United States Patent 12,616,207 (BOXWOOD ENDOPHYTE BURKHOLDERIA SP SSG AS POTENTIAL BIOCONTROL AGENT AGAINST A WIDE RANGE OF PATHOGENS) - sequence listing, part 3

SEQ ID NO: 1 - DNA, 5470797 bp, Burkholderia cepacia strain SSG (residues 3,647,199-5,470,797 of 5,470,797)
ttccgggtcgctgatgtacatgtactcggcgccgatcgtgccgcagtacgtgtcacgcaggcccttgacgatgtcgcgcaacgaagcctggtcgaaaccgaagtacaggttgcttgcgctgtacgtctggtcgaggtcgccttcggagaagtcgtagaacgcgggttcgagttcgggaatggccggacgttcgcgacgcttcaggggatcgagattggcccattgcgagccaaggaagcgataagcgctgatgagggactgcacgtgcacttgcttgcgcgctgcagcaaggttggtgctgctttcgcgcgggatgaaggcattggccttcgcacgctcggcgaacgattcgacgatcgggaaatgagcgacgtcattggcattcgagccgtccgttgcaggcacgttctgcagcgcgtcgaaatactctcgccagttctccggcaccgatgccggattgttgaggtatgcatcgtacagttcttcaacgtacgaagcattgccgccgaacagataggagttcagctgaaactgcttcattacatctgacattttacgctcacctttcttcgagcttctcgagaaatagcgggttactcaaccttccgcgacacggcctgaccgtttagcggattgcgaatcaagtcttgcttggaaggacctaaaacttgcgtgcgcgcagcatatcacagaaccgataccggagttcacggcgaaatgtgcctgaaagcaccgcgcgacggggttttgccggattgccacaacccgcgggaacagtgttttgcagcgcccccgattgcacatcgggcagatgcaaaaaggccacccgaaggcggcctttctcgtcctgcacgggaacgatcgatgcttagtcgaccgcgccttcgcggctcgcgcggcgacgctcgtgctccttcaggaagcgcttgcgcaggcggatcgactgcggcgtcacttcgacgagctcgtcgtcgtcgatgaattcgaccgcgtactcgagcgacatctggaccggcggcaccaggcgcacggcttcgtcggtgcccgacgcgcgcacgttggtcagctgcttgcccttgatcgggttcacgacgaggtcgttatcacggctgtggatgccgatgatcatgccctcatagagcgcatcgcccggcttcacgaacatgcggccgcgatcctgcagcttccacagtgcgtaggccacggcagcgccgtcgtcctgcgagatcaacacgccgttgcggcgctcgaagaccgaaccatccttgaccggtgcgtacgagtcgaagatgtggctcatcaggcccgtgccgcgcgtgagcgtcaggaattcgctctggaagccgatcaggccacgcgccgagatcttgtactccagacgcgtgcggccacggccgtccgatgccatgtcgagcatctcgcccttgcggcggccgagctcttccatcacgccaccctggtgctcgtcctcgacgtcgacggtcagcagttcgtacggctcgtgacgcacgccgtcgatttcctgcatcacgacgcgcggacgcgacacggccagctcatagccttcacggcgcatgttctcgacgagaatcgtcaggtgcagttcgccgcggcccgacacttcgaacaccgtttcgtcgccggtgtccttcacgcgcagcgcgacgttgtggttcagttccttcatcaggcggtcgcggatctggcggctcgtgacgaacttgccttcgcggccggcgagcggcgacgaattgacgaggaagttcatcgtcagcgtcggctcgtcgacggtgatcatcggcagcgcttccggcgtatcgaccgcgcagatcgttgcgccgatgccgacgtcttcaataccgttgatcagcacgatgtcgcccgcttcggcggattcgacctgcacgcgctcgaggcccgtgaacgacagcacctggttgatcttgcggttcagcacttcgccttccgggccgaagcgcatcgcgaccggctggcccggcttgatgcgaccccgcgtgatgcggccgacgccgatccggccgacgtacgtcgaatagtcgagcgacgtgatctgcagttgcagcggcgcgtccggatccgccggacggaccggcacgtgctcgaggactgcctcgaacagcgggcgcatgtcgccttcgcgcgcggccgggtcgagcgacgcatagccgttcaggcccgatgcgtagacgatcggaaaatcgagctgctcttcggttgcgccgagcttgtcgaacaggtcgaaggtctggttgatgacccagtcgatccgcgcacccggacggtcgatcttgttgacgatgacgatcggcttcaggccgagcgccagcgccttcttcgtgacgaagcgcgtctgcggcatcgggccctcgaccgcgtcgacgagcagcagcaccgagtcgaccatcgacagcacacgctccacctcgccaccgaagtccgcgtgccccggcgtgtcgacgatgttgatgtgcgtgccttcgtactcgaccgcgcagttcttcgcgagaatcgtgatcccgcgctctttttcgatgtcgttcgagtccatcacccgctccgcaacctgctggttctcgcggaaggtgccggactggcggagcagttggtcgacgagcgtggtcttgccgtggtcgacgtgggcgatgatggcgatattgcgaagggcgcgggtcatagaaacctggaaatcgtttgaacgcgcaaaagcgcccgctcgtttttcacgggcgcgcgcattgcagcttggaaagccgcaaattatagcacgtgagaatgtcggtaaccgacgggcacgttgcaacgcagcaggcaggccggcgcaccctcctctcgaacgcgccaatccgtcgaagcccgtgtcgccgtcgggcacaaaaaccttattaatatgagggattattgagacgcaaagcgcgccccttgccgttcgattaacatttgccgcggcaagcaactgtgcctatactgctgcctagtcaactattgcagcttcagggttttatgtcggattcttctaccccatccccgtttcgccgctgtcctcgtaccagatgaacgacagcgtcggttatctgatgtcgcgcgtgaagtcggtgatgaccaacctcgtcacgcaacgcacgcaggaagagctcggcatcacgggcacgcaggcgagcatgctgttcatgatcgcggtcggcaagtgctcgacggccgccgagcttgcccgcgagtacgggatcgacgcgagcgcagtcacgcgcctgctcgaccgggtcgagaagcgcggcctgctgtcccgtgtccgcagcatcgaggatcgacgtgtcgtgcgcctcgagctgaccgacgaaggccgtgcgctcgccgaacggctgccgccgattttccgcagcgtgctcgaccaggtgctggacgggttcacgccggaagaagtcgggttcctgaagagcatgctgcgccgcattctcagcaactattgcgagaccgccggcggcagcatcacgtaatagttgccataacaattacttttgacagattaatgtaaggaaatccttgcagtgtccatcattcattccgagtcagggatcagcgcgatgaaatcctccccgttgtccgtgcgcgccgggtcgtgccgcaccgccgtcgccgtcgcggtcgccgcactggcgctggcgggctgcgcgaactacatcggcatcaagagcgacaagcagatcgcccccgcgtcgcaattcgaatccgcccagagcctgccggcccagggcggccagtggccggcgctcgactggcccagccagttcggcgatccgcagttgccgaagctgatcgacgaagccctgcagggcaatccgtcgatcgctcaggcacaggcgcgcatcgcaaaggcgtcgtcgtacatcgaatcgtcgcgttcgaacctgatgcccaaggcggaagccagctattcgtggacgcgtgagctgtattcgtcgaacgcgctgttcccgccgccgtacggcggccagtggtacagcgagaacaacgcgctcgcgagcgcgtcgtgggaactcgacctgtggggcaagaaccgcgagcgcctgcacaccgccgtgtcgcaggaaaaggcggccgaagccgacatgcagcaggcacgcatcacgctcgcgtcgtcggtcgcacgcacctacaactcgctcgcgcagctctatgcgctgcgcgatatcgcccaacgcgagatcaccaaccgcgagacggtcggcaagatcaccgacggtcgcgtgtcggccggcctcgacaccaacgtcgaacgccagacggcccgcggcaatatcgcgacgacccaggcttcgctgtccgatctcgatgggcagatcacgacggtgcgctaccagctcgcggcactgctcggcaagggcccggatcgcgggctgcagatcgcggcgcccgtgatgaacccgagcggcgatgtcgcactgcccggcaacctgccggccgatctcgtctcgcgccgccccgacatcgtcgccgcgcgctggcaggtcgaagctgcgatgcacgacgtgaaggaagcgaaggccgagttctaccccgacgtgaaccttgcggccggtttcggcttcgatgcgttcggctggggcaaattcctgaacttcgcgagccgccaggcgcaattcggcccggcgatccatctgccgattttcgacgccggcgctgcgcgcgcagctcaagggccgctacgcggacttcgacctgtcggtggcgaactacaaccagacgctgatcagcgcgctgaacgacgtcgcgacgcaggtcgcgtcgatccgcgcagtcgatcgccagatgggcgacgcgcaacgcgccctcgacgcatcgacgcgcgcatacgacctcgcggtcatccgctacaaggccggcctgtcgccgcagttgcaggtgctgaccgcggacagcaaccgcctcgcatcggagcagacggtgaccaacctgaagatgcgccggcgcgacatgcagcttgcactgatcaaggcgctcggcggcgggttcgacgcgaccggcacgccgcttgccgcgcccgatgccgacaagccgacaaaacaggccgccaactgatccggcgccaccactacgcagacactcgaaataacggacggagaaaatcgccatgagcgaccaacaaaacgccgccagcgcgcagccgcagaacaacggcaagcgcaaacggatgatgacgctgctcgtcgcagtcatcgtgatcgcggccatcgcgtatggcctgtactacttcctcgtcgcccgcttccatgaagggaccgacgacgcgtacgtgaacggcaacgtcgtgcagatcacgcctcaggtcaccggcaccgtgatcgcggtgaaggccgacgacacgcagacggtgaaggccggcgatccgctcgtcgtgctcgacccggccgactcgcaggtcgcgctgcagcaggccgaagccaatctcgcgcagacggtgcgccaggtgcgcggcctgttcgtcaacgacgaccagtatcgcgcgcaagtcgcactgcgccagtccgacctgtcgaaggccgaggacgacctccgtcgccgcgtggccgtcgcgcagacgggcgccgtgtcgcaggaagaaatctcgcacgcgcgcgacgccgtgcgcgccgcccaggcatcgctcgacgcctcgcagcaacaactcgcgtcgaaccgcgcgctgaccgcaaacacgacgatcgcatcgcatccgaacgtgatggccgcagccgcgaaggttcgcgacgcgtacctggcgaacgcgcgtaacgtgctgcccgcaccggtcaccggctatgtcgcgaagcgctcggtgcaggtcggccagcgcgtgtcgccgggcacgccgctgatgtcggtggtgccgctgaacgcagtgtgggtcgatgcgaacttcaaggaagtccagctcaagcacatgcgcatcggccagccggtcgaactgacggccgacatctacggctcgtcggcggtctatcacggcaaggtggtcggcttctcggcaggtacgggctcggcgttctcgctgctgccggcgcagaacgcgacgggtaactggatcaaggtcgtgcagcgcctgccggtgcggatcgaactcgatccgaaggatctcgccaagcacccgctgcgcatcggcctgtcgatgcaggtcgacgtggacatcaaggacgaacgcggcgaccagctcgtgaacgcaccgaacaccgtctacgagaccaatgtgttcgcgaagtacggcgacgaagccgacgccgaaatcgcccgcatcatcgccgagaatgccggcggcaacgcaccggcgccggctgcggcgaagtcgagtgccgtcgcgaagatgatgtaaccgttccgactccggaaagacaaccgacatggcacaggcacctgtctctcacccgcccttgcagggcgggcagctcgtgatcgggacgatcgcggtatcgctcgcggtgttcatgaacgtgctcgacacgtccatcgcgaacgtcgcgatcccgaccatctcgggcgacctcggcgtgtcgtccgaccagggcacgtgggtcatcacgtcgttcgcagtcgcgaacgcgatctccgtgccgctcaccggctggctgaccgaccgcttcgggcaggttcgcctgttcctcgcgtcgatcatcctgttcgtgatttcgtcgtggatgtgcgggctctcgcccaacctgccgttcctgcttgcgtcgcgcgtgctgcagggcgcggtggcaggcccgatgattccgctgtcgcaagcgctcctgctgtcgagttatccgcgcgccaaggcgccgatggcgctcgcgctatgggcgatgacgacgctgatcgcgcccgttgccggcccgatcctcggcggctggatctcggacaactactcgtggccgtggatcttctacgtcaacatcccggtgggcatcgccgccgccgccgcgacgtgggcgatctaccgcaatcgggaatcggccgtgcgccgcgccccgatcgacggcgtgggcctcgcgctgctggtcgtctgggtcggctcgctgcagatcatgctcgacaagggcaaggatctcgactggttcgcgtcgacgaccatcatcgtgctcgcgctgaccgcggtcatcgcgttcgcgttcttcgtcatctgggaactgactgccgagcacccggtcgtcgacctgtcgctgttccgcatgcggaacttcaccggcggcaccgtcgcgttgtcgatcgggtacggcctgtacttcggtaacctcgtgctgttgccgctgtggctgcagacgcagatcggctacacggcgaccgacgccggtctcgtgatggcgccggtcgggctgttcgcgatcctgctgtcgccactcaccgggaagtacctgccgcgcaccgatccgcgctttatctcgacggcgtcgttcctgacgtttgcgctgtgcttctggatgcggtcgcgctacacgacggggtcgacgaatggtcgctgacgctgccgacgctcgtacagggcatcgcgatggccggcttcttcatcccgctggtatcgatcacactgtcgggcctgcccggccaccgcattcccgcggcatcgggcctgtcgaacttcgtgcggatcatgtgcggcggcatcggcacgtcgatattccagacggcctgggaccatcgcaacaacttccatcatgcgcaactggtcgagcaggcgaacgtctacaacccgacgttcaaccaggccgtcacgcagatgggcaacctcgggctgacgcgggaccaggcacacgggctgatcaacaacctggccacgcagcaggccgcgcagctcggcgtgaacgacctgttctacatctcggcggcgatcttcgtgctgctgatcggactgatctggatcacgaagcccgagcgctcgggcggtggcgatgcaggtgccgcggcatcggctgcacactgaatacgctgcctggacgcaaacaaaagccccgcttcgtgaagcggggctttttcattccgacgggcacgcgttcgcgcggctgcgtcaggctgccgtgacgacgagccgctccggcgccaatacgccgtttgccttgcgggccacgccgagcaggcgagtcgcgtcgtaaacgcgcacgcgcccgccttcggccgcatcgatcgggtcgagcgacgacagcggcaaacgctgcccgtgcaggaaccgcttcgcgctggtttcatcgagacgaaccagcggaaacgtcgacagcaacgcatcgaccggctggagccacgcatcacgtgccgcttcgtcggcatcggacagcgcatcgagcgttaccgcatgctcgagcgtcagcgcgccgacgcccgtgcgccgcagcatcgtcagatgcgcaccgcaaccgagcgcctcgccgatatcctctgccagcgtgcgcacataagtgcccttgctgcaggtcacgcgaaacgtcacgtcaggcaggtcgcacgcgagcaggtcgagggcgaggatcgtcacgttgcggccctcgcgctcgacggtttgccccgcgcgggcatattcgtacagcggtttgccatcgcgcttgagcgccgaatacatcggcggcacctgcacgatctcgccggtgaagcgcaccagcgcggcttccaccgccgcacggtcgcattcgacggggcgcgtgtcgatcacctcgccttccgcgtcgccggtagccgtacgctggccgagacgcatcgtcgcttcgtaggtcttgtccgcttcgagcagatcctgcgagaacttcgtcgcctcgccgaaacacagcggcagcaaacccgaagccaggggatcgagcgtaccggtgtgaccggctttttcgcgagcagcaggcgcttcgcgcgaatcagtgcatcgttgctcgaaaggccgaccggcttgtcgagcaggaggacgccgtccagcacgcgccggggcacgcgcggacgttgggatgctgcagtcgtcataggccggtcgagctcagtcgtccttggtagccgcgtcggcctcgtcgtcgtccttcgcgcgcgtcgagttcgcttccttgatcaggcgcgacatttccacggccttctcgatcgtctggtcgtagtggaaatgcagcgtcggcaccgtatggatgtgcaggcgcttgaacaacaggttgtgcaagtgacccgacgcgtggttcagcgcttcctgcgtcttggccggatcgccggtcaacgcggtgaagtagaccttcgcgtgcgcataatccggcgtgagttcgacgctctggatggtcacgatgccgatgcgcgggtctttgacctcgcgcatgatgagttcggacagatcgcgctgaatctggtcagcgatctgcacgttgcgattggggaagtacgtttcctggacatgatcgatccgtgatccgtttatcaggatgaagcggcggccagtgttggcgcgccaccatgaaaatgggcgggacaggcccaagcctgccccgcccatgagccgatgcgcgaggattacagcgtacgcgcgacttcggtcacttcgaagacttcgaactggtcgccttcgatgacgtcgttgaagttcttcactgacataccgcactcgaagccttgcttcacttccttcacgtcgtccttgaagcgcttcagcgattcgagttcgcccgtgaagatcacgacgttgttgcgcagcacgcgaaccgacgacgagcgcttgacgataccgtccgtgaccatacagccggcgaccgtgccgaccttcggcaccttgaacacctggcgcacctcgaccatgccggtgacgacttcgcgcttctccggcgccagcatgcccgacattgccgccttcacctcatccactgcgtcatagatgatgttgtagtagcggatgtcgatgccgttcgcttcggccagcttgcgcgcctgtgcatccgcacgcgtgttgaagccgatgatgacagccttcgatgccgttgcgaggttgacgtcgttttcgctgatgccacccaccgcgctgtgcacgatctgcacgcgcacttcgtcggtcgacagcttgagcagcgactgcacgagcgcttcctgcgagccctgcacgtccgccttgatgatgagcggcaggttctgcacttcgccttcgcccatctgctcgagcatgctttccagcttcgcggcctgctgcttcgccagcttcacgtcgcggaacttgccctgacggaacagtgcgatttcacgcgccttgcgctcgtccggcagcacgatcacttcctcgcccgcgcccggcacttccgacagaccctggatttcgaccgggatcgacgggccggcttccttcgtcggcttgccgttctcgtcgagcatcgcgcgcacgcggccgtaggccgtacccgccagcacgatgtcgccgcggttcagcgtaccggactgcacgaggatcgtcgcgaccgggcccttgcccttgtcgagcttcgcttcgatcacgatacccttggccggcgcttcgaccggtgccttcagctccagcacttcggcttgcagcagcacgttctcgagcagatcgtcgatgcccgcgcccgtctttgccgacaccggcacgaacggcgaatcgccaccgtattcttccggcacgacgccttccgcgaccagttcctgcttgacgcgatcggggttcgcttccggcttgtcgatcttgttgatcgcgacgacgatcggcacaccacccgccttcgcgtgggcaatggcttccttcgtctgcggcatcacgccgtcgtcggctgccaccaccagcaccacgatgtcggtcgccttcgcgccgcgtgcacgcattgccgtgaacgcttcgtgacccggcgtatcgaggaacgtgatgacgccacgcggcgtatcgacgtgatacgcgccgatgtgctgcgtaatgccgcccgcttcgcctgcggcaaccttcgcgcggcggatgtggtcgagcagcgaggtcttgccgtggtcgacgtgacccatcaccgtgacgaccggcggacgcggcagttgctctgcgtcggtaccggtttcgccttcgacgagcagcgcttccggatcgtccagcttcgcggcaaccgcgcggtggcccagttcctcgacgacgatcatcgccgtttcctggtccagcacctggttgatcgtgaccatctggcccatcttcatcatcaccttgatgacttcggaggccttgatcgacatcttgtgcgcgagatcggcaaccgacacggtttccggcacgtgcacttcacggacgatcggctcggtcggcgcctggaaggacgatgcactgtcctggtgacggccacgacccttcgggccgccgcgccagccgcggtcgacgccgccgctcgaatcgccgcgcgtcttgatgccgcgacgcttcgacgcgtcgtcctgccagccgcccttgcctgcgcccggcttcttgttgcggtcgcccgcgcctgccggcgcctgcgtcgttgccggtgccgcaccggccggcttcttcacggccgggcgcgcctgcgcaccttccggctttgccggcttgtgcaacgtgcccttcgcttcggccggcttcggcggctcgaccggcttcggcggctcgactgccttgacgacggccttgcgcggcgtgttcatcatctcgcgaatcgcacgcgcttcggcttctgccgccgcacggcgcttgctgatctcttcctgctcggcacgcgccttgtccgctgcctcgcgggcagcgtcttcagccttcttcgccgcttcgcgctgcgccgcacgttcggcggctgcgcgcgcctcgtcctgcgcggactgcgccgattgcggagtctccgcttcctgttcggctgcaacagcctgctgtgccgctgcctgctgctgtgccgccgcagcttcggccgcggcacgcttcgccgccgcttcttcttcggcgcgacggcgctcggcttcggccgcctcctcgcgggcacgacgttccgcttcctcgcgctcgaggcgctcctgacgctcgcgcagttcctgcgcctgcttctcgagcagctcggcctcgcggcgcgcttcttcctcgcgacgcttcagttctgcatcgtcgtccgcttcggcgacctgcgcctgaccctgttccgcaccttcggccacgtcgtcgcgcttgacgaacgtacgcttcttgcggacctcgacctgaatggtgcgagccttgcccgtcgcgtcagattgcttgatctccgacgtatgcttgcgggtcagcgtgatcttgcgcttgtcgccgtcggttgcgccgtgcgacttgcgcaaatgatcgagcagacgcgccttgtccgtttcggacagcgcatcgtcttcactcgctttctggacgcccgctgcctgcagctgttcgagcagcacaccagcaggcattttcagttccgcggcaaattgggctacgttgttactcgccattcattcctcttagtgcaaggaccgattccttgcggttagcatcgggtcaggccatacggccgccatcaaatcagtgcgccatggtcatttctcactggaaccagtgttcacgtgctttcatgatcaacgccttagcggcatcctcttccatcccggtcatgtcgaccagttcatccacagccagctcggcgagatcgtcgcgcgtctgcacgccgtgttcggccagcttcgcgagcagctccggcgtaatgccgtcgaggctcttgagatccagcgctgcgttctcgaccttttcttcgttcgcgatcgccatcgtcaacagcgcgtcgcgtgcgcggttgcgcagttcgtgcacggtgtcctcgtcgaacgcctcgatttcgagcatttcgttgagcggcacgtacgcgatctcttccagactcgtgaagccttcgtcgatcaggatgtcggcaacttcttcgtcgacgtcgagacgcgccatgaacagcgcacgcagccggtcgcgttcttcaccctgcttcagggcggattcgtccggcgtcatgatgttgatctgccagccggtcagttcgccagcaagacgaacgttctgaccgctgcggccgatcgcgacagccagctcgttctcgtcgacgacgacgtccatcgagtgcttttcttcatcgacgacaatcgactggacagctgccggcgcgagcgcgccgatcacgaactgggcgggatcctccgaccatagcacgatgtcgatgttttcgccaccgagctcgttgcgcacggcctgcactcgggaaccgcggataccgacgcaggtgccgatcgggtcgatccgcttgtcgtacgcgatgacgccgatcttcgcgcgcacgcccgggtcgcgggcagccgccttgatctcgagcaggccctgctcgatttccggcacttccatctcgaacagcttcatcaggaactcgggcgccgtacgcgacagttcgatctgcgggccgcgcgcggtgcggtcgaccttcgcgatgtacgcacgcacgcggtcgcccacgcgcaggttttccttcgggatcagctgatcgcggcgcagcagcgcctcgacacggcccgattcgacgatgaagttgcccttgtcgaggcgcttcaccgtacccgtcatgatcttttcgccacgttcgaggtaatcgttcaggatctgctcgcgctcggcgtcgcgcaccttctgcaggatcacctgcttcgcggcctgcgcgccgatgcgaccgaactcgatcgacggaacgggttcctcgacatactcgccgacttcgacgtcgggcttctgctcacgcgcttcgaacagcaggatctcgcgatccggctcctgcaagcctgcctcgtcgggcacgacgagccagcgacggaaggtttcgtgctcgccgctttcgcgatcgatatggacgcggatttcggcgccttcgtcgaacagcttcttggaagcagatgcgagcgcggcctcgagggcgcccagcaccacatccttgtcgacgtttttctcgcgccagcgcatccaccagcatcaacacttcgcgactcattatttgcggctcctaaagtcaacttgcggaatcaggcgggctttgtcgatatcggccagcgtgaaatccagcatggccgcctcgcccttcttcctctcaaattccaaaccgatcgtttcgccattcggcgcgtgcagaatgccccggtacgtcttgcgcccgtccagcggctttttcaaggtcacggaaacttcgctgccggcgaagcgctcgaagtcggccagcttcttcaacgggcggtcgagccccggggacgagacttcgagccgttcgtaatcgatgttttcgaccgtcaagacgtgctggagctgacgcgtgaccttttcgcaatcttcgagcgagatgccggcaggctgatcgatatagatgcaaagcatgccgcgcccagtgcgctcgagatccaccagctcgtaaccgagcccggtgaccgtggtttctatcagttccgtcagttgcacagtgtcctctcaggtgttcgcgcccgccgctcgcgaattcacccgcgggcgcgcgccttagccggcgcaggaagcgctacccgagatgcctaaccgtttcagcaaaaaaatgggcggaacgcccatcttcttactggtggtcgcacctgagccgcacattgaatccgtacgcccagcgactccgcgattatagcgatttttggcgcaaacgccaagccagccggtaaaagcagcgtgtcgcccgcctttaccgacccaaaaatgcgaaatcgggttatccgatcagccagcaccatcctgccaggccggagatcggtcatgccggctgcgacgcagcggcacgcaatatatatacagtcgaaagcgatcggcgcaatacgccgtaccggcaaaatcggcgggatgccgatcgggccggcacgccggcggctttgcgccgccgtgcgccaacatgtgtttagcggctgcgcgtacgactgcgctgctgacgctggccgccgccgcgcggaccgccgccgttgccggcgccgtcagcccgattgccgttcggattgcgattgccgccacccttgctgccgccgcgcttggcgcccgcgccttcgcgcttggggcctgcgccgtacgacgcacggttgccgtcgacatcacggccgccacccgctcgattgccgtcgcgaccaccgcccgcgcggttgccatcgcggccgccgccggcacgattgccgtaacccgacggcgcaaccggcaggctgccgtagccgctcaggcccggcaaacccggcccgccgcgccgaccgccgccgcgacgcggctgatccagctgcccgtgagccgtcagcaccggctcgcggctgatgaagcccatcgatgtctgcatcggatcgggctggcgacgctcggcctggccggcaccgccgcgcttgcccttctcctcggacggcgccttcagaccaacggtcgccatcagcttgcgcacctgcgtgtcgtcgagctcctcccagcggccgcgcttcagaccgcgcggcagcggaatcgggccgtgacgcgtacggatcaggcggctcaccatcaggccgaccgcctcgaacatccggcgcacttcgcggttgcggccttcggccagcgcgacgtgataccagtggttcgtaccctcgccgccgccgtcgcggatgcgcaggaagtttgctgggccgtcatcgagctcgacaccatgcagcagcttctgacgcatgccttcggccagttcgccgacgacgcgcaccgcgtattcgcgctcgacgctgtagcgcggatgcatgaagcggtttgcgagatcgcccgaagtcgtcagcatcagcagaccttcggtattgaagtcgaggcggccgaccgcgagccacttcgccgtcttcatcggcggcagtcggtcgaataccgacggacggccttccggatccgcgtgactgacgatctcgcccgtcggcttgtggtacagcagcacccgcggcggcttgttcggcagcttgcgcttgaccggcttgccgttgatccgcacctggtcggtcggcatgatgcgctggccgatgtgtgcgggctcgccgttcaccgacacgcggccggcgacgatcagctcttccatctcacggcgcgaacccatgcccgcttccgccagcaccttgtgcagcttcggcgcgtcgtcgtccggcgacagcacgcgcttgttcgccggctggttgcggccacgacgcagcatcggcgcacgcacgccgctaccgcccgcggaattgtcggcgtcgaatgccggcgacgtcacgtaggcaaacagttcgtcctgggacgcatcgccttccgtcttcgccgcaccaccttcagccttcgatgcgccgccgcgacggccctggccgccctgaccgccctgggccttggtcgcactttcgcgcttgccggccggcttgcgaccgcccttggccgcgccttccttgcgcggcgcacgcgccggctgctgcgcttcggcggcttcggccggctgcgcgtcagcgtcttcgccaccctgcggctcgccttcggcgcccttcgacttggccgccgcgcgacgtcgcgcgatcaggctgcgcgggcctcgccgcagaccgcggcggggacgttcgtcgccaccctcggccggagcgccctgctccggtgcatcgtcggcacgcgctgcctgcacggcaggcgcggacgattcaatatcgtggatctctgtcaaaacaacctcaaaatgtcaggtctcgcgcccggcgcgggcgcggcaagaagttggccgcgttcaggcgcgacgctgttcgggttctgcttcgtcgtccggcagcgcgtcgacaccgatgggtgcactggcgcttcgtacggcatcggcgagactgtcggacgtgtcgtccagcatctcgccgtccgcgggacgggaacgggaggcgccggcctgaccagcctcgccgggcatgtcgccggccgcttccgttccgtctccggcaaccgcttcggcggccggcttgcgatcttcctcgctccaatccgcgcgcagcggctcgggctgcacaccggccggcactacttcggcgccagcctgttccagttgttccgcttgcccgcgatcagcttcgagcgtatcgcggctcgcgatttcctgcgtcggcacgacgtccgtcgcggaatcgcccggcaatcccgccggctggccggcggatgcctcgtccgcctgcggcgcgtcgcccgctgcgtcgtcggcaatcgacatgtctccgtcgaaatccatcgcctgctgcgccagcagcgcagcctcgatgttcgcggccggctcttcgagcgccggcagatcatcgagcgccttcaggccgaggtcgtcgagaaactgcttggtcgtcgcatacagcgccgggcgccccggcacgtcacgatgaccgatcacttcgatccagccgcgatcctcgagttgcttgaccacctgcgtattgaccgtgacaccgcgaatctcttcgatgtcgccgcgcgtgacgggttgccggtacgcgatgatcgcgagcgtctcgagcaccgcgcgcgaatatttcggcggcttctcgggatgcaggcgatccagatagtgacgcatcgccggcttgctctggaagcgccatccggtcgccagcgccaccagttcgacgccgcggccggaccaatcctgtttcagatcttcgagcaacgtgcggaccgtgtcagccgacacgccgtcggcaaagagcttgcgcaaatcgccgagcttcagcggttcctgcgcgcagatcaaagcagtctcgaggacgatcttcgcctcttgggtattcatgcagctaggccagaccctgtggtcaaacgaaccggatcaacaaacagacgaaaggaacggaagacgcgctcgcccgattctgatcggtcatattgatgggagcacgaaccggggcggcgaaccaacttcaggtcaggcccaaaccggacggaacagcacggctcaacgacggaaccgcgtgactgagcgccatattacgcaaaattgcccggtgcgtaaagatgagccgaaccggccgccgccagcgcgccgaatccgctccggccccgcttcagcgggtggccgctccgcgcgcgaggaagctgcgcagccgctcgacgcccgcgtcgagtcgtgccggatcgcatgcgtagcaccagcgcacgaacccttcgccttccgggccgaatgcacgcccgggcgcaaggccgagccctgcttcacgcaccagcgtcttgcagaacgccagactgtcggccgcgcccggcaggcgcaggaacaggtacatcgcgcccggtggcggcggcactcgacgcccggcagcgtgcgcagcgcggcaaccaggtgatcgcgcgcgtcacgcagcgccgcgacgaacgaccgcacgaacggctcgccatcgcgcagtgcgacctcacccgcagcctgcacgaaacccggcgcgcacgacgtgttgtattcgacgagcttcgacaggtcgcccatcaccgctgccggcgcgatgagccatcccaggcgccagcccgtcatcgcccacgctttcgaaaacgaattcacgacaacgacccgctcttcgcgcgacgcgatgtcgaggaacgacggcgcgccgtccgcgccgaacgcgagccgctcgtacacctcgtcggcaaccagccagatgccgtggcggcggcaatgggcgagcacggcccgctggtcgtcacgcgacatcgtccagccggtcggattgttcggcgagttgatcagcagcatccgcgtatcgggtgtcagcgccgcaagcagccgcccgatctcgagctgccagcctgcctcgccatagccgagcggtacgcattcgacccgcgccccaagaatcttcggaatctcgacgagattcggccacagtggcgtgaccgcgacgacgcgctcgcccggaccgaccagcagctgcgcggccagcatcagcgcactcacgcccgaactcgtcacggccacggtgtcggccgccgtcgcaccgtgacgggcgctgacgtaggccgcgatcgcgtcgcgcaacggcgcggtaccgaggttgtgcgtgtagaaggtttcgccgtcgcgcagcgccgccgccgcggcgtcgcggatgaagtccggcgtcacgcgatcggattcgccgaaccagaacggcagcatgtccggcacgccgaagccggcgtttgccacttcccggatcagcgacggacgcaacgcgtgcaccacatcgcgcgccgccagcgcgccagacaccgaaagagaacctgcagaatgcgccatcgagcaccaccatcgaggaacacgatccgcgtagtgtaccggccccaagccgtaccgacgcgcgtcggtacgcgtcagtcgaggtcctccgccctcgccggcatctgccgcacaagctcccagatcgcctgagcggcaggcgacaacgacctgtcgcggcggcgcaccagctcgaccgtgcgttcggtgcgcggcgtgagcggccgcgcgacgagcgtcgagccggccggcagcggcagcgacagccacggctgcacactcacaccgacgccggcctcgacgaggccgaacacggtcgccgaatgcccgagctcctgcatgaccgtcgcgttgacacgatgggcggccagcgcggcatcgatcagcggccggcttcccgacgcatgatcgaggagcacgaggcgctcgccgtccagcgccgtccagggcacctcggtgcgcgccgcgagcggatggtcggcgcgcgcgacaaggcagaacgaatcggtcatcagcggttcgcagacgagatcgccaaccgtgagcggcccgatcacgacgccgaaatcgacctcgctcgacttcaccttgcgcaacacatcgctctgcacgtcgtcgcgcaagcccagcgtcacgaacgggaactggcgctcgcacgacgcaaccacgcgcggcatcagccggcatgcgatcgtcgggctggccgcgacgatcacgcgaccccggcgctgctcgccgatttcgcgaatctcgcgcagcgtgtcgtcgagatcgtcgagcagacgagacacactcgcgatcaggttcgcgccgacatcggtcagctgcacgtcgcgcgtcgtgcggtcgatcagcttcaacccgagctcggcctcgagctcgcgcacgcagcggctgaccgcggactgcgtgagcccgatttcgtcgcccgcgcgactgaagctactgagccgcgctacctcgatgaagacgcgaagctggcgcagcgtgacgttcatttcctgacctcatcaatcgtcgatatcgatgcgcgattttaatgcgcgattccggcgtcgatgtacgaatcaggcgcttgcccccatgtttcgctgcggtgcaatacctacgcgaacgcacgcggtgcgggcgaactgcacaagattggtgattgtcccgatttgctggcgggttattttggcgtcttatacgcccctagctgacttagccgttagctcgctgccaagcggctctcgaggaattacctccgacatggcacgcttcgtgcatcacctggcgcacagggcgcaggtttcgtcggacggaagagcagaaacgccgctgccggccaaccggacgccccacccggcactcgacgatcgagtgcttgaagagtgcgcggcgcagggcagcgcaccggagttagcttcgctgaggtgaggacatgatgctgttcgacgatttgagagataacgagtgggcgctggtcgaaggtctgttttgctcggaacccgcacggagtgagcggcgcggccgcccccgcgtggaagcccgctcggtggtgaacgccgtgctgtgggtgctgtcgacgggcgaaggctggtcgaagctgccaggccgctatccgtcgccgccgacttgccgccgccgcttcgacgaatggcaggcagacggcacgctcgccgaaatcgtgaagcgactcggcacgagcggccggcagatctcctgcgcgggcgcatcggcgcgagtgctgcgaagccgcccgccccgccgagccgcgaccggctgcgcggcgccttctggaccaatccggaatcctggcgcgcgcccgtcaagatggcgtaacgaatgctcgatcgggcggcttcggccgcccggtttctttccgcaactcgatctgttcgcgacgcctgcggtgccgtcgattaccgttgtcgtggcgcgatacatctatttaccaatatttacagcaagcctgcactcccgcgcttaccttagcgacatatcaacaagccgcgtggcttgaggggagccgccatgaaaccaatgtcactgctcgttgcatgcggcattgtcatttccctggcgttgtccgctccagcccgcgccgacgatcgcgcgaagccgccccatcgccagcaggatcaccggaacacgccccgccagccaccctccgccaacgcgtccggccggcagaccgtgccgcgcggcgacctgcgcggcgacatcgccagcaatgcgcgagcgcgcatcggctcgcagccgtcggacgtaccgcgtcatccgtagtcctgccaatttcaggatttcaccaaagaaaatgcccgctgccgggaactgcgccgcatgcggcgagtcacaacgttgccatgagcacagcgtggcaacagcaaagtatccggtacgcccgtatcctcgcgatacgggctttttcatcgcctgccgctcggcgttgcgtgcggagaaatgatcggccgctacaggcggctttcgagaatcgccacggcactcgcttcgctcaatgcgtagtcggccatgcggcgatcgctccaggaaagtaatttctcgtcgcgctcgaggcgcgagaactcggctcggccgctttcggtcagcacggcaatgtcgaccggtgcgtgaaagcccggcgcgggggcaacggttttctgcctgaccgtgtccatcagcccaagcgaacggagatactcgaacacgcccgggcggcgcgcccacggtacctggcggtactgcactcgtctcaatgcgtcgagcaccgcttcgttggaatacgtggccatctcgattctttcttaaagtgcagcgacaatgcgaagcggcgcgccgggcgggtctccacccaccgataccgccaccgattctggaggccgacgttcggcgtcgcgtcagggctggatcgtcagccgtccataaaaagacaccataccccaatcaaattgattctgttcgattcatttgtacttctcttcatctgtttcatgctctgccgcaagcggcggcaaatcatctcgatggccgccgctgcgctgttctggctgctcgcgacaggctggctcaccgcgccgctgatcgcgtggaccgaggcgggagtcgtacctgtcgagcacccggacatgcatgggcggaccacactgattctcatcggcgccggaacacggcgcaccgacgccgggctgcaacccccgcctgacggagccgcccgcatccacaaggtcgcggcgctctaccacgcgtgccggcagcaggccgcacactgcaccgtggtgatgtcgggcggcgacccgcagcatcacggagaaaccgaagcggccgtctacggacgccagctcgtctcggaaggcattgctcccgcggacctcgttctggaaccagatagccgcacaacctacgaaaacgcgaaattcactgcgcctatactacgctcacagcatgacgacgcacgcattctcgtcacttcgtcatatcagatgcgccgcgcattgctcgatttccgccacttcgggatcgacccgcagcccgtttatgcgaatcgccggcgcgcgcaaaccggctggctgccgcgctggcgcaacctggccaacgccgaacaggcgctgcatgaactggtcggcatcgcgcagttccacgtctatcgatggctcgggtggttctgactgacggctgcgggaaacccgagcgggaatgaatgcggcggcgacgatggcaggcgcgtgacgaagtgtgcgaagtgttgcgcgacttcaacggggccttgcgtcccgcctcgatccgatgcacattgatccgtcacttttgttacactcgacacgcactcgattgcagtcgccagacaaaacggcaacactcgggttcatcaccacttagcggaggtaaagcaatgaagaagacgtccctggctatcctggtagcgatgtcggcgctgactggcgcagcgtatgcgcaagagagcacggaaatcaagacgattaccgatccggccaagatctccgagatcgagcagcgcgcacaggcgctgcagcagcagcaagcggccgaagccgcacagccggcgatgcaggaagagcatcaccacggcaagaaggctgctcaccacaaggctgccgcgaagaaggccagcaagaaggctgccaaggccgcagacgctgccagccagtaagttcggcggtaccgcacaagaaaaagccgaatccgggcaaccgggttcggcttttgattgcggcacgcgtgcgctgtgctaaagtcgcgcaccgaatttttccacccgtgcgcaccccggtgcggaggacagcatgagcaacattcaactcgacatcgagtggaccgaagccgccactcgccagatcaagcaactgatgccccgcggctcggccgacgcattcctcgcgctgccgccgatcgagtgcctgccgatggagggcgacgtgctcttcctcggcccgcaaggcaaacagcaaccgttcatcgtcgccgagcgccagtatcatcacgacggcgacgccgactggacgatcatcctgatcctcgacgtccccaacacgtcgcactgacgcacccgcgaccggacacgtccggtcgccccacccggctcagacgagcttcgacagcacgcggatttcggaacgctcgatccagtccgcggccgcttcgcgataagcaagaatgtgcgcggaacgcgcatgggcagcaagcgcctcctcgctttcccaacgctcgacgaatacgaaccgcgcgggctcctccagatcccgatgcaggtcgtactgcagcgcgcctgcttcgttgcgggtcggctcgacgatcccttcgagctggacgcgcaacttctcctcggcgcccggcttcgccacgatcagcgccacgactgcaatttccgccattccgccccctcatctcgaaaagtccgagaatacgcgaatcgtgtatcggctgcgccggcacggccccgcacgacggccaaaaaatagcccgcgcttcaaagaagcgcgggcgaaaccgtcgccctacgaggataggcgacggggccatcgggatccgcacgctggcgcggatcatcatcagttgtgccgacacttgtcgcatcggcattcgaagacgtcgataccgttgatcgggcgctcgcggcgcaccccggtatctgacgccatcctccctgtttcaacgattccaacatataaagcaggttgcgtgccagccatcacacgcgaaccacctcattgatttataaggacaaaatttttgcagacgacaatacggcatgtgttctgccgccgtaacgcgcggatgttacgtaacgtcacgagaagggactgaacacccctctcatgtgcgcgccggcgagcggccaaaaaagcccgccatgtggcgggcttttcatggtgcggagaaaccgcggaaatcagcggagctgattcacgagcaaccccatgatctggcgagccggcgacgatgtgtcgatcgcacccgaatcgtcaatgaccgccacgcgcgtctggtcggccgtgagcgccttcacgttgacacggtactgcttcgcctgcttttccttcttgccgtggaacagctggctccagaagccctgctcggccgaagtcagatccttcggatcgacgtaacgcacgaaatacaggcccttcgtgcgatcgcgatcatcgaccgtgaagttcgcacgatcgagcgcgagaccgacgtgcaaccacgaccggtcgtacggctcgccaagcgtgacttccgacggcacggccgcgtcggccgcatcgttgccttgcgccgacgtgcgggagacgttttgcgcggcaatcgcggcagccgccttcgacgacgcgtcggtgtccgccttcttgtccttcggaatcgtgttgtccttgatgttcgcgatcggcggctcgccgttcttcgcgcgctgctcgttctgtgcgagcacggccatcaaccgcttcaggtattcggtctcgagcgccggatcgttcggcttcggttcccacttgctcgaatcgttgttcgcgcccgtgatcgcttcgcgcatccccttctggctgatgaacacgtaggtgccgccattcggcgccgcatcgagacgcgtacggtacttgttgcgctcggccgtcacgtacgagttgcccatcgccttcgagatcacgctgcggatcaggccgtcgttgatctgcggatgggtttcgttccagtcggtttccatcacgcccttgtcgcgctggtcgacgacgagcaggaaaccctgctcctgccagaagcggcggacctgcgtccagacgtcggccggctgcttgccgtcgatcacgagccagctctcggtgccgtcgcgctggatatgcatgccggctacggccggagcaacggtgtccagcgcaggcgccgcctgctggacctgctgaagcgcggacaggaagtcgcgccgccctggggcggcagcgaacgctgatcggccgtctcgtcgagcatgttgggcggcactgcgagcgacgcttccttcgatttcgaatcgctcttgtagtccactttcgtgggcgacgacgtaccgcaaccggcgacgagcgcgccggtggcgagcactgcagcgaaccgcatggtaagacgaagatcagtcatgttcgggaatcctcttccgctaaatcacggcgctttccgtggatcaaccttgcattttaccggggccgcgccgcgatgtgcaaaaagcgaccggcaagaaaaacccgcgtcagcccaagctgacgcgggttcttgtctggtcggggcgagaggatttgaacctccgaccacctgcaccccatgcaggtacgctaccaggctgcgctacgccccgaaagaaaaaaattataacagacagttttccgatttagaacgggtcacatgcattttgtgaatgttcttgcgaaatttttggcgtgacgcctccgatgcagccaacgacgcgcatgatatggcgaccttcgcaccggccgcacggcccccgcgcatcgcattcaaagcttgcgcgcgatacagatgaccgtcaggccggcgacgcggttgaagcgaaacatcggcaactcgatccggcagatcgtcttgagcaagccgttgacgaacggatggtgacggcgcaattgcgacgccggctcgcgcggatgccgacgcgcccgctccccagccgcagcgctgccgcaagcggaaacgtaaggccgaaataataggcgccgtgctcgacgtcgagccccgcgcggcgcaccacgtcctcgagactgccgagcgtatatcggcgcttgtgctcgagaaaatcgtcatggccgctccagaggaactggaacgcgggaaccgtgatcaggaaccggcttccggaaggcgcgcccgccacgtaacgtgcgagtaaaccgacgtcgtcgtcgacatgctcgagcacgtccatcagcaacacgagatcggcatcgaatcgttcgacggagcgccgaaagtggatgggcttgccggccgcctccgcgtcggtatcgtcggcgtagctcgtatcgacacaccatgcctccgacgcctgcgtacgctcgagcaagtgcttcgagaagaagccggagcctgcaccgacatcgagtatccggttcgcgcccgatgcacccaggaaccggcggatcgcactcgccttcgacgcgtagtaccagtgatcgcccacgcccgcacccagtacgtcgacttccttgagatccatgacgcttccccgtgatggctacttgtgctttggtcgatacagccactgtcgccgatcttacctcgccgctgccaccgatcctacccgtcgacgacgcacatccgctatcggtatcccgcattccgccctaatcgaaaaggacgatggccggttcgccgcaaatcgctaccgtgcgcttacccggcgcgagaccgatgcgcgcgggcgatccgtccgactgcatgccgatcgatccggcccgccccggctttgccgcgtcgcgtgcgagacacgaggcggcgtcggtcaccaccgcggtcgcgaccgcttgcaaccttctccgacaaaggacattgaatgcatcagaaaaacgaaatttcacgtcgacattttctccggctgggtgccggcacgataggtgcggcgctcgggagcgcgtcatttttgtcggcatgcggaggcgactcgatttcggtcgcgccggtcgcgacgccgcggctgggttccgcatcgaattttcgcgacacggccgggccggacggaaccggctatgtaacgacgagcggcgcgaagatgaagaaaggcgtgatctatcggtcatccgcgctcgcgttgtccgccgccgacatcgccaccgtcggcacgctcgacatcaggcaggtctgcgacctgcgcacgcccgccgagatcaagacgcaaccggatgcgccgctggccggtgccacatggcaaaacctcaacgtgctcggagccgccagcatcaccccgatcccgacgaccggcgccaccgcaacagcgttcatgtcgagcatgtatcgtgcgttcgtcacgtcggactccgcgcatgccagctatcgtgcactcttcaccggcttcgctgcctccggcgaaaacctggtgttccactgcacggccggcaaggaccgcaccggctgggccaccgccattctgcacacgatcctcggcatctccgggcagacgatactcgccgactacctgttgaccaacgcctacagcgcgtcggaaatctctgcgtcgatcgcccaggcacaaaaagccggcgggcaaaatgcggcagacatgatgaccgcgctgcagggcgcgcacgccgactatctgcaggcggcattcgatcaggtcactgcgtcgtacggctcgatggcgtcgtatatcgcgaacggcctgcaactcgaccaggcaacgctgaacgccatccggcagcacatgctggtctgatccacccgcgggccgcttcgacggggccggatcgtatctgcgcttcgatcgcagcggccgctgcggctcgtatccggcggaacccttaccggccaaggcctgggcgggttttcccggtcgcaacgaaagccgcctggggcgggccgtgcgaaccaaacgaccgtttgatccgcgcgcccgaccaccccgaatccgttgtcccgcagcacgctggcccactctgcccgggcgcccgttgtttggtaacgccgctctagcgtgctatgccacactgcacggcatcgacgctcgcgccgtgtagtgccgcgcaccgccgtcgatcacgacaagacatggagacagacgatgcggaatgcggtccggcgcggccatcgctcgcctttggcaattttcgactggatttccggcccgcaacgcgcggcccggcctatctcgcccggaacatcccgcgtgttcggctgcggcatgctggcgctcgcgctgctttgtgccggttgcgcggaatcgtcggcgcagcgtgacggcaacacgtcaatcgcgtcgacgaagatcgaacgcaccaaggccgagcggctcgcccgcgagcagcagctcgcacgtaccgtgccgtcgctcgcatcgatcagcctgacgcaaccgcgccagttcacgctgcgcgactcgggccagaacggcgcgatgacgttcctgcgcgacgtcgatttccgtatcgtcaacaacctcggcttcttcatccatcagttgtccgccacgctggtgccgacgcaggccggcgcgccgatcgtgttcgacgatccgacgagtttcgagatcgacgtgcatgaaggcacggtcacgctcgacaacgcgaagctgaccgcgctcttcaacacctacatcttcggctaccgcaacgcgccgctgcgcaagctcgccgtgtcggccggcgacggcgtgattcacctccaaggcgagatgcagcgcgacggctgggtgccgttctcgctgaccggcacgctcgcgatccgcgacggcagccagctcgtgttccatccgacggggtgcgcgtttcgggcatcaacgcgcagccggtgatgcgcgcggccaacgtgaaaatggccgacttgctgaaagtccagacaccgatcgcgcaactcgccggcgacgatctcgtgatgtcggtcgacaagctgatgccgccgccgcgcctgaaactcacgatcaccgcggtgcgcgtgacaccggccggcctcgacctgaagctcgacgacggcacgcacgccggcttcgcgatgcctgcgaatgcgccccagcaagccatgtacattcgaggcggcgacgtgaagttcatgcgctcgatgccgatgaacgcggacatcctgatcggcccggtcgacccggcgaagcgcgaccagactttcgtattcgacctgtatcactatcgcgaccaggtgtcggccggttacttcaatttcgacgaaagcggtgcgatggcgatccggatgccttcgtacacgggcccggccagcggcgcgctgctcggcaacgcggccgcgcgcctgaacgacaggttcctcgccgcgcagcagactgcgctgcgtgacatacgccagcactgggaagcctacgcactcgcggcgaacgccacgcaccccggcatgcagaaggtcgccatgcggcgcacgtcgaccacgccgttcaacgagcggcacgtgtcgaaccgcaacccgacgatccatctgcgcaacgtcgatttcaacctgtccggggatatcggctttcacgtcgaggatctcgacgtggaactcgtatcgaagcggcccggcgaacccgtcgatctcgacgacccgaaccagtacgacatccggattctcggcggcacggtcgtcgagtcgtggaaggcgatgtccgcgctcttcaacgactatctgctcgactactcgccgcgctcgctcaacgacctgcatctgagcgcggacggcacgaacctgcgtgtccagggcggcatcaagctgtggaaccatgtgcccggcgtctggctgccgaccgacatgaagggctcgctgtccgtgctcgacgaccggcatctcgcgttcaagccatcccaggtgtcggtgctcgggattccgcaggcgaagctgctgcgttcgctcggcatcgagctcgcttcgctgacgccgttgcagcgtcgcggcgcggaactgcgcggcgacacgctcgtgctcgaccagtacaccgtgttcccgcccccgtgctgaacggcaagcttggccaggcaacggtcgagcgcgacgggctgcgcctcacgttcaggcgtctggcgggctcgcctgcgccgcaacggccgcagatcgatgcgccgagctacatgtggatggaaggcggcgacatgaagatgttcaacgtgctcgaactgaacgtgcgcgcgctgatcaggaattcggccgaggccggcccgatgcgtttcgacctgtacggctaccgcagccaggtcgcgcaaggttccgtgcggatgctgccggacggcacgctggtcgtcgacatgggccaaagaatccgctcgcatcgcgttgatgtgcatgcgcgacgcgcagcaaaagcccggtggcgcgtcgccaaccgggcttttcatttcatgcttcgcgtttcgcactcagtcgtgcttcagtccgtcgatcacgtcgagcagcgcctgtcgcaatgcaattacgtcgacggttgggcctggcctgcccggtgtgcgcgcatcggcgccctgggcctccggctcgacgggtgccggcgcggcccgctcgccgcccggtgaatcgagccggttgcgcgcgccgttgatcgtgaatccctgctcgtacaacaactcgcgaatccgccggatcagcagcacttcatggtgctggtaataccgacgattgccacgccgcttcaccggccgcagttgagtaaattcctgttcccaataacgcagcacatgcggcttgaccccgcacagctcgctgacttcaccgatcgtgaagtagcgcttcgcgggaatcggaggcaagacgactttctcaaccgtagtggtcatcgtcggttaaccgtcggtaaagggtgcgcggcggccgcgcggggacgtcagcgcgcgggggcttactccgcgccgttttcgaccagcgccttcagcttctggctcgcgtggaaggttaccacccggcgggcggcgatcggaatcgcctcgcccgtcttcggattgcggcccggacgctgcggcttgtcgcgcagctggaaattaccgaaccccgacagcttgacgctttcgccgttttcgagcgcgtcgcgaatcacctcgaaaaacgcctcgaccatgtccttcgcttcacgcttgttcagcccgacgctgtcgaacagcaactccgccagttccgctttcgtcagcgtgggcgtctcggtggacgccggcgccgaagcatcgcggttcatggcgctgcgttgcgccgtcaggagggcttcgaattcactcgaggtcatgtcgttcatatctgccatacagcgcgttaaatcaaaacttacgatcggaaaaggccgcccgcgagcgggcggacctcctccttagccgcgcaggcgcgcaccggcgcgagccatccgctcgaccagcgcctggatcgcctgatcgacgacctcgtcctgtagcgtgccagccgcgtcctgcagcgtcacgcggaaggcaaggctcttctcgtgcgcggcaaggccaccggaagtatttgattttgcacgaaattcgtcgaagagtacaaccttctgaacgaatcggcaggcctcttcggcaagcgccttcttcatttcgtcgaaaagtgcctgaacctcgaccgcctgatcgacgacaacggcgatatcgcgacgaaccggcgggaatttcgacacctcggtcggcgtgggcaacgcacgcgcaatcagcgcgtccgcgtcgatttcgaacatcaccggagcgtgcggcaactcgtacttctgcatcaggcgcgggtgcaactcgccgatccagccaaccgcacggccgtcgacttcgattcgcgcgctgcgccccggatggagggccggatgctccgccttcacgaagcgtgcggctgccggcgcgagcagcgcctcgagatcgcccttcacgtcgaagaaatcgaccgcacgggtcgccacgccccactgctcgtcgagcaccgggccataggcaagcgcaccgacgcgcttcggctgcacgtagccctcgaccgtcagctcaccggccttcgccgacgcatcggcgaggaacacacgaccagcctcgaacacgcgcacgcgatctgcacggcggttcaggttgtggcgcagcacggaaatcaggctgccgaacagcgtcgtgcgcatcaccgagagctggctcgcgatcgggttcagcaggcggatcggctggtcgttgcccgcgaaatcctgctcccactccgcatcgacgaagctgaagttgacggtttccgcgtagtcgcgcgcggcgagcgcgtgacggacatcgtggatcgaacgccgcgtctcgttggtcgcgcgcatttcgctcgtcgcgaccggcggacgcgccgggatcttctcgaagccgtagatccgcgcgacctcctcgatcaggtcttcctcgatctcgatgtcgaagcgatgcgacggcggcgtgacgaggaacgcgtcgtcttcacgctcgaacggcaggccgaggcgcgtgaagatgctggcgatctcgtcggcgccgatctgcacgccgatgatgcggttcgcgcgcgacacgcgcatcttcaccggcgcgcgctgtggcaggttcacggactgatcgtcgaccgggccggccttgccgccgcagatctcgagaatcagttgcgtgatgcgctcgacgtgctcgacggtcgtcgcgtaatcgacgccgcgctcgaagcgatgggccgcatcggtcgagaagttgtacttgcgcgcgcggccgcggatgctgtccggccaccagaacgcggcctccaggtagatgttggtcgtatcgagcgtgacggccgtgctgtcgccgcccatgatgccggccaggctttcgacctggcggtcatccgaaatgacgccgaccgtttcgtcgagttcgaccgtgttgccgttgagcagcttcagcgattcgccgcgcttgccccagcgcacctcgatgccaccgtggatcttgtcgagatcgaacacgtgcgacgggcggccgagctcgaacatcacgtagttcgagatgtcgacgagcgccgacacgctgcgctggccggagcgctcgaggcgctcgatcatccactgcggggtcttcgcacgcgcgttcacgccgcggatcacgcgacccgagaagcgaccgcacagatcgggggcggcaatgcgcaccggcagcgtttcgtcgagttcgacgcgcaccgggcggatatcgaccggcgtcagcggcgcaccggtgatcgcggccgtctcgcgcgcaatgccgaacacggacaggcaatcggccttgttcggcgtcagcttgatttcgaagatcgtgtcgtcgagattgagcgtctcgcggatgtcctggccgaccggcgtatcttccggcagcaccagcaggccgctgtgatcctcggacagcttcagttcacgtgccgagcacagcatcccctggctctccacgccgcgcagcttcgacagcttgatcgcgaacggcttgccccctcttccgccggcggcagttccgcgccgaccagtgcgaccggcaccttgatgccgggcgcgacgttcggtgcgccgcagacgatattcagcgtcgcgccggtgccggcatcgacctggcagacattgagcttgtccgcatccggatgcttgacgacttcgagcacgcggccgacgacgatcttcgacgtcggcggcgcagcctgctcagcgattcgacttcgagccccgccatcgtcagcgcgtgcgacagttcgtcggtcgtcagctgcgggtcgacaaaggttctcaaccaggattcagggaattgcatggatgtctacgttcgaaacaggttagatcgacgcccgggccccgtcggatcgtccgtcggggcgtgcacgggcacaggtcggcgcggcgcgcggcgttacgcgaactggcgcaggaaacgcaggtcgttctcgaagaacagccggagatcctggacgccgtagcgcagcatcgtcaggcgctcgaggccgctgccgaacgcgaagccgatgtagcgctcgggatcgaggcccatgttgcgaatcacggtcggatgcacctgccccgaaccggaaatctcgagccacttgccggcgttcttgccttgctcgaacatcatgtcgatctcggccgacggttccgtgaacgggaaatacgacggacggaagcgcacgaggatgtcgtcgcgctcgaagaatttttcaggaagtcggtatagacgcccttgagatcggcgaagctgatgttttcgtcgatccacagcccctcgacctgattgaacatcggcgagtgggtcgcatcgctgtcgacgcgatacgtgcggcccggcgcgatcaccttgatcggcggacggttcatgcgcgcgtaacgcacctgcatcgggctcgtgtgcgtgcgcagcagcaactggcggccgtcggcatccttgccttcgacgtagaaggtgtcctgcatcgaacgcgccggatggttctccgggctgttcagcgatgtgaagttgtaccagtcggtctcgatttcggggccgtctgccacatcgaagccgatcgagccgaaaatctgttcgacacgctcccacgtgcgcatcacggggtgcaggctgcctgcaccggcgccgcggcccggcaacgtcacgtcgatcgactcggcggcgaggcgctggttcagcagcgcgtcggccagtgcctgacggcgtgcggtcagcgcggcttcaacctgctgcttcgcggcgttgatgcgtgcgccttcggtcttgcgtgcttcgggatcgagcttgccgaggcccttcagcaactcggtcagcgcacccgacttgccgagaaatcgtgctttctcgttttcgagcgtggtgatgtcggcagcctgttcgaaggactgctgcgcgtcggcgacaatctggtccagatccatagatcccatcatttccaacgtcattcggtcttggcgagcgaaatcgcacaccaaacaaaaaggggctcggaagagccccgttttcgctgcaacggccgaaactaccggagcatcgctgcaactaaccacgcagtgctaatttcgcaattaggctgcaacggcggctttcacctgcttgacgatcgcagcaaaagcagccttgtcgaacaccgccatgtcagccagcaccttacggtcgagttcgatcgacgccttcttcaggccgttgatgaacacgctgtaggtcatgtcgtgctgacgaaccgccgcattgatacgcgtaatccacagtgcgcggaacacacgcttcttgttgcgacgatcgcgatatgcgtactgaccagcgcgcatcaccgcctgcttggcgatgcggtagacgttattgcggcgaccgcgataacccttggccaggttgatgatcttcttgtggcgggcccgtgcggttaccccacgtttgactcgaggcatgtttctctccttagagtatcgattgaggggttacgcgaacggcagcatcgcgcggacggagttcagatcggaatcatgaactgccgttgcgccgcgcaggtggcgcttgttcttcgtggttttcttggtcaggatgtgacgcttgaaggcttgaccgcgcttgacggtaccgcccggacgcaccacgaagcgctttgcagcgctcttcttggtcttcatcttaggcatgacgaacaactccagtttattagatggcgatgggtgtgcggttggcttgcgcccttgacccgcccttcgaaacccagtccacttgtgtacggcgaaccgcttgcgcagccgccgtcattgctggcgcgccgccctgatcgggcaacgcgccgaaccactgcgaacctgcgcgcgaagcgcgcgggccgttacttctttttcttcggcgagagcaccatgatcatctggcgcccttccatcttcggcatctgctcgacctggccgacttcctcgagatccgtgcgcagacgctcaagcatccgcataccgatttcctggtgagccatttcgcgaccgcggaaacgcaacgtgatcttcgtcttgtcgccttcttcgaggaagcgcacgagattgcggagcttgacgttgtaatccccgtcatcggtacccgggcggaacttgacttccttgacctggatgaccttctgcttcagcttcgcttcgtgctgcttcttcgattcctggtacttgaacttgccgtaatccatcagacggcaaaccggggaaccgcttgcggcgcgatttccaccaggtcaacatccagttcttccgatttacggaaagcatcagcgagttttacgataccgagcggttcgttctcgatcccgaccagacgcacttccggcgcagtgatttcaccgttgatgcgatgcgacgacttatcagtagcgatgttacgtttcctctaaaaattaaaaacgagccgcgctgccagggcggttacttgaacgagcgcaggtcttcctgcagacgctcaacgaaggcttcgaccggcatcacgccaagatcgacgccgccacgggcacgcacggctaccgtttgcgcatcacgctccttatcacccacgacgaggagataaggcaccttttccagcgtgtgctcgcgtattttatagctaatcttctcattgcgcaaatcggccgtcactctaaccccttgtttttgcaacgattgggccagagattgcgcatattcggcctgactttcggcaatattgagcacaactgcctggaacggcgcgagccaggcaggcattgcaccagcgtggtgctcgatcaaaatgccgaggaaacgctccatcgaaccgacgatcgcacggtgcaacatcaccggccggcgacggctgctgtcgtcggcaacatactcggcgccgaggcgttccggcagcaccatgtcgagctgcagcgtaccgcactgccatgaacggccgagcgcatccttgatgtggtactcgatcttcggaccgtagaacgcgccttcacccggcaattcttcccacgtcagaccgcaggcggtcagtgcgtcgcgcaggccctgctcagcacgatcccacgtctcgtccgtgcccgcacgctgatccgggcgcagcgacagcttgatgtcgatgtgatcgaaaccgaagtccttgtacacgctcatcgccagcgtattgaacgcgatcgactccgagatgaactggtcttccgtacagaagatgtgcgcatcgtcctgcacgaagccgcgcacgcgcatcaggccgtgcagcgcgcccgacgcctcgttgcggtggcacgaaccgaattccgcgtagcgcagcggcaggtcgcgatacgagcgcaaaccgtgcttgaacacctggacgtgacccgggcagttcatcggcttgatcgcgtagtcgcgcttctccgactccgtcgtgaacatgttctcgcggtagttctgccaatggcccgacgcctcccacagcgagcggtccatgatcatcggcgtcttgatctcgaggtagccggcttcgttcacccggcggcgcatgtattgctcgacctgctgccacagcgcccagcccttcggatgccagaacaccatgcccggcgactcttcctgcatgtggaacaggtcgagctgcttgccgagcttgcggtggtcgcgcttttccgcttcctcgagcatgtgcaggtactggtcctggtcttccttcttcgtccaggccgtgccgtagatgcgctgcagctgctcgttcttcgaatcgccgcgccagtacgcgcccgcgaccttcatcagcttgaagaccttcagcttgcccgtcgacggtacgtgcgggccgcggcacagatcggtaaagccgccgtgcgaatacagcttgatttcgtcgctctgcggaatcgattcgatgatctcggccttgtacttctcgccgatgctgcggaagtagcccgccgcttcgtcgcgcgacacgacacggcgcgtcacgggctcgtccttcttcgcgagctcctgcatgcgcttttcgatcttctccagatcttcaggcgtaaacggacggttgtacgagaagtcgtaatagaagccgttgtcgatcaccgggccgatcgtcacctgcgcgtccggatacagttccttcaccgcgtatgcgagcaagtgcgccgtcgagtggcgaatgatgtcgaggccgtcggcatccttgtcggtcacgatcgcgagcgacgcgtcgcggtcgatcacggccgacgtatcgacgagctcaccatcgagcttgccaccaagcgcagccttcgcaaggccgggaccgatcgaggctgcaacctcggcaactgtcaccggatgctcgtattgtcgaactgagccgtcaggcaagcgtatcgaaaccatagcaatctccgtgatgccgacagtgggcggcagaccaggtacgcgacatgaaaatcgcgcgggaaaatttcgcgacaaaaaaatgcggccccgctttcgaggggccgcattcgatacttcactcagactgaaagggcgaaagggttcctcgactagcgtcgctccgaaaaggtttcggtcaacgttcgcggtgtcataaccgtattcgccttgttcgcgttgagttatttactgcatcgaacacccggagaccgggcattctcaattcgttggtaggctcgattggactcgaaccaacgaccccaccatgtcaaggtggtgctctaaccagctgagctacgagcctagagaagctaagattatatggagccgttaccggcttggcaagtgtttttatgcggtcgcagcaaaataacggggctccaaccccatatcatgccttccgccccgcccgcacgacgccttgcacctcgccgagcagcgcgcgcgcgctgcacctgcgccgagttcgacacctcgaccgtgaactgcatgaatgccgcattgcggcggctctgcgtcttcacgcccaccacgttcatcttctcgcgcgcgaacacttcggagatatcgcgcagcaacccttgccggtcgcttgcctcgatcatcaggtcgaccggatagacggacgcaccgcgcccgccgagcacgtctgccgaccaggtcgtctgcaacacgcgctccggcgcgcgctcgaccatccggcggaacgtcgggcaatcggtgcggtggatcgacatccccttgccgcgcgtgacgaaaccgctgatcggatcaggcggcgccggacggcagcagcgcgcgagctgggtcagcagcgcgtcgacgcccacgaccagcacgccggtcgacgcgccgtgcgccacgctcgcgccgctgctgcgcttctcgaaatcggcgggcgcttcgggcgccggctccggcggcggcgcatcggacagcgcgtgctcgacattgcgcaggctgaactcttccttgccgacgaccgagaacagttcctcgggcgacttgaagccgagcttcgcggcgagattgtccaggttgaccgatgtcttgccctcgcgctgcagcgtcttttcgacgagcgcgcggccgtgcgagatgttttcttcctgctcgatcgagttgaaccatgcacgcaccttctgacgcgcacgcgggctcttcatgtaaccgagctgcaggttcagccagtcgcgcgacggcccgccctccttcaccgcgacgatctcgaccgtctggccgtttgcgagcggcgtgttgagcggcaccatcgcgccgtcgacgcgcgccgcggcaccgatggccaagctcgctgtgcaggtggtacgcgaaatcgaccggcgtcgcgccctgcggcaacgcgatcacacgcgcctgcggcgtcagcacgtagatgtggtcgtcgtcgagcgacgtctcgcgcaattgggcccacgccttgtcgcccgacttttccgcgccgtcctcgacgtcatccttccacgcgagcaactgccgcagccatgcgatcttctcgtcgtatttgtcgctcgccgagaactggccgccgtagccgcgcgcgccggcctccttgtagcgccagtgcgcggcgacgccgtactcggcgaaacggtgcatctcctgcgtgcggatctgcacctcgaacgcgcggccgtcatcgccgatcacgaccgtatgcagcgacttgtagccgttcggcttcggccgcgagatgtaatcgtcgaactccttcggcaccggctgcctaggtgatgcacgatgccgagcaccgcgtagcaatccttgatgtccggcacgatcacgcgaaacgcgcgcacgtcgtacagctcggagaaatcgagctccttgccgcgcatcttgcgccagatgctgtagatatgcttcggccggccgctcacatcggcctggatgtgcgcgtccgccagctcctgctgcaaccggtcgatcgcctgcgtgacgtacgcttcgcgctcgatgcgcttctcgtcgagcagcttcgcgatccgcttgtaggtgacaggatcctcgaagcggaacgcgagatcctcgagctcccacttcagttgccagataccgagacggttcgcgagcggcgcatagatctcgagcgtctcgcgcgcgacgtcgggcggcgggtcgatcttcgcggccgcgtagtagcgcagcgactgcaggcgcgacgcgagccggatcaacaccacgcggatgtcttgcgcgaacgcgagcagcatcttgcgcagcgcctcgatctgcgtacgccgctcttccgccgtgtcgcgccccgcatcgggcaccgcgttctgcgcggcacgcaggctgacggtaccgagccgcaacagcttgcgcacgtcggacacgagccgcgccacttcgtcgccgaaacgctcggtgagttcgcgctcggggtcgctcaggtgcggcgtcagcacgaacagtgcggccgcctgcatcgcgggcggatcgacgttcagcgtgcgcatgatcgacgccgtgcccgccgagtgatcggcgagcagttcgcccgacgacaggcgcgcgtcgccggcccgttcgcgcacgaacgcgagcacgtcgtcgaacgacggtgccgcgacggggaagcggaaacggactcggtcattgcttggcctggcggaatgcgatcatcgtcgggttacgtccggttcagctccgctgtgcggcgaccaccacgatctcgacgagcaacgccggatccgcgagcttcgcctcgacggtggcgcgcggcggcgtgttgccctgcgcgacccatgcgtcccactccgcattcatgccgtcgaaattcgccagatcggaaatgtagatctgcaccgacagcagatgcgccttgtcgctgttcgcttcggcgagcaggcggtcgatgtggccgagcacttcgcgcgtctggcccttgatgtcctgcgtggtgtcttcggcgatctggccggccagatacacggtaccgttgtggatcgcggtttcggagagtcgggccccgacgtggtgacgaatgactgccatggaatgttccggtcgtgagtggatggagattcgggtgacggcacggcccgcgtgccgtcgaaccgcatattatgacgcgtttatgcgccgccttcgacgaaaaaccgccgcgcgagcgcaatctggcctgcgtcgacgaacgccggcgcatggcccgccctggaatctcggcgtgcgtgacatgtcggccacgacgcaccatctcggccaccgtctcgcgcgacagcaggtcggacgtctcgccccgcacgacgagcagcgatgcatccgtcgtctcgatggcatgccacagcgcggcctcgccgagtgcggccaactcgggcgtggttgccttgaacggctcggcgatgcgcggatcgtagcggaccgtccagccaccttcgggcagttcgcgcaacagcggcccgttgatctcgcgccactcgtcggcgctcagcgcaccgaacggcagcgacagcgacgtcagatagtcgatgccctcctgctcggtcgcaaagcgcggctgcacgccgagatattcgccgatgcgcgtcagcgaatcgggttcgatgcgcgggccgacgtcgttgacgatcatccggcgtagcggcgatccgggcagccccgcgaacgccatgccgatcaggccgcccatcgacgtgccgaaccagtcgaccgattcgacgtcgagtcgcgcgatcagcgtcaccatgtcggccacgtattgcggaatcgcgtagagccgcggatcggccagccagtccgattggccgcgcccgacgatgtcggggcagacgacgcgatacgtatcggacagcgccgtggcaagccggtcgaaatcgcgcccggaacgggtcaggccgtgcacgcaaaccagcacgcgcgggttcgcgggatcgccccactcggtataggcgacgtggtgaaggccggccgcgctcgcacactgcacgcgccgctgacggggaatcgggagttcactggggaagtgggcatcggaggcgtcctgccgaacggtgcggcgcgatggcatgtgggcccggcccgccagggcagccggggatgcgatcgattgtaaacccgttccggatcacgagtcgcctgaccacccttgcgggcttgcggctcgtgcgagcgccaatgaaatgtcacgcggccgtgcggaatcgggcgcggtgttccgtgttcagcaggctgccgatccagcctcccctgcggccgcggcgacggcgccgcaaacgcaccatcgcgcaccggcccgtcatgaccgggaaagcgcggctatttctgcatgaccgcgccgatgctcgcaccgaccacgcacagcgtgccggcgacctgcagcgtgctcatcggctgcgccagcacgacataaccgatccccgcagcgatcgcgggctcggcgctcatcaggatgccgaatgccgatgcgctcatccgtcgcaacgcaatcagttcgagcacgtaaggaaacagcgggacgagcaccgccagatacgcggcatcgatcagttggccggccggcaagtggccgccgctttgcgccagcccgaacggcgtcgtgacgagcgcggccacgaacagcgacgcggacagcccttgcagcccgtcgaacagcgtgccgacacgcttcatcaacacgatataggcggcccagccaagcgcagagccgaccgggaagaccagcgcggccggcgccgtcacccacatgccgtcctgccgcgccagcagcagcacgccagccagcgcaagtgccggccatgccagcatcgccggcttgcgcacgccgatcgtggcgaccgccagcggcccgagaagttgatcgccaccgcgagcccgagcggcacgcgacgcacggcttcgaagaaacacagcgtcatcgcggccatcgccgtgccgagcgcgatggccgcgatccagcgctgccgggaataggtgtggagcggcggccggacgacaacggccagcgcgagcgcggcgaaacagagccgcagccaggtcgtgctgacggtgccgtactcgatcgtcgccggcctcgacagcgccgcgccgagctgcacgctgcacatcgacgcgacggccagcagcggcgccaccgcattcgtgaaaggtgacgccacgcgctgcgcgacatccggtcgtaccgtactcgattcctcgctcatgcaaccgctccggttcagtgacacgccgatgctaaccgcggccgcatgcttgatataagctgataattcttatgcccgcatcaggaatattgatgacccgcgatctcgacagcaccctgctgcgcacgttcgtcaccgtggtcgaaaccggcagcgtcagcacggcggcaacggcgctgcatcgcacgcaggccgccgtcagcatggcgctgcgacggctcgaggatgaagtcggccagcgcctgctcgaacgctcgccgcgcggcgtcacgccgacggccgcgggcaatgtgctgctgccctatgcacatcaactgctcggcgtcgggctcgccgcacgcgccgcgctcgccgcaggcgacatctcgggcaccgtacggctcggcgtccttgaggacatcgccgtcggccgtctgccgcacgcgttgcgacagttcgcagcgtcatttccgaacgtcgcgctcgagatcgtcgtcgatacgagccccgtcctgtcgcagcgactctcgagccacgcactggatttcgtgatcggcgaccccgcgctgatccgggcagagccgctcgcgacatggcagcatccgctgcactgggccgccgcagccaccaccaaccggctccctcgcaacgaaccggtgccgatcgttgcgttcggcggcacctgcccgtggcaggaaaagttgttcgcgatgttgcgcgacgccggccgtgcgtggcgcgtcatctgcaccagcacgagcctgtccgcgatccagtcggcggtcgaggcaggcctcggcgtcgcggtactgctcgactggaacgtgcgtcgcgacacgatgcgcgcactcgatccgctggcagccgggttgcccgcgccacccgccgcggatttcgggctgttcagccgcgcggacctcggcgatcacacgtcggcggcagtcacgctgcaacgcttcctgtttcatgcgctgcagctggattcacccgacgacggcacgcccaccggcgaacaacgcttggaatcgttgcagaccgccgtctgacgcggccgggcgcgcatgccacaaacataaacgcccgcatgcctgacggcatgcggggcgaatcggcatgaagaaaactcaggcgaccgcgctgacgtcgagcggcgcgcccgtctttgcctggatctcgtcggcgctcacgccatcggcaagctcgaggaccttcaggccggacggcgtcacttcgatcacgccgagatcggtgatgatcaggtcgaccacaccgacacccgtcaacggcaggttgcattcctcgaggatcttgtgctgatcgcccttcgcgacatgctccatcagcacgacgacacgcttcacgccggcgacgagatccatcgcgccgcccatccccttgatcatcttgccggggatcatccagttcgcgaggtcaccctgcttgctgacctgcatcgcgccgaggatcgcgaggttgatgtggccgccgcggatcatcgcgaacgaatcggccgacgagaagatcgacgagcccggcagcgtcgtgacggtttgcttgccggcgttgatgagatcggcgtcgacttcgtcttcggtcggcgacgggccgatgccgagcaggccgttttccgactgcagccacacctcgacaccatccggcacgtggttcgcgacgagcgtcggcaggccgatgccgaggttcacgtagaagccgtcctgcagttccttcgccgcgcgcgcgccatctggtcacgattccaggccatgtcagtctcctttcgcgcgtacgacgcgttgttcgatgcgtttttcgggcgtcgcgttcagcacgatgcgctgcacgaaaatccccggcgtgtggatgtgatccggatcgaactcgccgttctcgacgatttcctcgacctccgcgacggtgatcttgccggccatcgcgcacatcgggttgaagttgcgcgcggtgcggcgatagatcaggttgcccgacttgtcggccttccaggccttcacgagcgcgacatcggccgtcagcgacggctcgagcacgtagtggcgatcgccgaactggcgcgtttccttgccttccgcgatcacggtgccgtagcccgtgttcgtgaagaacgccgggatgcccgcgccgcccgcgcgcagcttttcggcgagcgtgccttgcggcgtgaattcgagttcgagttcgccggccaggtactggcgctcgaactccttgttctcgccgacgtacgacgagatcatcttcttgatctggcgcgtttccagcaacaggccgaggccgaaaccgtcgacgcccgcgttgttgctgatgcaggtgatgcccttgacggccgaatcgcgcaacgccgcgatcagcgcctccggaatcccgcacaggccgaagccgcccaccgcgaaggtctgtccgtcacggacgatcccttccagcgcggcagccgcgcttggatagactttgttcatctgttgtcccttcctctatggaaaccagcgaaaccggttcacgcgccacgtggcccgcaagcccgccgcatcattctatgcatgcacggcgatgcctgcgtcgaggcgcgctgtttttataccgcggcaaaccgccacgagatgcctgaaagggtacgatgcggcgcggatgcggcacaatacgcaaaaatacataagcgtttgcctccgcttgcctgcgccatgcccgctctcgattaccagaccgccttccatctcgcgccgctcggcctcgtcctgtcgcgcgaccgcgtgatcgaggattgcaacgacgcgctcgcgtcgatcttccgctgcgtgcgggctgacctgatcgggaaatcgtacgaggtgctctacccgtcgacggacgaattccagcgaatcggcgaacgtatcgcgcgcatgatggccgcgaacggcatctactcggatgacagaatcatgaaacgcgcggacggcgagctgttctggtgccacgtcaccggccgcgcgctcgaccgcaccgcaccgctcgcggcaggcgtctggaccttcgaggatttgagcgcgacgcgccgggtcgccgtcgaactgaccccgcgcgagcgcgagatcgcggcccagctcgcgaccggcaagaccagcaagcagatcgggcgcgtgctcgacatcagctcgcgcacggtcgacatctaccgcgcgcggctgatgcgcaagtacggcacaaacaatacgccggagctgctgcagcgcctgctcgggcagtgaatggcggctcccgtatgacaatcggccgcgcatggcggccgattcgtgaaacaggcaggcatggcgtgccgccggcgcccgggcgccggcctcgccgtgccggcactcagccgaccttcgtcgcgagcgcgcgctcgatcgtgtcgcgcagcaactggggcagcggtaccgacttgccgagcgcgtagtcgacccacacgcagcgcgccttgccgcgcgcatagacgtgctgcggatcgtccgcgcgcgtaagctcgaaaccggtgtcgaagctgctccggccgggtttcgcggccgacatcttcgcgatcacgtcgcccggatagtgcagttgcttgaggaattccatcgacgccgtgacgatgacgggccctgccctcgccattgccgccggcaatgccgagctcctcgaaccacgagatccgcgcctgctccatgtagcggaaatagaccgtgttgttcacatggccgaacgcgtccatgtcgccccagcggatcggcatcgacatctcaaatacggggagtaatcgcttgttgcgctcattgcagtcttctgtgttgctgaatgtcatccgctcaggcgaggccgaagccgtcgtcggcggagataatcgagccattgatgaactgcgactcgtcggccgcgagcagcaacaacagcccgtcgagatcctgcggcttgccgacgcgccggcgcggcagcatcgactgcagcttctggccctgctcggtttcccacaggtaatgattgatttcggtatcgatataacccggacagatcgcgttgacgttgatcccgtggcgccccactcgagcgccatcgcgcgcgtcatctgcacgaccgcggccttgctcatcgcgtacagcccgatctgcgggaacacgcgcaggccggccaccgacgcgatattgatgatccggcacggcggcttgccgttgccgctgccgttcgcgcgcatgatcatccgcttcgcgacttcctgcgcgacgaaaacgcgccgcgcgtgttggtatcgaacacgaactcgaaatcggccggcgtcacgtcgacgagcttctgcatcgtcgagacgcccgaattgttcaccaggatgtcgatcgtgccggcctccgtttccgcatgcgcgaccgccgccttgatgctctggacgtcggtgacgtcgagcgacacgacatgcgcggcgccgcccgccgcctcgatctcggcacgcaactccttcaggcgctcgacgcgacgactcgcgagcacgacctttgcaccggcctgcgacagcacctgcgcaaaacgctgccccaggccgctcgacgcccccgtgaccagcgcaaccttgccttccagattgatcgaacgacccatttgcacatcccctttcgatgtcgtttcgccgctacgagcagcactgcccgagcggcattaccctagcacaaaaatagaacgatcgtgctaatctagccgcatgctgttgcggcaagcgtttcgtttcgcagacaatacgctcccgaataaaagcattctaacggttagaggaacgccaatgacccccgcaagcctcatcgagcaatatggcccgcgcgaatcgatggaatacgacgtcgtgatcgtcggcggcggccccgccgggctgtcggcggcgatccggctcaagcagctggccgccgagaaaggcaccgagatcggcgtgtgcgtgctcgagaaaggttccgagatcggcgcgcacatcctgtcgggtgcggtgatggacccgcgcgcgatcaccgaactgttccccgactggaaggaacgcggcgcgccgctcgacgtcgaggtgacggaagaccgcttcctgttcctgtccgagaaaagcgcgatcaccacgccgaactgggcgctgcccgccaacttccagaaccacggcaactacgtgatttcgctgggtaacgtgacccgctggctgggccagcaggccgaggctctgggcgtcgagatcttccgggtttccccgctgcggagattctctacaacgacgacggctcggtgaaaggcgtcgccaccggcaacatgggcgtgggcaaggacggcgagccgaccgagaacttccagctcggcatggaactgcacgcgaagtacacgctgttcgccgaaggctgccgcggccacctcggccgccagctgatcgcgaagttcaagctcgacgcgaacgccgatccgcaggcgtacgggatcggcatcaaggagctgtgggaaatcgatcccgccaagcacaagccgggcctcgtgatccacacggccggctggccgctaaagtcggacacctacggcggctcgttcctgtatcacatggacaacaaccaggtcgtggtcggattcgtggtgggcctcggctacacgaacccgtacctgtcgccgttcgaggaattccagcgctacaagacgcacccgtcgatccgcgcattcctcgaaggcggcaagcgcgtgtcgtacggcgcgcgcgcgataacggcgggcgggctgctgtcgctgccgaagacggtgttcccgggcggcgcgctgatcggcgacgacgcgggtttcctgaacgcgtcgcggatcaagggcagccacgcggcgatcaagaccggcatgctggccgctgacgccgcgttcgacgcggtgcaggcgggccgccagtcggacgagctcaacgcgtacccggatgcgttcaagcaatcgtggctgtacacggagctgtaccgcgcgcgcaacttcaagcagtggatggccaagggcctgtacctcggtacgctgatggtcgggctcgagcagaaggtgatgggcggcaacgtgccgtggacgctgcatcacaagcacgcggatcacgagatgctgaagccggcgtcgcagtgcgagccgatcgagtacccgaagccggacggcaagctgacgttcgaccggctgtcgtcggtgttcatctcgaacacgaaccatgaagagaaccagccggcgcacctgaccttgaaggatgcgaacgtgccggtgaacgtgaacctgcgcacgtatgcggggccggaaggacgtttctgcccggcagcggtgtacgagttcgtgaagaacgacgacggcagcgatcgcctcgtgatcaacgcgcagaactgcgtgcactgcaagacctgcgacatcaaggacccgacgcagaacatcgtgtgggtcacgccggaaggcggtggcgggccgaattacccgaacatgtaatccgccacgacgcgctgccgcgagcggcgcgtttttgccggtcgccacaaacgaaacggggcgctgcctgaagcagcgcccgttttgtattccctgcgcgttcgcgaggcgtgccgcgccccgcccgcttgtgtcaggtcgcgctaccggcgattttcggcgtcgacgtctcgacgtccccgcactgcgcgcgatggcgcagcgcgtgatcaatcagcaccagtgcgagcatcgactcggcgatcggcgtcgcgcggatgccgacgcacggatcgtggcggccgaacgtttccaccgtcgcctcgtcgcccgccttcgtgatcgaacggcgcggcgtacggatgctcgacgtcggcttgatcgcgatcgacacggtgatgtcctgccccgtcgaaatcccgccgagcacgccgcccgcatggttgccgacgaaaccgcccggcgtcagctcgtcgccgtgcatcgagccgcgctgcgcgatactgtcgaaacccgcaccgatctcgacgcccttcaccgcgttgatgctcatcatcgccttcgcgatgtccgcatcgagacggtcgaacaccggctcgccccagccgaccggcacgcccgacgcgacgacgtcgatgcgcgcgccgatcgaatcgccatccttgcgcagcgcatccatgtacgcctcgagctccggcacgaccgccgcattcggcgcgaagaacggattctcgtgcacgtgcgaccagtcgacgaacggcacgtcgatttcgccaaggccgctcatgtagccgcgcacctcgacgccgaagcgctcgcgcagccacttcttcgcgaccgcacccgcgccgacgatcggtgcggtcaggcgcgcggacgaacggccgccgccgcggtagtcgcggatgccgtatttctgccagtaggtatagtcggcgtggccgggacggaacgtctcgacgatgttgccgtagtccttgctgcgctggtcggtgttgcggatcagcagtgcgatcggcgtaccggtcgtcacgccttcgaacacacccgacaggatctcgacctggtcagcctcctgccgttgcgtcacgtgacgcgacgtgcccggcttgcggcgatcgagttcgacctggatgtcggcttcggtcagccccattcccggcgggcagccgtcgatcacgcagccgatcgcgggaccgtgcgattcgccgaaggtcgtgacagtgaaaagcgtgccgagggtattgccggacatgatggaaccgcccaaagagaaatgggcaaaccgatgcgctgcccgggccgcaggcagatcgatcgtttgccggtcgagaaaagaggtaagccgctattatgccagccgtcccgcgcccgcgggccgcaggccgcatgaaaggcagcccggacgcgcggaacgtgcgcgcgcggcccggcttgtgcggcgcaagcccgtccggcccggttgcagccgaacgcatccggacaggcgctcgcctacttccgcgcgccgcgcagttccgttaccgcggcctgcagcgactcgggcgtcgcgaccgacgccgggaccggctcgccgaccgccagcgtcagccggctcatcacgccgcgcttgatgggtcgcggcatccgcgcatcggaatgccgcgaaaaatagctgccccacagcccgcgcagcgccatcggaatgaccggagccggcgtacgtcccaggatctcggtgatgccgtggtggaacgtgttgatgtcgcccgtcttggtcagcttgccctcggggaagatgcacacgagttcgccgtccttcagcgcggcctcacatgcgtcgtacgcacgcgcgagcatcgcgggatcctcgtggcgcggcgcgatcgggatcgccttcgcatgccggaatacccagctcgcgaagcgcgtcttgaagatccggtgatccatcacgaaacggatcgggcgcgggctcgcggcggccagcacgagcgcatcgacgtagctgacgtggttgcatacgagcacggccgcgccttccgccggaatccgctccgcgtgcacgagacgaatccggtagaacgtgtggacgagcacccacgcgacgaagcggagcaggaactccggcacgagcagatagatataggccgcgacgatcacgttcaacagcgcggtgacgaggaacagcccgggatgtcgacgccggccttggtcagccccatcgccatcacagccgataggatcatgaacagcgcgttcaggatgttgttcgcggcgatgatccgcgcgcggtgcgtcggcgcgctgcggctctggatcagcgcgtacagcggcacgctgtagaagccgccgaacatcgcgagcaggaacaggtccgccaggatgcgccagtggcgcacgccggccaggaattcgccgaccgacagcagatggccgggcgacggcagcgcgcggctcgcgaaatacagctcgatcgcaaacacgctgatgccgatcgagccgagcggcacgaggccgatctcgacgcgccgctgcgacagccgttcgcacagcagcgaaccgaggccgataccgactgagaacgtcgcaagcaggaccgtgacgacgtcggggctcgccgacagcacgtccttcgcgaaattgaagaacgacgtgaggaacgtcgcgccgacgaaccacagccacgagatgccgagcaggctcaggaacacggtgcggttctggcgtgcgagcccgaggttgcgccaggtctcgctgacaggattccagttgatcacgagatcgggctgcggcgccggcgtggaaggcacgcgctgcgcgacgaggcgccccgcgatcgcgatgacgagcacgctcaccgcgagcacgcgctcgccggcaccttcgatgcccgcggccgcgccgccgatgatcgtgccgatcaggatcgcgatgaacgtgcccatctcgacgaggccgttgccgccgaccagctcatgctcgccgagatgctgcggcaggtacgaatacttgacgggcccgaacagcgtcgagtgcatccccatcatgaacgtgcacagatacagcagcggcgcgtgtgcatgacgaagccggccgcgccgaccagcatcagcacgatctcgaaggtcttcacgaaacgcgtgagggtcgccttgtcgtacttgtcggcgatctggccggacgtcgccgagaacagcacgaacggcaggatgaagatcgcggaaatcaggaaggccgccgtcttcgcatcgacaccggcgaaccgcgcggtgtgataggtgacgagcgacgtgaagccgatcttgaagacgttgtcgttcagcgcaccgaggaactgggtcgtgaagaacggcgcgaaacggcgctcgcgcagcaggtcgaactgcgacgcgtgggcgtgccgttcgtcgcgccgcctggaagtggcttgcgtttgatcgctcatgcggaatacgcgcgcgccgtctgggcaacgctgcgcgggccttgtgtggtcattgaaaaacggcggcgcaggacaagcctgcgccgccgcgtgccggtggcggcgcccgcgcatgacggcgacgggcgcggcgtgtttcacgacttgtgcgcttcggcttccgattccggccagtcgcggatgtacgccttcagcatccggttctcgaagctctgcgcctcgacgaccgtctttgcgacgtcgtagaacgaaatgacgcccatcagcaccttcttgtcgagcaccggcatatagcgcgcatggcgctcgagcatcatccggcgcacttcgttgacgtccgtttccggcgtgcacgtgagcggctcgtccatcaccttgcgcacctgcacgtcgccaatcgcgccgccgttcacgtgcaggcgcaggatgatctcgcggaacgtcagcatcccgacgagatcgccgtactccatcacgacgagcgaaccgatgtcgtgctcggccatcgtgtcgaccgcttcgcgcagcggcttgtcgggcgtcaccgtaaacagcgtgttgcccttaactttcagaatatcgctgacgcgcatcgtagtccccatgcttgaatgcaaaacctctttcgatcctatcggaaagcctgtcaaaggaaagcgcgggcccgcggcgggccgccgccccgcttgcggaagcaggccgccggcagcacaatggccccatgaacagcggcccgaggagacggccatggcgcatacgcatacggagcaattcgccagcttcgctgatttctacccgtattacctgaacgaacaccagaacctgacgtcgcggcggctgcacttcgtcggctcgctcggcgtgatcggctgcgtcgcgatggcggtcgcgaccggcgactggctgtggctgccggcggcgatcgtctgcggctacgggttcgcgtggatcggacacttcttcttcgagaagaaccgcccggccacgttccggcacccgatctacagcctgatgggcgactgggtgatgttcaaggacatctgcaccggcaagatcccgctgtaacggccaggcacccgctcacgcgggccgcggcggccgcgcgtgcgggtcggacatgccgcccggcgcctgcccggggcacccgccgcttgtgcgccggccggccggtgcgcggcgatcagcgacgcgagcgacacgtcgaagcgatcgctcgacagcaccgcgagcagcgccgcgccatcgacatggctgcggcgtcgctgcaactggtaggtcaactccgtgcggtcgatcaccagcacgtcgaacaactgcgcgagcgtcagctgctccgggttcgcgagcaggatgtagcgcggcgtggtctcgccgccgccgtccagccgcgcgatccattcccgctcctccatcgtcgtcagcaggcgctgcgcggtttccatgtcgcagcgcagcatggtcgcgagccgcatcgccgtgtagccgcgcttgccggccgtgcgcgcttcggccagccgcgcgagcatttccagtgcgtcgagcaggtcgctgcccggatagtggatgcggtggaactggccgacgcggatcgccggcagcgcagaggccaccatcgcgccgagcagcgcgatgaaccagctcaggtacacccataacaggaacacgggcaacgccgcgaacgcaccgtatacggccgtataggtcggaatgcgccgcacgtagtagccgaaaccgcgtttcgccagctcgaacgcaattgccgcgaacagcccgccgatcaccgcatcgcgccacgcgaccgtgcagttcggcaggtacacgtacagcaacgtgaacgcgagcaccgccagcggcagcgacacgagcgccagcagccactcgacgatcgacgtggacggccccgcgccggtaaacgcgagcgactgcgtgaacaggtacgacgagatcgacaggctcacaccgaacaacagtgggcccagcgtgatcagcgcccagtacgcgagcacgcgctgcgcgaacggtcgcggcttgcgtacccgccagatcaggttgaacgccgactcgatcgtcatcatcgtcatcaccgacgtgacgacgagcacgatcaggccggccgtcgtcagccccttggccttcgacgcgaactggttcaggtacttgaatatctggacgttgaactgcgcgggcatcaggtgatccgcgaggaatcctgcagcgagatctggaacgacgcgaacatcgggaacgcggtgaacagcgcgaacgcgaccgtcacgagcggcacgagggccagcatcgtcgtgaacgtcaggctgcccgccacttgcgggatgcgatcctcggcgctgcgccgggccgcgaactgcgccaggcgcttgagggtgtcgagatcgacgctcaacttcggcaaacggcttctccttcttgataccgcgcgcccgacggcgcgccgccgccgcgctgcgcgacggcttcagcccctataatagccgctcgattccagcaggggccgactgcaccgggcacgcgcgcggccgcacgcggttccgtcgcccatgaaagacatcctcgttctctattacagccgtcacggcgccacgcgcgatctcgcactcgcgatcgcgaacggcatcgacagcgtgccgggcatgcaggcccgcatccgcaccgtgccgcccgtgtcgaccgtctgcgaagccaccgcccccgacatccccgccgacggcccgccgtacgcggaactgcgcgatctcgaggaatgcgcgggcctcgcgctcggctcgccgacccgcttcggcaacatggccgcgtcgctcaagtatttcctcgacggcaccacgccgcaatggttgtcgggtgcgctgaccggcaagccggcaagcgtgttcacgtcgacgggcagcctgcacggcggccaggaatcgacgctgctgtcgatgatgctgccgctgcttcatcacggcatgatgatcgtcgggatcccgtacacggaatccgcactcagcacgacgcgtaccggcggcacgccgtacggcgcatctcacgtcgcgcagcacgaccgctcggccgccggcgggctgtcggcggacgaaaagacgctcgcggccgcgctcggcgtgcggctcgctcgcgcggccgccgccctctccagcgcccaggccgccgaggccgcatgaacgcccccgcccgtcccgccgtcactgcccggccacgctacgcgctgattgccgccgcatgcctcgtcgcgctgatcgcgctgtcgctcgcgtgggagctgcggctcgcgccgctgcgcccgggcggctccgcgctgatgctcaaggccataccgctcgcgctcgcgctgcccggcgtctggcggcgtaacatctatacgatgcagtgggcgagcatgctgatcctcgtctatttcgccgagggcgtcgtgcgcggcatgtccgatcgcgggctgtccgcgacgctcggctggtgcgaaaccgcgctcgccgtcggtttcttcgtgacggcgctggcatacgtcgcgccgttcaagcgcgcggcgaaaagtcgcgcgccgcgtcctgacccttacgcgacaaggtgatgatgtcctccgaagctttcgtttccgcgtgccgcgatgcgatcggcgccgatcatgtgctgaccgacccgcacgataccgaaccgttcctgaccgactggcgccgccgctacaagggtgccgcgtgcgcggtgctgaaacccgcgaacacggccgaggtcgccgccctcgtcaagctggccaacgcacacggcatcgcgctcgtgccgcaaggcggcaacaccggccttgccggcggcgccacgcccgacgcgagcggcagccaggccgtgctgagcgtcgcgcgcctgaaccgcgtgcgcgcgctcgatccgcacaacaacacgatcaccgtcgaatccggcgtgattctcgccgacgtgcaggcacgtgcccgcgaaggcggccggctgttcgcgctgagcctcgcggcggaaggcagctgcacgatcggcggcaacctgtcgaccaacgcgggcggcaccgcggtgctgcgctacgggaacgcgcgcgaaccagcctcgggctcgaggtggtaacgccgcaaggcgagatctgggacggcctgcgcggactgcgcaaggacaacacgggctacgacctgcgcgacctgttcatcggtgcggaaggcacgctcgggatcatcacggcggccgtgatgaagctgcatccgctgccggccgcgcaggtcacggcactcgccgcgctcgaatcgccgcacgcggcgctcgatttcctcgcgctcgcgcagcgcgcggccggaccgctcctgaccggcttcgagctgatgtcggatttctgcatgcagctggtcggcaagcactacccgcaactgcgctacccgttcgcgcagacgcacgcgcaaacggtgctgctcgaactgtccgacaacgaaagcgaagcgcatgcgcgcgcgctgttcgagaaactgatggaggaagcgttcgaggccgggctcgtggtcgacgcggtggtcgcggagaatctcgcgcaatcgcgcgcattctgggatctgcgcgagcacatcccgctcgcacaggccgacgaggggctcaacatcaagcacgacatcgcggtgccgatttcgtcgatcgcgcgcttcatcgacgaaaccgacgcggcgatccagcaggccgcgccgggcgcgcggatggtcacgttcggccacctcggcgacggcaacctccactacaacgtgcagatgcccgaaggcggcgatccgaaggcgttcctcgctgcgttccaggcgccgatcaaccggatcgtctacgacaacgtgcaccgtcaccacggcacgatcagcgcggagcacgggatcggccagttgaagatcgacgacgcgcagcgctacaagtccccggtcgaaacgacgctgatgcgcacgctgaagaccgcgctcgacccgcgcggcctgatgaatcccggcaaggtcctgcgctgaagccgcccactccggagccccgcccgtgaaaatccgcgtcctgtccgatctgcacctcgaaagcaaccagcccgacgcgatcgcgcatgccgacgcggatctcgtcgtgctggccggcgacatccacaatcatgcggaaggcctgcgctgggcggccgaaacgttcgatcccgcggtaccggtgatctacgtgccaggcaaccacgagtactacgacggggaattcggcgcgctggagacggcgatgcgcgatgcggcgcaggcactcgacaacgtgcattacctgaacaacgacgtctacgtcgatcccgggcagcggttccgcgtgctcggcacgacgctctgggccgatttttcgttgttcggtaccgacgaagccagcctcgcgggtgcaatcgacgccgggctgcgcgtgatgctcgatttcaagggcttgatccaggtgacctggccgcatgacgcggcgctgcatgcggcgccgggcacgccggaacgggatttctcgccggccgacgcgatcgcgctgcatcgacgcagccgcgcatggctggagacgcagctcgcgacgccgttcgcgggccggacgatcgtcgttacccaccatgcgccgcaccggcgctcgctggcgcagcgctatgcggacgatcttgcgtcggcgggattcgtcacggacatggcggaactcgtgcagccgccggtggatctgtggctccacggccacacgcatacgtcattcgactatgtggcggacggtggcacacgcgtggtatgcaatccgcgcggctacatccaccggcgcaccggcgaacgggaaaacaccgcgtttacgtgggacaaggtcgtcgagctcggctgaacgccggcccgcccggccgcattgcgcggccttttgcgcgaccttttcgacccggagcgtgaccgcggatcagcgccccgggcggcgcggctcgcgcacccgtaccggcaccggcttcatctgcgccttcgccttcatcgcgcgcagcaggtcgcgggtcgccgcggcggccgcggccgcgcccagcaggactcaaggccgatcatcaggtgcgtatccatcgctactccggggttgcgtatctcgttaatttccacagtatcaaactgtccggcacgcgttcgtaaaaaatgttgcgtgaaggacaaatctcgtcagattgcggccaaccgcgcggtcatgtcgcacgcgtgtactgttcgagcgcggcttcgtcggctgccagcgtggccggcagctcgtcgcgcaggaaatcgacccaggtacggattttcgcgtcgaggtactgacgcgacggatacagcgcgtagatgttcatcacgtgcgaccggtattcgggcatcacgcgcacgatgtgcccgctgcgcaaccagccgatcgccgaatagagcggcaggccgccgatccccatcccttcgcgcacggccacggcgagcgcctcggcgacgttcacgcgaaacggcggcgccgtgatcgggacgacttcgtcgccgttcggccccgcgagcgcccattcgtcgaactgaaagcccggcgcgaccatcccgaggcatacgtgctgcgcgagatccgcgggccgctgcggcacgccgttcgcctcgacgtagccgcgcgacgcgcacaccacgctgtagctctcgccgagccgctgcgacacgagccccgaatccggcaggtctcggccgacgacgatcgcgacgtcgtagccctcgtcgagcaggtcgggcatccgctgcgcgagcgtcagctcgacgtgcacgtccgggtagcgctcgcggtagcgcgcgatggccggcaccaggtagtgctggccgaggctcgtgaagcaatgcaccttcagcttgcccgacgggcgcgcatgcgcgtcgcccgcctcggcttcggcctggtcgacatacgcgaggatctgctcgcagcgctgcaggtagcgctcgccggcttcggtcagtgcgatccggcgcgtcgtgcggttcagaaggcgcgtgcgcaggtgcgcctcgagatccgagaccgcgcgcgacgcgtaggcagtggtcgaattcatctgctgggcggccgcggtaaagcttcccgcgtcgaccacgcggacgaatacccgcatgttttgtaacgtatccatcccattacccgtttgaatccggacggattgttgcacagaggcaaacaagtattgtctcaggattcgtaaaaatgacttgcacccttgtccatatattcaggaatcgctgaaaaatataatcgcatccgactcatctatatccgaaagggagaaaatcgtgcagtctccggcgacaaagggacgctcgcactggcggttcttgcagtctcattaataatggccgggtgcgcgagcatgggcgacaacaagccgcagtcggcccgcatcgaagcgaacgcgctcgatgccggcgcggccatccgcgcggccgaccgtgacgcgggctggcccgcggccgactggtggcgcgcctaccgcgatccgcagctcgacacatggattgccgccgcgcaggccggcaacccgacgctcgcggccgccgaggcccgcgtgcgcgaagcgcaggcgatggcgcgcgtggcccgctcggccgaattgccgcagatcaacggcaacctctcgctgatgcgccagcactggccggacaacgtctattacggccccggcccgctcgcgaacaccgacacctggaacaacaccggcacgctcggcctgtcctaccacctcgacctgtggggcaaggacaagaacgcgaccgagcgcgcgctcgataccgcacacgcaaccgccgccgacgcacgcgcggcgaagctcgaactcgaggtcaacgtcgtgcgcgcgtacgtcggcatgtcgatgaactacgcgctgctcgacctcgcgcacgaaacgttcgaacgccagcgctcgctcgccgatctcgcgcgcaagcggttgcaggctggcctcggcacgcagctcgaggtaagccaggcggaatcgacgctgcccgactatgagcgccagatcgacagctacgaggaagcgatccagctcgcgcggcaccagctcgccgcactggccggcaagggcccgggcgccggcgatgcgatcaagcggcctcggctgtcgctcgacgcaccggccggcttgccgtcggcgatgccggccgacctgctcggccgccgccccgacgtcgtcgcggcacgctggacggtcgacgcgcaggcgcgcggcatcgacgtcgcgaaggcttcgttctatccgaacatcgacctgctcgcgacggtcggcggcttcggcgtgaccgcgccgttcaccgacttcctgcgcgcgatgaacggcggctggacggccggccccgcgctgtcgctgccgatcttcgaaggcggctggctgcgcgcgcagctcggcgcggcgaatgccggctacgatcaggcggtcgagcaatacaaccagacgatcgtcggcgcgctcaaggacatcgccgaccaggtcgtgcggatccgttcgctcgatacgcagaagaaggacaccgcacgctcggtggccgccaacgaccgcagctaccagctgtcgcgcgaaggtttccgccgcggcctgaccgactacgtcaacgtgctggtcgcgcagcagcaattgttgcgcgcgcaggaaacggccgcccgcatcgatgcggaacgcctcgccgcgcacgctcagttgatggccgcgctgggcggcggcgtcgagacgggcacggacgtgccgggcggccatccgccgggcagccaatcgtcgcatggcgaatccgccgcgggcgcagccgcgccggccgccgcgtcgggtgcgaaacccgtggcagccgccgcccggcccgcgcaggtcgcggccgccggtgccgccggcgtgccggccgcacggtaacccggagcgacgccatgtcagcctcctcctctccccgaccgccggcggtccgttcgcggcctggtatgccgcgttcggcgactgggcccgcaccgacggtgccgcgtggctctacctgttcaaggcactgctcgcggccttcatcgcgctcggcgtgtcgatgcggctcgacctgccggcgccgaaaacggcaatgacgaccgtcttcatcgtgatgcagccgcaaagcggcgccgtgctcgcgaaaagcttctaccgggtcgccggcacgatcttcgggctcatcgcgacgctcacgttcgtcgggctgttcccgcagcagccgcagctgttcctgctggcgatcgccctgtggatcgcgctgtgcaccgccggcgccgcgcgcaaccgcaacttccgcagttacggcttcctgctcgccggctatacgaccgcgctgatcggcctgcccgcgtcgcagcacccggatggcgcattcatgagcgcgatgacgcgggtctccgaagtcatcatcgggatcgtgtcggccggcgtcgtcagcgcgctcgtgtttcctcggtacacgggcgagcatatgcgcacgacggtgcgcaagcgcttcggcagcttcgtcgactacgtcgcgtcggcgctgtcgggccagctcgaccgcgcgcacatcgagaccatccatacgcgcttcgtcgccgacgtggtcggcttcgaggccgcgcgcagcatggccgtgttcgaggacccggacacgcgcatgcgcagcggccgcctcgcgcggctgaacagcgaattcatgagcgcgtcgagccgctttcacgcgctgcaccgctgatgaaccggctgcacgcggccggcgcgcaggccgcgatcgatgcgatcgagccgtatttccgcgagatcgcgccgctgctcacgcgcgatggcgaacccgtgcgcacgtcgatcgacgccgcgcactcggccgagcaactgctcgcgtggcgcgacgcgctgccgcgccgtatccgcgcgacacgcgcggaactcgaaacgcagcccgacttcccgctgctcgacttcgataccgccgccgaactgctgtaccgcttcatcaccgacctgcaggaatacgcggcgacctatgcgtcgctcgcgaccgcgacgcacgagcgcgaacgctggatcgaacgctacgagccgcgcaccaacaaaacggccgccacgatcgcggggatccgtaccgcgacggtgattctcgcgctcggctggttctggatcgagactgcgtggccgagcggcgtgatgctggtgctgaacgccgcggcgacctgcgcgctcgcgtcgtcggcgccgcgcccgaccgcgatggccgcgcagatggggatgggcacggcgctggccgtctgcaccggcttcctgctgacgttcggcatctacccgcggatcgacggcttcgtcctgctgtgcgcggcgctcgcgccgttgctcgcgatcggcatctacatgtcgctgaagccgaagctcgccggctacggcgcgggctatctgatcttcttctgcttcctcgccggccccgacagcatcacgcactacgatcccacgagcttcatgaacgacgcgctcgcgctcctgttgtcgatgctcgtctcggcgatcgcgttcgccgtgctgttcccgccgaccgcgccgtggctcaagaaacgcctgttcgccgacctgcgtcaccaggccgtcgcggcctgccacgcgcggctcgccggactgcgcacgcgcttcgagagcggcgcgcgcgacctgatgtaccaggcgcacacgctgtcggccgaccagcccgacgtgcagcgcgacgcgctgcgctggatgttcgcggtactcgaaaccgggaatgcggccatcgacctgcgccacgagctggcaacgctgccgtccgacccgcgctacgcgccgacgatgccgtggcgccgcgcgatcgaaacgatgcgcgccgcgctgtcgtcgctgttcgcgcggccggacgccgaacgtttcgatgcaacgctcgccgcggtgaacgatgcgatcgacgcgacccggcagacgctcgacgcgttcacgccgacgcgcgaggaacgccaccggctgcagcgcatcctgagccatctgcatttcgtgcgcacggcactgctcgatcccgaatcgccgctcgccgcgctcaaccgcaaccgccccgtgcgtccccaaccaggagcctcgtcatgatgccgcgtgaaatcgccattctcgatgcctacatgcccacggtggtgctgatgttcgtcctcggcgcgctcgcgacctgggccgtcgaccgcctgctcgcctatacgggcctctaccgtctcgtctggcacccgtcgctgttccgggcctgcctcctcgtctgcatttgcggcggactgagtcttgccgtttaccgttgattccgaaccatcatgattctcagaaaactcttcggcttcgtcgcgaccgccgtcattcttctcgtcgcgatcctgatcgggcgctcgctgtgggtgcactacatggacgatccgtggacgcgcgacgggcgcgtgcgcgccgagatcgtcaacgtcgcgccggacgtgtcgggcgcgatcgtcgaactgcccgtgcatgacaaccagctcgtgaaaaagggcgacctgatcatgcagatcgacccgtcgcactaccagatcgcggtcgagcaggcgcaggcggccgtcgccgcccgccgcgcggaactgcagatgcgccgcgacgacgcggcgcgccgcgcggatctcgatgcgctcgtcgtgtcgaaggaaaaccgcgagaacgccgcgcacagtgcgtcgagcgccgatgcgcagtaccagcaggcgatcgccgcgctcgatgccgcgaagctcaacctcgagcgcacgcgcgtcgtcgcgccggtcgacggctacatcacgaacctgcagacgttcaagggcaactatgcggtggccggccaggcgaagctcgcgatcgtcgacagccactcgttctgggtctacggctacttcgaggaaaccaagctgccgcgcgtgaagatcggcgcgccggccgaaatgcggctgatgagcggcggcgtgatgaagggccatgtcgaaagcatctcgcgcggcatctacgatcgcgacaacccgcaaagccgcgacctcgtcgcggacgtgaacccgaccttcaactgggtgcgcctcgcgcagcgcgtgccggtgcgcatcaggatcgacgaagtgccggccgacgtggtgctgtcggcgggtacgacctgcacggtcatcatcgatccggacaagcagaagaagtcgtaacgcaacgcgcgccgggcggcatccgcccggcggcgtcactcccagaagaaccggtaaggcaggaacggcgacgggccgagccccgcttcgccgatcatgttgcgcaaccgcatcgcaaagccgatggcgccgatcgcgacgagtgcggcgatcgcatacgggcgccgcacgtacggcacacgttgcagcggcacgaactggcagcccatcgcgaacagcacgagccactggaagcgcagccccgcatagctgacccgcgcgagcgcgaaactcgcgatctcgcaggcgaacaggaacacgagcgtgcgcggcatgcgggcaagcagcgcccagccggacgcgagggtcagcagcgcgagtacgagcggtgcgctgcccgacatctgtgcaggcggcgtgaatgccgcatagagtccgaacttcgccagcaacgcgtcgtggtgcatcgcgaacagcacgccgccgatcgcgaccgccagccccgcataacgcagcaggcgcagccgccgcacctggagcagcacgacgagcagcaccgccgacacgtgcatgccggccgccgcggccgccagcgcgatcgacgcgccatgccgcctgcgcgcccattcgtccgacgcgatcttggccgcgcagaacgcgaggccataacgcagcccgctcatcgccatgtcgtagaagaacagcggaaagatcagcgtggcgaacacgcacgcatcctcggccgtccgcccgaacgcgacgacacatgcgatgacgatcagcagcgacaggattgccgtcacgatgcgcgggtcgtgcccgacccattcgagcgcgcgcacgagccatacgaagcccggctcgagcgtgcgcggtacaaccttcaggttgccgctccagatgccggcgatgatgtcctggtaaatcgccgtgtcggtgcccgtccggccacgcagcacggcgaacgtggcggccggtgcgatacccgccgcgagccaccgccacggcggcatgcgcgtgcgcatgccgagcgcggcggagacgaggatgcacaggtatccgctcagataaatcgtcgttgtcattgttatgaatgacccgctcggcgcagtgccgcaccggtgtcgatgcgcgccgcgggttctggtccccagctgtgtggaagcgcattgtaggggatcgcgcggcgcgtgactgccggttttgtcacccaccggcggatgagcggcggattgcgcgtgtcgcgggtggccggcccgcgaccgcgcggcgctcgggccgcgtcaggccgcgatacgaaagcgcccgaccagcgacttcaaggcctgcgcctgctcgtcgagcgcgttcgccgcggcggccgcctgctcgacgagtgccgcgttctgctgggtgccggcgtccatctgcgtgaccgcgcggccgatctcgtcgatccccgcgctttgctcgtccgatgccgcggaaatttcgccgatgatgtcggtcacgcgcttgaccgcgcgaacgacgtcgcccatcgtgcggcccgcatcgtgcgcgagcgccgcaccgttcgcgactcgctcgaccgacgcgccgatcagcgctcggatctccttcgccgcggtcgccgcgcgttgcgcgagcaggcggacttcacccgcgaccaccgagaagccgcgcccctgctcgcccgcgcgtgcggcctcgacggccgcgttcaacgcgagaatgttggtctggaacgcgatcccctcgatcgtgccgatgatgtcgcggatgttcttcgcgctgtcgtcgatctcgctcatcgtcgcgacgacgcgcccgacgacttccccgcccgtctccgcaacggccgaagcattggccgcgagcgcgctcgcctgccgcgcgttctcggcgttctgccgtacggtcgacgtgagctgctccatgctggccgcggtgcgctcgagcgcgacggcctgctgctcggtgcgcctcgacagatcgagattgccggtggaaatctcgcccgacgcggccgcgatcgcctcggcgctgacggcgatctcgccgacggtcgccgcaagccccgtctgcatctcggccagcgcacgcaccatgctgtcgcggtcgtgccggcccagcgtgatcggtcgcgtcaggtcgccgcgcgcgatgtccgcggcaatcgccttcgcatgcgcgggctcgccgccgagctgcgacgcgagacggcgcacgacgcgctccgcgatgacgatcgcgagcacgatcagcgcaaccgtcatcgccgcgatcatcgcgaacgacgacgagaaaatggtggcggacgcatcgagcgtcgccttcgacttcgcaccgcgtgtcttcacgagttcggcgaccagtttctcgagcttgccggtttcgaccagcagcgacacgtcctgcgtgccgacctgccagctcatctgcgacaggtcgagcggctgtgcctgcacgagcgcgacgaaatcgcgcagatgcgcgctccacgcgccgaccgccgtcgagaatgcgcgcagccgcgccgaatcgtcgacgtcggccggatccgcatagcgctgcagcgtgccgagcgcctggccgatcgacgcgagccccgcgcccacgtccgcgcccagctcgttgcgttccttcgcggtggtcgcggtcagcagcatcttctgggcacggctcgcacgcagcacttcggcccgaacctcctcggccgcgcggctcgcgacgtgaccctgctcgtagacggacgcgatcgacgcattcagccggctgatctgccaaagcgaaaacatgccgatcgccagcgtgccggcgagcaggatcgcgaatgcggcgcgcaacgtcgccttgacggtccacggccggcgctcgcgacgcgccgcccgcgggcgccgggcggcgcgaccggcggcgacgtcgggtgcggcggcggccgcaccgggctgtggacgcaaagatgctgctttcatcgatatatccccgtattgatcacgcggccggaaaggtcggtcccggcgtacccgcgatggccggccatgccgcgcgtcctgcgcccgcacggcggatagccggtgccgggcgcggcgcgcctgttgtcattgggtcgttctacggccgccaccgccgtttcttgagtccggtaaaccacgcaccggccccgggcgcccgccccgcatgcgggcgggcgtgccgccagcgttatacccggccaaaaagcgggcaccggccgatccgtcggatgaatgtccgattcacgataaaacttgtccggacattcccgatacgccacattacacttctttgacgcagcaacgattcaagacgcgccgatccccagcagagcgcgcccgccacctcaactcgttcagctctcacatggaaaccagcctcgacaccggctccgccggcgcagccgccacccagccttccgcgccacccgtcgcccgcaccgtctacccggtgctcggcgcaatcagcttctcgcacatgctcaacgacatgatccagtcgttgatcctcgcgatctacccgatgctcaagagccagttcgcgctgtcgttcgcgcagatcggcctgatcacgctcacctaccagatcaccgcgtcgctgctgcagccgctcgtcggcctctataccgacaagcgtccgaaaccgtattcgctgccggtcggcatgggtttcacgctcgccgggctgctgctgatgtcggtcgcgccgaatttcccgatgctgctggtggccgcggcgctcgtcggctgcggctcgtcggtgttccatcccgaatcgtcgcgcgtcgcgcggatggcgtcgggcggccagcacgggctcgcgcagtcggtgttccaggtcggcggcaacgcgggttccgcgctcgggccgctgcttgccgcgctcgtgatcattccgcacggccagcacagcatcgcgtggttctcggcagccgcgctcgtcgcgatgatcgtgctcacgcagatcggccactggtacaagaagcatccgtcgatgaagaagaaggccgcggcggccggccacccgacgctgtcgcgcggccgcgtgatgggcgcgatcggcgtgctggtgctgctcgtgttctcgaagtacttctacctcgcgagcatcaacagctatttcacgttctacctgatcgacaagttccacctgtcggtgcaggccgcgcagatccacctgttcgtgttcctcgcggccgtggcggcgggtacgctgatcggcgggccggtgggcgaccggatcggccgcaagtacgtgatctgggtatcgatcctcggcgtcgcgccgttcacgctgctgctgccgtacgcgaacctgttctggaccagcgtgctgaccgtgatcatcggcatcgtgctcgcgtcggcgttcgccgcgatcctggtctacgcgacggagctgatgcccggcaaggtcgggatggtcgcgggcctgttcttcggcttcgcgttcggcctcggcggtgtcggcgcggccgtgctcggccagctcgccgacgcgacgagcatcacgttcgtctacaaggtgtgctcgttcctgccgctgatcggcgtgctgacggtgttcctgccgaacctcgaaagcagccggcgcaagaaggcgtaaaacggccgcggcgcgcctgccggcgccgcggccgtgatgctccgatcgacgggattgacggcggcttcaggccgccgtcgtcgcatgcagcgtcaggaaacgcttgaggatgccggacgaatagctgctcgcgatcgccgacaggaagtgcgagaacgactgcgtcgcgtgatcgtcggccgtatcggagatcgtgcgcacgagcgcgaacggcacgtcgtgctccgcgcacacctgcgcgatcgcggccccttccatttcgaccgcgagcgcatccggcagcgcgtcgcgcagcgcgacgacctcgcgctcgctcgacacgaagcggtcgccgctgatgacgagccccgcgtgcagcgtcgcgccggccaggctgaagcgtgcggcgaactgcgcaccctcttccgcgacgaattgcgtgcacgcggcccgcaggcgcgcggtcagtgcggcgtcggtcgcgaaacgcgtgatgccgagcaacggcacctcatagcgcggaaacagcggcgacgcgtcgagatcgtgctgcagcagcgtatcggccacgacgacatcgccgacgcgcaccgtgcgcgacacaccgcccgcgacgccggtaaacacgatgcccgacacgccgaacacgtggatcagcgcgctgaccgtcgcggcggccgcgaccttgccgacccgcgcgagcgtcaccacacaggccgcgccgtgcacggtaccgacgtgataatcgcggcggccgagcgtgaccgtcttcatcgcgccgtcggcgcgcatcgcggcgatcaggtcgccgagttcctcgggcagcgcggccaggatgccgagcggtcgaatcgaagccgtgcccaccatgtcgatgccggtcattccaccgcctgcagtttcgcgaccgcgagcgcgagccacttctcgccgtgccgcttgaatttcacctgtgccttcgcatcggtgccgttgccttcgagcgcggtgaccgtgccttcgccgaacttggtatggaacacctgctggccgacgcggaaaccggtatcggcggcccgctgcttgttcgcgaacgccggcagcggcgcggacacggccgcatcgacgatctgctcgcgactgccgccgcccggccgcgcgaaccagtcgcgcccgtacccggcgttgtccgaccggccaccccagcgcgaaccggcctcgaccttcggcgtcaaccacttgagcacgtgttcgggcagctcgtcgaagaagcgcgagcgcacgttgtagcgcgtctggccatgcagcatccggctctgcgcgaacgacaggtagagccgctccttcgcgcgcgtgatcgcgacgtacatcagccggcgctcttcctcgaggccgtccgattcgagcacgctgttctcgtgcgggaacagcccttcctcgaggcccgtgatgaacacggccgagaattcgagccccttcgccgcgtgcaccgtcatcagctgcacggcgtcctggccggcctgcgcctggttgtcgccggcctccagcgacgcatgcgacaggaaaccggcgagcggcgtcatcgtgtcggggttctgtgccgggtcggcaggcgataccgggtcgagcacgtcgaccgcctgatcgtccgccgcggagccgagctccggggccgcgatcgcgcctgcgcgcagcggaatcgaacgggccggcgtgtcgagcccgtagccctcctcggcgatgaacgcggtggccgcgttcacgagttcctgcaagttctcgagacgatcctggccttcgcgctcgccctggtagaaatcggcgagaccgctggcgcgcacgatgtgctcgacggtgtcgggcaggttcatctgctgcgtgtcggcgcgcatcttcgcgaccaggttcgcgaacccgccgaggctcgtgcccgccttgcccgtcacgtacggaatcgcggcggccatcgagcagccgtacaggcgcgcggcgtcggcgagctgctcgatcgagcgcgcgccgattccgcgggtcgggaagttcacgacgcgcacgaacgcggtgtcgtcgttcgggttgtcgatcaggcgcaggtacgcgagcgcgtgcttcacttcctggcgttcgaagaagcgcaggccgccatacacgcggtacgggatgcccgacgacatcagcgtgtgctcgatcgagcgcgactgcgcgttgcttcggtacaggacggccacttcgctgcgcgccatcccggtgttgatcagcgagcggatctcctcgacgatccagccggcttcctgcgaatcggtgctcgcctcgtacacgcgcacgggttcgccgtggccggcgtcggtgcgcaggttcttgccgaggcggtgcgcgttgttcgagatcagctggttcgccgcgtcgaggatgttgccgtgcgaccggtagttctgctcgagcttgatcaggttgcgcacccggaattcgtcttcgaagtcgcgcatgttgccgacgttcgcgccgcggaacgcgtagatcgactgatcgtcgtcgccgaccgcgaagatcgcgttctggccgcccgcgagcatcttgagccacgcgtactgcagcttgttggtgtcctggaactcgtcgacgaggatgtgccggaagcgcgcctggtagtgcgcgcgcagcggcgcgttgtacgcgagcaattcatagcagcgcagcagcagctcgggaaatcgacgacgccctcgcgctggcactgctggtcgtatgcctggtacagctcgacgaacttgcggttgaagttgtcggtcgcgtcgaccttgtcgggacgcagcccctgctccttcgcattgttgatgaagtactggacgttcttcggcgggtacttctcgtcgtcgacgttcgccgccttcatcagccgcttgatcgcggacagctggtcggccgtgtcgaggatctggaaggtctgcggcaggccggcgtcgcgccagtgcgtgcgcagcatccggttgcacaggccgtggaacgtgccgatccacatcccgcgcgtgtcgatcggcatcatcgccgacaggcgcgccatcatctcgcgggcggccttgttcgtgaaggtcacggcgagcacggtgggcggcgatgcgtagccctgctggatcagccacgcgatgcgcgtgatcagcacgcgggtcttgccgctgcccgcccctgcgaggatcagcgccggttcgttcggcaacgtgacggcggcgagttgttcggggttcagattggcgagcaggtcgggcatggagcggcagcgaacgggcgagaaaatgcggacccgacattataaggcggccggacgatgccgttcccgatccgttcgaccgcctgtcgcgcgtacgttgccggcacgtggcggccgcgtcgcgacgggcccgcgccggcaaggcgatggctggtcgatgtgcatccatttataattgtcggattcggcatccaattcacgcatttttcggcagatttccaacatgagcgacaacacgcttgcgaagagtttcgagccccacaccatcgagtcccattgggggccggagtgggaaaagcgcggttacgcggccccggcattcgatccggcccgccccgatttctcgatccagttgccgccgccgaacgtgacgggcacgctgcacatgggccacgcgttcaaccagacgatcatggacggcctcgcccgctaccaccggatgctcggcgagaacacgctgtgggtgcccggcaccgaccacgcggggatcgcgacccagatcgtcgtcgagcgccagctcgacgcgcagggcgtgtcgcgccacgacctcggccgcgagaagttcgtggagcgcgtgtgggaatggaaggaaaaatccggttcgacgatcaccggccaggtgcgccgcatcggcgcgtccaccgactggtcgcgcgaatacttcacgatggacgacaagatgtcggccgccgtgcgcgacgtgttcgtcacgctttatgaacagggcctgatctaccgcggcaagcgcctcgtcaactgggatccggtgctgttgaccgccgtgtcggatctcgaagtcgtgagcgaagaggaaaacggccacctgtggcacatccgctacccgctcgtcgacggctcgggctcgctgaccgttgccacgacgcgcccggaaacgatgctcggcgacgtcgcgctgatggtccatccggaagacgagcgctacgcgcacctgatcggcaagctcgtcacgctgccgctgacgggccgcgagatcccggtgatcgccgacgactacgtcgaccgcgagttcggcacgggcgtcgtgaaggtcacgcccgcgcacgacttcaacgactaccaggtcggcctgcgccacaagctcgcgccgatcgagatcctgacgctcgacgcgaagatcaacgacaacggccccgagcagtatcgcggcctcgaccgcttcgacgcacgcaaggcgatcgtcgccgacctcgatgcgcagggcttcctcgattccgtgaagccgcacaagctgatggtgccgcgcggcgaccgcacgggcgtcgtcatcgagccgatgctgaccgaccagtggttcgtcgcgatgacgaagccggcgccggaaggcacgttcaatcccggcaagtcgatcacggaaacgtcgctcgacgtcgtgcgcaacggtcagatcaagttcgtgccggaaaactggacgaccacctattaccagtggctcgagaacatccaggactggtgcatctcgcgccagctgtggtggggccaccagattcccgcgtggtacggcgagaacggcgaggtgttcgtcgcgcgcaacgaggaagaagcgcgcgcgcaggccgcagcgaagggttacgcgggcgcgctgaagcgcgacgaggacgtgctcgacacgtggttctcgtcggcgctcgtgccgttctcgtcgctcggctggccgaacgaaacgcctgaactgaagcacttcctgccgtcgtcggtgctcgtcacgggcttcgacatcatcttcttctgggtcgcccggatggtgatgatgaccacgcacttcacgggccaggtgccgttccacaccgtctacgtgcacggcctcgtgcgcgacgcggaaggccagaagatgtcgaagagcaagggcaacacgctcgacccgatcgacatcgtcgacggcatcgatctcgacacgctggtcgcgaagcgcacgacgggcctgatgaacccgaaacaggccgcgacgatcgagaagaaaacgcgcaaggaattcccggacggcatcgccgcgttcggcaccgatgcgctgcgcttcacgatggcgtcgatggcaacgctcggccgcaacgtgaacttcgacctcgcgcgctgcgagggctatcgcaacttctgcaacaagctgtggaacgcgacgcgcttcgtgctgatgaactgcgaaggccacgactgcggcagcgacaagccggaagtctgcggcgcgggcgattgcggcccgggcggctacctcgacttctcggcggccgaccgctggatcgtctcgctgttgcagcgcaccgaggccgacatcgcgaagggcttcgccgattaccgcttcgacaacatcgcaaacagcatctacaagttcgtgtgggacgagtactgcgactggtatctcgaactcgcgaaggtgcagatccagaacggcacgccggaacagcagcgcgcaacgcgccgcacgctgctgcgcgtgctcgaaacggtgctgcgcctcgcgcacccgatcatcccgttcattaccgaagcgctctggcagaaggtcgcgccgctcgccggccgctatccggaaggcaaggccgacggagaagcgtcgctgatggtgcaggcgtacccggtcgcgaacctgcagaagatcgacgaggtgtccgaacagtgggcggccgacctgaaggcgatcgtcgacgcgtgccgcaacctgcgcggcgagatgaacctgtcgccggcaaccaaggtgccgctgcttgccgccggcgatgccgagcgcctgcgctcgttcgcgccgtacgtccaggccctcgcgcgcctgtcggaagtgcagatcctcgcggacgaagcggcgctcgacaaggaagcgcacggcgcgccgatcgcgatcgtcgggccgaacaagctggtgctgaaggtggaaatcgacgtcgcggccgaacgcgagcgcctgtcgaaggaaatcgcgcgcctgacgggcgaaatcgcgaaatgcaatgcgaagctcggcaacgaggctttcgtcgcggtgcgccgccggcggtggtcgaacaggagcagaagcgcgtcgcggaattccagagcacgctcgaaaaactgcgcgcgcagctcgatcggttgcctgcgtaacaaagggtaaggttgtttgcgttcactataatgcggacgtgaacataaaccgtctgacaagtcgattacagaaataaaggttcgatcatgttgaaagtcaccaaggcggtattccctgttgccggcctcggcacgcgcttcctcccggcaacgaaggcaagcccgaaggaaatgctgccggtcgtcgacaagccgctgatccagtacgcggtcgaggaagcgatcgccgccggcattaccgagatgatcttcgtcaccgggcgcagcaagcgcgcgatcgaggaccacttcgacaagtcgtacgaaatcgaggccgaactcgaggcgcgcggcaaggagaagctgctcgaactcgtgcgcagcatcaagccgagccatgtcgactgcttctacgtgcgccagccggaagcgctcggcctcggccatgcggtgctgtgcgcggaaaagctcgtggccgacaacccgttcgcggtgatcctcgccgacgacctgctcgacggcaacccgcccgtgatgaagcagatggtcgacgtgttcgaccactatcacagctcggtgatcggcgtcgaagagatcccgccgtcggagacgaagtcgtacgggatcgtcgacggcaaggagtgggaggagtcgatcgtcaagatgtcggcgatcatcgaaaagccggcgccggaagtcgcgccgtcgaacctcggtgtggtcggccgctacatcctgaagccgaggatcttcgagcacctgcgcgcgctgaagcccggcgcgggcggcgaactgcagctcaccgacgcgatccaggcgctgctcgccgatgaacaggtgctggcctacaagtaccagggcacgcgctacgactgcggcagcaagctcggctacctgaaggcaacggtcgaattcgcgctgcgccacgcggaagtcggcgcggaattcgacgcgtacctgcgcgcgcgcgccagcgcacacccggccgactgaacgcggcaagggcacgagggctcactccggcgagcccgccctcacctcaccggccggcgctcagcgcgcttcggccggcttcaccgagacgacgcccggcatcccgcccgcgtcgtctttttcgtcttgacgagccagccgttgcccgcgtcgaacggcatcttcgcgagcgcgctcttcacgagcgccggcgcggcctgctgcgtgcccggctcgcgatcgcgcagcgacgccgtcacgcgatagacgtcggcccccgacttcgcgtcgacgaaccgcagcgtcaacacgtggcggtataccttcccggcgaacggcagcgcgagcggcgacggcccgtcgacggtcacgcacgcgctgctcgccgcaccgcactggtcggcgacggccgcgaccgccgtcggctgcgtcgcgtaggcgaccgacagccggtagcgcgcgtccttgagcggtttcgcatcgaagccgcggtgcgcgagttcgtcgcgcacgagcgtctcgatctgccggtattcggcatcgttggcctgcgcggccgtccgcacgaaatcgtagccgtgtgcatcggatgcgaacgcgttcggctgcccgaccgcactcacaccgctcgtcacgccggcgcaacccgtcaacagcgacgccgccagcgcggccgctgcccattcctttctcatggctttcccaaatacctgccgtcgtgcccggccctatcaggcggacggctcgtcgatcgcgggcagcgacaccgtcaccgcggtgccgacacccacctcgctgtcgaccgacacgctgcccccatggcgcgtgacgaccgtcttcacgaatgccatgccgagcccggaacccgagatttcgggccgctcgccggcatggaaccgcttgaaacgctcgaacagatgccgctgatcttccggcgcaatgccgtacccctgatcgcgaatcgtacagaacatccgtctcgacgcatgctcgaccgccagcgtacacgtgatcacggtatcggacggactgtatttgactgcgttgttcagcaggttcacgaacgcgcgcgtgatcagcgagcggtccgcgcgcacccagcacatgtcggtgccgacgtcggtgtcgatgcggatgtgcttcgcctgcgcctgcggccatacctcgtcgctcgcgtcgatcagcacgtcgacgaggctcgtcgcctcgagctggtacgcctgcgactccgcgcgcgccagctgcacgaactcgtcggcgagcgacagcgcgcggtgcgcgtagcgctcgatccgcgcgagcagcccgcgcatcgcgtcggtctcgacgcggtcgcgctcgatctcgacgagcgcgaggatcgacgactgcggcgagcgcatgtcgtgcgacagcaggtgcagcgcttcctcgcgatgccgctcggccgcatgcagttcggtcacgtcgacgaggccggcgatccagcccgtcacgcggccctgcgcgttcgtgcaagcggcgtagcgtaacagatggtcgagcccgtcgcgatcgcgcacctcgatgccgcgcgccattgcatcgtgctcgtcctcgagcgtcgggtcgagcacggccggccagcgctcgcgaatcgccgcgtcgtgttccgcgttgccgtcgacggtcttcatgaacgtcagctcgccgagcgcggtgcgcagcggccgcccttccggcagcggcagcgcgagccgcgacccgtagcgcttcgctgcatggttcgcgatcagcacggtgccggccaggtcggtcacgaagatcggctcgggcatgctgtcgaggctgtcccacacgaagcgcttcatgtcctgcacgcgctgcgcggcttgcgccatcagcgccatctgccgctcgagcacgtcgccgccgacgctgcgcgtgcgcggcgcctcgggcagcaggtgcggctcgtcggcgagccgctgcagctcgcggcgcaggtacgacatcgtcatttccaggcgccgccagttccagatcgggtagacggcgaccagcccgaagatcgcgggcgccggcgacagccagatgcgcgcttcgaacagcagcgccatgctcgcgacgacggcgagcccggcaaggctcagcgtgagcagcagcgcgcgccacggcgacagcatcaggaagccgcccagcagcacggcgagcggcagcagcgacgcggcgaacagcccggcgcgcgacgcgggcgagatcgcgctgccggtcgccagcatatcgagcacgttggcatggatgtacacaccggcgagcggcccgaactcgccggacacgggcgtcgcgaagcggtcgtacagccccgacgccgtcacgccgacgacgacgatcttgccgcgcagcgcgtcgggtttcacgcgcccttcgagcacgtcgtcgaacgacagcgtcggatacgcgggcgtgttgcggctgaacgggatcaggtagcggccctcgcccgccgcgtcgcgcgacaggtcgtgcgcatgcgcaccgggcacgccgccgaccggatgcagccggccgccctggatcgcgcgatacacgggcaccatcagttgcggccagcgcacgcggccgtcgctttcgaacagcgcgacgctgcgtacgataccgtcgcggtcgacttcgaggttgatgtggccgagcccgaccgcgcgcgccgcgagtgcggccaccggcggatcgaccgcgcgcgtgccgtccgcctgttcggggctcagcagcacgggcaggaaggtcggcacgtggctcatcgcgtccgcgaacgcgcgatcctccgcggacggctcggtaaacagcacgtcgtagacgacggcagccggctgcgcgcgcgcgagcgtatcgagcagccgcgcgtgcacgttgcgcgaccacggccagcggccgagcgcggacacgctctggttgtcgatgtcgacgaccaccacgtcgggcgacagcggcaggctgcgcagcatcagcagccggtcgtagatcaggccgtcgacgctcgtcgacaggcggccgagcgcgcacgcgaggatcaccgcgatcccgaggcagccgatcgcgatccattcgatcaggaagcggcggccgaggcgccgccgcggggaaacggagtcgggtttcatgcgccgcggatcagcgcgacagcgtgaacgcgctgaccggactggtcttctcgtagaacttgccgccttcgaattcctcgacggtcacggcccagaaatagtcgcccggcggcaggtgcgcgacggtgatctggcgcgcatgcaggccgacctggtcgacgaccggtgcgctcaggtccttcgagcgcgacagcacgaaccggtagcgcgcatccttgcccgaaccgttcggcgaccagcggaactcgtagccgtcggcgccgggcgacgcgctcgcgtcgagccccatcacgcggcgctcgaacgcatatgtgcgcggccggccctcgaggccgttcgcgtcgatcgcggcgacccgcacgaagtagttcccgttcggcacgtcgtgaaagaccgcccgcggagaatcggtgcgcgtttcgcggaacaggtcgagcagcccggcgtcgtgcgcgagctgcaagcggtagccacgcgcgtcgccgagcggcgcgacgtcgaatgtgacgtcgggctcgtcctgcaccttgtcgggatgcgcgagcgccggtgcgggcagcagctcgacgggcgcgccgaccgcgccggacgacgtcgcgacgctgccgaaattcgcatgcacgagcgtcgggccggccggctgccgatcacccgcgacgccgacggtgccgtcgagcacttcgacgcgcgtcgacgcgctaccggctgcgtcgtaattcacgcgaaagtgcgtaccgcgcacgccggccacgaccgacggcgaacggatctggaagcggtcgtcgcgtttcttcagatgggtgacctcgctgtcgaccgagccgcgcgtgagttcgaactcgcgatcgagcgtgccggtcagcaccgtgcggcgcagcgccttcaggtcgagctggctgtcgggcggcaggctcatgtgcgtgccgtcggcgagctcgagcgtcacgaagccgttcgggcccgtgcgcacgcgatcgccctcggcaagcgtcgcatcgttcgcgagcggcgcgtaagcgtcgccggacgcgcgttcggccgtcccctgtaccgcgacgacgcgcgcggtcagtttttccttgcgcagacgcgccaccggcagcttcagcgcgatgccgggctgcaggtgcttcggcgcgggtacgccgttgatctgctgaagcagctgccagtcgtccgcgccctgcaggtagcgcgcggcgacgtcgtacagcgtgtcgcccgcctgcgtgcggtagacgaccatcttgcccgccgcggcaggcggctgcgcggccgcatgctgcgcggcgaacgcaaacgcgaccgcgcaggatacacgcagcgccgccgtccgcaggttcgccgtgtgctgcgtgattcccgtggtcactccggttctccctggccgacccgctcgagccggtagccgtagccgtagatcggcgcgaggcgatagccgttttcgggccgcaggccgagcttggtgcgcagcatcgagatgtgcgtatccatcgtgcgcgacgggatgtcggtcgcctgcttccacacgagatcgagaatgtgcgcgcgcgacagcggccggtcgaggtgctggaacagcagcagcgcgagctcgaattccttctgcgtgaggctcacggccttgtcgccgacgtaggcttgcttcaggttcacgtcgaagcggaactggtcaaactcgcgaacggttgcctcggcgttgaccggatacgcgcggcgcagcaacgagccgatgcgcgcacgcaggatcgggcccgacacgggcttgaccacgtaatcgtcggcgccggcgttgaggatctgcgtgatccccgcctcgtcgtcacggctcgtcatgaagatgatcggcaggctgtgctcggtctgattcgcacgcacccacttcagcacttcctcgccggacatgtcgggcacgttccagtcgagcaccagcagatcgaacgtctcgcgctgcaggcgcttcttcagggccttgccttccttgaacgcatagcacgtatggccgacggccgtcagcgtttgactgacgaaatccgtctgggccggatcgtcatccagtacagcaattctcatagcaccccgcaaatcgaaatcgattcgtccagttcagctccccgccccaccccggccgcgcagcacatgcgcggcttccggataccggccggcgagccgtcgttcgccgctcgcgccacctgcgcaaaccggcgaccccggctaaatatctcaaaaacggggcacggacgaaccggcgatttcatcatagtagtatgaaattcgccaataaattgcgcggactaccgtcttttcttcgaataatgcttcctgtcgcgcaatcgggcgtctagtcggcgcccgcgatgccggccaccggctcgacaacatcgtcggccggcacgtgctgcgacagcggttccgcatgcgccggttgtacaagcatccgctgcagctggccgcgcacgcgctcccacgcggcggccgcatagtccggctggctcgccgcccacgcctgcgccagatcgaacacgcgctcgatcgtcgcaccgcagtaggtcaggcccgagccgtcgtccagcgcggcgtcgcgcagccgttcgtcgagccactcggccagccacggcatctcggccgcggccgaatccgcgtaagcctccagcgccgcacgcgcgtgacgatcctgctgcggatcaagctcgatacggctcagtcccgatacgctgcgttccgctccggacggacttcgaatggtccctggtctgaaggacatgtcctctccccgttgtacgacggtagcgtcaggcatggcccccgtgcccgccgtaagacgtaccgtggccggcgcatccgctgggagcggacgaccggccgggtcagatacgcagccggtcacgaagcgaggtttaagaattgtcagaaaagcgcggcccggcgccaggcgcggccggcagcatgacgcgggccttcagcggcggcgcatcaggaacacgaaggtcttgtcctgcgtcgtcgattcgacgatctcgttgcccgtctgcttggcgaacgcggcgaaatcgcgctgcgaacccggatcggtcgcgagcaccttgaggatttgcccgctttccatatcggcgagcgctttcttggcacgcaggatcggcaacgggcaattgagcccgcgcgcgtctacttccttgtgaatctgcatcggctgtcgaccttcgaatgtcgcgccacacgcggcgcgggaagaagccgcgattttaccgcagcgccgccgcgcctgcccgggcaggccgaggcccggcacccgcgggcaccgggttcacgcgccggagaagccgcccgcgagccgttcccgcaggtgccgcacgagcgcgcgcaccgcgctcggcacgaccgggctgtacgggcggatcgcgaagatgtggtcgccgaacgcgcccgacggccgccagccgtcgagcagcgcgacgagccggccggcgtcgagatcgcgctgcgcgctgaagtccggcagcaacgcgatgccgagcccgccgagcgcggcttcgcgcatcgcctcgctgttgttcgccgcgaaactgccgcgcaccggcacgctcacgcgctggcgccgccggccgtccggctcgaagctccacgcggccggctcgtgctcgcgcaggtagcacaggcagctgtgctcgacgagttcgctcgggtgcctcggcgcgccgcgcgcgtcgaggtagtcgcggctcgcgacgagcagcgaacgcgtgtcgcacagcttccacgcgacgtgggtctgcggcgcggtggtcgtatggcggatcgcgaggtcgaaaccctcctgcgtcagcgaatgcagccggtccgacaggtcgagctcgatatgcacgcccggatgccgccgcaggaaatcaggcaggtgcggcacgacctgctggcgcccgagcgcgaccggcaccgtcacgcgcagcaggccgcgcggctccccggccaggtccttcacgcgcgcgaagtgctgcccgatcgactcgaacgcgtcgcgcgtgctgtcgacgagcgtctggcccgcgtcggtgagccgcacgctgcgcgtcgtgcgccgcacgagcggcacgccggccgctttttcgagatcggcgatgcgctggctcatcgcggccttgctgatgccgagccgctgcgcggcggccgtgaaactgccggccgcggccagcaccgtcagcgaatggatatgcggccagagggcctggacattttgctgattcatccgccgattattcagaattctgaacagtgaatcaagctgcgcggccttctcccgcccggcgcgtttgcctagactgggtgctgtccaccctacccgatccctcaggagacacgatgaatccggttcccgcgtacacctccgacgccgacgtcggccactatgtcgacggcacgcccgtctccggccgcagcggccgcttccaggacgtgctcaatccggcgctcggccgcgcggtgcgccgcgtcgcgctcgccgacgacagcgaagtgcagcaggccgtcgcgtcggcccatgccgcgttccccgagtgggccgcgacgccgccgatccgccgcgcacgcgtcctgcatcgcttcctgcaactgatgaacgagcaccgcgacgcactcgcggcgatcatcacggccgagcacggcaaggtgttctccgacgcgcagggcgaagtcgcacgcggcatcgacatcatcgaattcgcgtgcggggtgccgcagctcctgaaaggcgacttcaccgaccaggtcagcaccggcatcgacaactggacgatgcgccagccgctcggcgtcgtcgcgggcatcacgccgttcaacttcccgtgcatggtgccgtgctggatgttcccggtcgcgatcgcgacgggcaacacgttcgtgctgaagccgagcgagcgcgacccgtcggcggccttgttcatcgccgacctgctcacgcaggccgggttgccggccggcgtgttcaacgtcgtccagggcgacaaggggcggtcaacgcgctgctcgaccacccggacgtgcaggccgtcagcttcgtcggctcgaccccgatcgcggcctacgtgcagcaacgcgcggtgcagtcgggcaagcgcgtgcaggccctcggcggcgcgaagaaccatctggtggtgatgcccgatgcgaacctcgaacaggccgtcgacgcgctgatcggcgccgcgtacggctcggccggcgaacgctgcatggcgatcagcgtcgcggtgctggtcggcgacgtcgcggacaagatcgtgccgctggtggccgagcgcgcacgcaagctcgtgatcggcgacgggatgtcgccggaagtcgagatgggcccgatcgtcaccggcgatgcactcaagcgcatcgaaggctatatcgagcaaggcgtgaacgaaggcgcgcaactggtggtcgacggccgcgggctgcgcgtgccgggccgcgaggcgggcttcttcaccggcggcacgctgttcgaccacgtgacccccgacatgcgcatctacaaggaagaaatcttcgggcccgtgctcggctgcgtgcgcgtgaaggacttcggcgaggcggtcgacctgatcaacgcgcacgagttcggcaacggcgtgtcgtgcttcacgagcgacggcggcatcgcgcgcgaattcgcgcggcgcatccaggtcgggatggtcggcatcaacgtgccgattccggtgccgatggcgtggcatggcttcggcggctggaagaagagcctgttcggcgacatgcacgcctacggcgaggaaggcgtgcgcttctacacgcgccagaagtcggtgatgcagcgctggtcgtcgagcatcggcaagggtgccgaattcgcgatgccgaccgcgaagtaatcgcctgaaggcacgccggcggccggccgctggccgccggttgccggttgccggttgccggttgccggttgccggttgccggttgccggttgccggttgccggttgccggttgccggttgccggttgccggttgcttccgcggccggtataccggcaggcgacgtcagccggccttcgtgccgtgcgcgccgtcggcggtcggcaggtacgacagttcgagccgatacgcgagcgcgacgaacaggctctgcgcgagacccatcgtggccgtcagcgcgcggaagccgaacgtctcgctgtcctgcaccatcagcgtcacctcggcctcccgtgcaagcgggctcatccggctgtcggtgatcgcgatcagccgcgcgccgcgctgcacggcctgctgtgcgacctgcacggtttcctccgcatacggcatgaacgagatgacgatcatcacgtcgcccttgcgcaccgaccggatctgcccgagatgcatgctgcccagcgcgctgaacagcccgatgcgcttgtcggtgtgctgcagcgcgtagtcgaggtacacggcgatcggaaacgcgcgccgcgagcccgcgatccagatcgcctgggtttcggcgagcaggtcgacggcctgcgcgagcgcctgcgaatcgagcgtctgccgcagctgctgcatgccggcaatgctgcccttgatgaattcgtcggcgatctgttcgggctgcaggctcgacgagcccgactcgatcacgtcgcgcagccgcaggttgtacgcgcgccccggcgcgatctgctgcgcgagcccttcgcggaacagccgctgcatctcggagaagccggaaaagccgaaatgcttcgcgaagcgcacgacggccgacggctggacgccgcacgcctccgcgagcgactggatgccttccaggccaagctggtcccgatgcgtttccacgtggcgcgcaatcaccttcaggcgattgctcaggccgtcgtactcctgcgtcaggtgctgcaggaactgctcgacggtggcgggaggtttctcggatgaactcatcggatagcgcgaagttgacggccccgatgcgcgcacgacactgacggacgcggcccggggctcacctgaacacatgcatgaagggcgaatttaatcacgtttgcggcgcggcccgcgccacgtgctcgctcccacgcgctcgatcatcacttgcctacgctccacggcgatactggaagcgattgtccaatgctcgcgcggcgtcgtaaagattagggcgtctaccaagccggccatcggggcgaagcggcgagaaacagcgagaaacggcaaaagcgacagaagcggagacatggggcaggcagccgctcgccccgcagcctgcccgcgccgccggttcagcgatagtcgacccacaccccgcccgcatcggcggagcgcacgcagttctccacccagcgcacgccttccacgcccgcatggacatccggaaagcgaatgctcttcaacgccgcgacgtcgccgcggtcggccgcatccatcgcaagcgcgaagcgcgcatagagattcgaccaggcctcgaacagcccctccggatgcccggcaccgatgcgatcttcgcgcaatgcgtgcggatgcagataacccatcccgcgatcgagcacctgggcgggctgcccctgcacttcgtagcgcaactggttcggatgctcgtcccaccattcgacgctcgccttcgcgccgatcaccctcaccttctggccgtgcatcgagcccgcgttcaccgcgctcgaccacacgtaaccgaccgcgcccgtgtcgtactccatgatcgtgaacgcgttgtcctcgagcggcgcgcggctcttcacgaagctctgccgcgagcacatcagccgccggatcttcagctcgggcgccatcacttcggagatgtacagcggatgcgtgccgatgtcgccgagcacgtagctcgggcccgcgaacttcgggtcgacgcgccagcgcgcggccgcgctcgcggcctcgacgccctcgctgtggaacccgtgtgcgaactgcatctgcacgatacggatctcgccgagatcgccgcgcgcgatcatctcgcgcgcctgttcgatcatctggtgtccggaatagccgtacgcgacgccgacgatccggttcttctcgaccgacagccgctgcagcgcctcggcctcctcggtcgtgaagcacagcggcttctcgcagaccacgtgcagccccgcgttcagcgcggcgcggcagatctcgaagtgcgtgttgttcggtgtcgcgatcgacaccgcgcggatgccgtctgggcggcgcacctcggcgtcgaacatcgtcgcgtagtcgggatagcagcgctcggcggcgacgccgagcttcacgccgaactggcggccgcgttcgggatcgatgtcgaacgcgccggcgaccagctggaagctgccgtcgcgcaacgcggccgaccggtggctgtagccgatctggctgccgagcccgccgccgaccatgccccagcgtatcgaatgtccaagcagaatctgtccgtcaatcatgatggtgatgttcctggttcgtgttcagggtgttcaggggtgcaacgcgcggtggatcatgcgaagccggccgacgcgagaaacgcgcggctcgcggcgacgtcgcgcaggctcgtgccggcattgcgcgggtcgcgctcctgttcgatcgtgatgtacccggcgtaaccgatgtcgtcgagcgcgcggcggatcgcccggtagtcgagcacgccggtgccgatcgggcacatcacgccgcgcgcgcacgcggcgaagaacgcgatgtgctcgcccatcaccgcgtcgtacacggccgcgtcgatatccttgaagtgcacatagtcgaggcgcgccgcatggcggcgcagccaggtttccggtccatgcccgagtaatgcaggtggccggtatccagacagaggccggccgtgtcggccggaatgtcggcgacgatccggtcgatctcgtccgcgaattcgatgtagccgcccgcatgcggatggatcaccgtgcgcacgccgaattcgtcgcgcgcgatcgtcgcgatctgccggatgtgctcgaccatgccggcccagcgtgcgccggacagccgcggcgcgcgatcggcgtggccggccgcgtagtcgcgttcttcatgcccccagtcgatcacgaccaggtacggcgccgcgtagcgctggccgtcctgcgtcggcagtttcggcagccgcgtgatcagcgcgcagatctcgcgcgtctggcgcaacaggttcggcaggttctccggcgccacgagatcgtcgaagatcgtaccggcggtgatgctcaggcgctgccgttcgagctcggcgctcaccacgtcgagttcgagcgggatgtagccgtacggcccgagctcgatgcccgagtagccggcctgcgcggcttcggctagcacctgccgccacggcggcaggtgcgggttcttcacgtcgtcgacaccccagcagcacggtgcgcaacccatcttcatcgtcatgtcggtcagtccggcaagtaggtaggcggctgcggttcagccgcgatagaacgcgggacgatcggccatcgcgatcgattcgaccgccccgctcttttgcgcacgcacgcatgcgtcggccgcgaccgccgccgcgtaaccgtcccaggccgacggcccggtgagcgcgtgcgcgcgcacgccgtcgatgaacgcctgcagctcgacgtcgtacgatgcgatgaagcgctccttccagtcggtcatgatctcgaccgactgccgcgccgcatgcttgagccccaccgccggcggatcgggcagcttcgcgatgccctgctcgccgaccacctcgcactggatgtcgtagccgtactggcagttcacgaagatctcgacgtcgatgcgcacgccgctcgcggtttccagcaacacgatctgcggatcggcgagatgcgacgatgcatggcgcgtcttcttcggatagacgacctgcgtgctcacgtagtcctcgccgagcagccagcgcagcacgtcgagttcgtgaatcagcgtatcggtgatcgccatgtcggtcgtgtagcgctcgccgaccgactggttgcggtgcgcgcaatgcagcatcaagggcgcgccgatctcgccgctgtcgatcacgcgcttgagcgcgcgatagccttcgtcgtacggacgcatgaagccgacctgcacgagccgcttgccgtgcgcgacttccgcttcgacgatccgcatgcagccttccgccgtgacggcgagcggcttctcgcagaacacgggcttgccgtgcgcgatcgcgtcgagcacgaacgcttcgtgcgtcggccccacgacgtgacgagcacggcctgcacgtcggcggccgcgaccacctcgtggccgtcggcgtagatctcggcatcgagcccgtacttcgtcaccgcgtcgcgcgcctgctgcggatcgatgtcgttgacggccacgacacgcgcgccggacagcgtgcgggtcagtctgcggatgtggtcctgaccgatcgcgccgcagccgatcacgccgatttgcaaggtcatctaacagtctccagtcgttcatctgcggtgcgacacccgccgcaccggccagcaacaggtcagcgcgcggtgcgatcgaaaaacgatcgacgtagcgccggatcgtgtcgcgcatgtagcgcgacgacgcttccgcgcggtcctcccacgcgaacacgcacgacgacatcacgccgtcgaagcctgccgcgccgagcgcgcgaaagaacacgtcccagtcgatctcgccctgcccgatgtcgagatgctggtgcacgcggatctggttcgaaccgggcgggttcacgatgtagcgcagctggctgctcttgcggtggtcgaaggtgtcggccacgcgcacgtgcgcgaggatcggcgcggcctgcgcgatcatcgcggccatgtcgtcgccgtagtagaacgtgtgcggcgcgatgtacgacagcttcagcgacggcgagccgatgttcgtgacgatgtcgatcgccggctgcagctgctcgatccagtcctccggatgcggctcgaccgacagcacgatgcgctcacgctcgaggatcggcagcagctcgtccatcgaacggaaccacgcggcttcgcacagctccttcgggttcgcgcccggccgttcgccgaccgagcgctcgggcgacgcgccgcgcccgaactccgacaccatcagcgcgcactccatctcgaccgccacctcgatcgccttcttccagcagcgcacggcccataaccgctcgtcctcgaacgggctcgcccagcggtacatcggctgcagcgacgcgaggccgacgccgctcgcgcgcatcgcctgccggaaagcggccatccgctcgcgcgtcgcgcgcggcatcacccaccagtcgagcgctgcgcggcgacagctcgatctggtcgtagccgagctcggccaccgcgtgcggcaggcggtcgagcggcaggtggcgaatcatgtaggggtccagcgcgatcttcatcgaaagtcctcggcgatagcgggttcgggacgaacgcggcggcacgtgccgccctcgtccggcgatgcatgacggtcagcggcgcttcttcttgttgcggtactggtcggcgatcacggccgcgacgatgatcgcgcccttgaccatctcctggtaatacgcgtcgatgcggatgaacgtgaagcccgacgtcatcacgccgaggatcagcacgccgatcacggtgcccgtcacgcggccgagcccgcccgacagcgacgtgccgccgatcacgacggccgcgatcgcgtcgagttcgtacatcacgcccatgcccgactggcccgagatcgcgcgcgcggcggtcacagtgccggcgatcccgctcagcaggcccgcgatcgcgtagacgaagaccaggtggcgcgtgacgttgatgcccgacacgacggccgcgtgacggttcgcgccgatcgcgtacgtgtacttgccgaagcgcgtgtagcgcagcacgacgtggaagatcgcggcgatcacgaggaagatgatcaccggattggcgcctgcgccgatggccgcgaactggtcggtcagcatcgacacgggcatcccgttggtgaaccacttcgcgaacccgcgcgcggcgaccatcgtgccgagcgtcgcgatgaacggcgggatgccggtcatcgcgatcagcgagccgttcagcaggccgaccagcagcccgacgcacacgccggccagcacgggccagatgatcggcaggtcggtcaggtgcgggaacaccgcacgcgggaagtcggacacctgcgcaaggcttgccgacacgaccgccgcggcggccacgaccgagcccgacgacaggtcgatcccgctggtgatgatcacgaggttcacgccgaccgcgatgatgccgatcacggccatctgcagcacgatgatctcgagccgctcggtgttgaacaggaagctctggccgacgacgatccagccgacgatctcgaagaacaggctgatgccgacgagcacgaggaaaatgctcagttcgggcggccacttcatgtgccgcgccttgatcgtcatggtctgcgcatccgcagccggattcaggttgcccatttcatttgtctccagtcttgtttcggctcagcgcgacgcgagatccatgatgcggacctggtcggcgtccttgcgatcgacgatgccggtcatgcgcccttcgtgcatcaccatcacgcgatcgctcattcccagcacttccggcatttccgacgagatcatcagcaccgcgacgcccttgccggcgagcgcgctgacgagccggtgaatctcggccttcgcgccgacgtcgatgccgcgggtcggttcgtcgaggatcaggatgcgcggctgcgtgagcagccaccggccgatcagcaccttctgctggttgccgcccgacaggttctggatctcctcgtgcagcccgggcgacttcacgcgcagcatccggctcatttcctcgcagtcgcgcttcaactgcgcctgccgcacgaaattgaacttcacgtagcggttgctgagcaccgccgcttccatgttcgcgagcaggtcgagattcaggaagcagccggtgtccttgcgatcctcggtgaggaaggccatcccatgcttcatcgcctgcgcgggtgtcgcgatccgcaccggcttgccgtcgatccggatctcgcccgacgtggccggcacgacgccgaacagcgcctccgcgacgttcgagcgccccgagccgacgaggccggccacgccgaggatctcgcccgcgcgcagctcgaagctcacgtcgcggaacacgccgtcgacgccgaggttcttcaccgacagcacgacgtcgccgatcggcacttcctccttcgggaacatctgcgtgatctcgcgcccgaccatcatgcggatgatgtcgtcgcgcgtgacgtcgctcgacgcatgcgtgccgatgtacttgccgtcgcggaacaccgaaaactcgtcggcgatctcgaacagctcgttcatcttgtgcgtgatgtagacgatgcccttgccctgctcgcgcagctggcgaatgatccggaacaggtgcgtgacttccttgtcggtcagcgcggaagtcggctcgtccatgatcagcacgtccgagtcgaacgacacggccttcgcgatctcgaccatctggcggctcgcgaccgtcagcgtgcgcacgtcggtttccggatcgatgtcgatcgacagccgctcgaacagcgcggcagtctgacggcgcagcgccgcgtgatcgatcaggccgaagcggttcttcggttcgcggcggatccagatgttctccgcgaccgtcatgtacggcatcaggttgagttcctggtgaatcatcgcgatgccgcggtcgagcgcatcgagcgggccgttcagcacgaccggctcgccgttgatcaggatctcgccctcatcgggcgtgtagacgcccgcgatgatcttcatcagcgtcgacttgcccgcgccgttctcgcccatcaacgcatggacggtgccgcgacgcacgcggaactgcacgccgtcgagcgcgacgacgcccggaaaggacttgccgacaccgcgcacctcgagcacgcagtcggccgcggaagaagccggcggggccgacgagccggacaaacccgacacaccggccgacgcatcgtcgccggccatcgggcgcgcgatcctggctgtaaacatggacgttcctcgacgagtcgcgcgcgtccccggtcatgccgggcacgcgcagttcaacggatcaccggtcagtgcttcgcgtactggctcatgttctcgggcgtcacgagctcgaacggcacgttcacgtagcggtcgacgggctgtttcttcgcgagcttgagcgcggccgcgacggcctgctgcccctgcccggacgcgttctggtacaccgacaccttcagctcgccgctcttcatcgaggcgagcccgtcgggcgtcgcgtcgatgccggcgacgatcgtcttcggcgtccacttgcgcgcggccttcagcgcattgatcgcgccgatcgccatctcgtcgttgttggagatgatcgcgtcgtacttcgtgccggagctcagccagttcatcgtgatgtcctggccctgcgtgcggctccacttgccctcgcgcttgtcgacgatcttcatgcccgagcaatccttcgtcgcgatcacgtcctcgatgtctttcgtgcgagcgcgcgccgattcgttggacagctcgcccatcagcacgaggaggtcgcccttgccgccgagcagcttgcacacctggcgcgcctgcagcgtgcccgactgcttctcgtcggacgcgacgaccgcgacgccggccggcagcttgtcgaaatcgaccggcttgcggttcacgtagacgagcgggatcttcgcggccgtcaccatcttcgtgatcttcggcgtcgcgtcggtatcgaccgcgttcacgatgatcgcgtcgaccttctgcgcaatcatgttctggacctggctcaactgcttgccgacgtcgttgccgccgtcctcgatctgcaccgtcgcgccgtccttcttcgccgaatcggcgatgctgttgcgcaggatggtcaggaacgtgtcgtcgaacgacgccatcgtcacgccgatcttctcggcatgcgcgagcggcgcagccaggatcgcggcggccgcgacggccatcagcttggtcttcatgatcaatctgtctcctcatctccggggcggaagacggcgcgttgcgcgccgccgggccgagtccgatcgaatccgatacggactgaagcatccggatgaaactgtagatcacttcctcgaaaatttggaaatttatttctacgtgatttcacctagggaactggatttccaaaagtctagactgcgtccgtagcccgattccttgcggcaggcagtcccgcgtcgtgcaatacacggtgcggacggtcgcgaccggatcggcccctaatccgccggcattgccgaacgccggccgcgagcgtgacacgtgatatgagcctgctgaactttccgagtgaccgccccattgatctcgcctgcctcggccgcgtggccgtggatctctatgcgcagcagtacggcagccgcctcgaagacgcgcgcagcttccagatgtatctcggcggctcgtccggcaacgtcgcgttcggcgtggcgcggctcgggctgaagaccgcgatgatctcgcgcgtcggtgacgagcagatgggccgcttcctgcgcgagacgctcgagcgcgaaggctgcgacacgagccagttgcagaccgaccgcgaacgccttaccgcgctggtgctgctcgggctgaaggatcgcgacacgttcccgctgctgttcgtgcgcgagaactgcgcggacatggccgtgcgcgccgacgagatcagcgaggacttcatcgccggctgccgcgcgctcgcgatcaccggcacgcatctgtcgacgccgggcacgcgcgaggcgtcgctgaccgcgctcggttatgcgcgccgccatggcgtcgtgcggattctggacatcgactaccggcccgtgctaggcctgaccgcgcgcggcgcgggcgagaaccgctacgtgccggacgcgcaggtgacgcgtcagctgcagcaggtgctcggcgaattcgacctgctggtcggcaccgaggaggaattcctgatcgcgggcggcgcgccgcacgacctgatcgggtcgttgcaggcggtgcgcgcgatcacgaacgcgacgctggtcgtcaagcgcggcgcgctcggctgctgcgtgatcgaaggcgatattcccgcccgcatcgacgatgcaccgaccttcctcggcgaacgcgtcgaggtgctcaacgtgctcggcgcgggcgacgcgttcctgtcgggcctgctgtcggggctgctgcgcggccgcgactgggccgagtcgacgcgcatcgcgaacgcgtgcggcgcgatcgtcgtatcgcgccacgcgtgctccgcggcgatgccgacgccggccgagcttgcgcactggttcgacggcagccgcaatccggtggtcgatgccgatcacacgctcgcgcacctgcatcgcgtgacggtgccgcgccgcgaatgggacgacctgtgcgtgatggcgttcgaccatcgcagccagttctacgaactcgcggtgcaggccggcgccgacgaagcacggatcaggacgctgaagcgcctgctcgtgcgcgcggtcgagcaggtcgagcgcgagcgccggatcgaaggccatgtcggcgtgctgatcgacggcggcggctacggcagcgacgcgctggcgtcggccaccgggcgcggctggtgggtcggccgcccggtcgagctgccgggctcccggccgctgcgcttcgacgaaacgcgctcggtcggctcgtcgctcacgcactggccgaccgaacaggtcgtgaagtgcctcgttcactatcatccggacgaccaggtcgacctgcgcgtcgaacaggagcagcgcgtgctggaactgtgggaagccacgcgcgccagcggcaacgaactgctgctggaaatgattccgccgcgcgcggtcacgccggccggcaccgaggacgacgcggtgctgcgcacgatcgcgcgcttctacaacctcggcgtgaaacccgaatggtggaagctcacgccgctgagcgccgacggctgggcacggctcgccgcgctgatcgccgagcgcgacccgcactgccgcggcgcggtgatcctcgggctgaaccagccgctgcaatacctcgtcgacagcttccgctcggcgaccaacccgatcgtcaagggcttcatggtcgggcgcacgctgtgggccgatgcgtcgctgaactggttcgccggccggatcgacgaccaggcgctgatcgatgaagtggccggcaacttcgcgcagctcgtggatgcgtggctcggccgccgtgcggcggccgcccgcgccgccgcggcgtgacgtgacgtgacgcgacacgaagcgacgcccgcgatgatccacccgaatcctcttcaccgaccgacatgacctctaccgtaagactgaccgtcagccaggcgctcgtgcgctacctggccgccctgcgcgccgaagtcgtccagcccgacggccgcgtcgagatcctgccctactgcggcggcgtgttcgcgatcttcggccacggcaacgtggccgggctcggcgaggcgctgcacgccgaaaaagaccggctgccgacgttccgcgcgcacaacgagcaagggatggcgaacgcggcgatcgcgttcgcgaaagcgaacttccgccagcggatgatggccgcgacgtcgagcatcggccccggcgcgaccaacatgctgacctccgccgcgctcgcgcacgtcggccgcctgccgctgctgctgctgcccggcgacgtgttcgtgtcgcgcctgcccgacccggtgctgcaacaggtcgaggatttcgaacagggcgacgtcagcgcgaacgactgcttccggccggtgacgcgctacttcgaccggatcacgtcgcccgagcagctgctcgtcgcgctgccgcgtgcgatccaggtgatgaccgaccccgcgcagtgcggccccgtgtgcctcgcgctgccgcaggacgtgcagaccttcgcgtacgactggcccgaggatttcttcgcgccgccggtgatccggatgcgccggccgccggccgacgcgctcgagctcgccgatgcgctcgacgtgctgaaggccgcgaagaagccgctgatcgtcgcgggcggcggcgtgctgtacagccaggcgtgggacgcgctgcgtgcgttcgccgatacgcatggcgtgccggtcgcggaatcgcaggccggcaagggcagcctcgcgtgggaccacccgctgaacctcggctcgatcggcgtgacgggctcgcccgccgcaaaccgcgcggccgcgcaggccgacgtggtgttcgcggtcggcacgcggttgcaggacttcacgaccggctcgcatgcgctctacggcaacgcgacgctgctgagcctgaacgtgcagccgttcgacgcgggcaagaaacgcggccggcaactcgtcgccgacgcacgcacgggcctcggccagctgtcggccgcgctggccggctggcgtgccgatccggcatggacggccagcaaccgcgaccaggccgccgcatggaacgcgcgcgtgaccgaactcacgacgcacgtgccgaacgacacgctgccctacgacgcggaagtgatcggcgcggtgcgcgactccgcggccgacgcggggcgcgacagcgcgcgcgacgacctcgtggtgtgcgcggccggcacgctgccggccgaactgcacaagctgtggcgcagcggcgtgccgggcaactaccacatggactacgcgtactcgtgcatgggctacgaggtcgcgggcggcctcggcgcgaagctcgcgcggcccgagcgcgaagtgatcgtgatcgtcggcgacggctcgtacatgatgctcaacgcggaactcgcgacctccgtgatgctcggccgcaagatcgtcgtcgtgatcctcgacaaccgcggctacggctgcatcgagcggcttcaactcaattgcggcggcgcgagcttcaacaacatgctcgacgattgcgtgcccgaaggcggcgaacgctcgacgatcgatttcgcgatgcatgcgcgcgcgatgggcgccgaagccgtgcacgtgcgcgacattggcgaactgcgtagcgaaatgaagcgcgcccgcgcggcgaagaagagccaggtgctcgtgatcgacaccacgcaccggcgcacgaccgacgacggcggcgcatggtgggaagtcgccgtgccgcaggtgtccgaacgcgccggcgtcgaggacgcgcaccgcgcgtatctcgacgcgaagacccggcagcggcgctgacggcgcacgctgcccacgccctccccgcgaaaaacacattcgaaccaaggaagcccgtcatgagctggaacgtccgcatcggtatcaatcccctgtcgtggatgaacgacgacctgccgtcgctcggcggcgagacgccgctcgaaacggcgctgaaggaaggcgccgaaatcggctatgcgggcttcgagctcggcaacaagttcccgaagacgggccccgagctgaaggcgaaactcgccgggttcgggctcgtgtgcgtgtcgggctggtattcgggcttcctcgcggaagtcgcgccgggcatgagcgacgccgatgcggtcgccgcggagatcgagcgctgccgcgcgcacatgacgaagctgcagtacaacgacgtgaacgtggtcgtgtacggcgaatgcgcgggcacgatccagggcaacatcgacacgccggtcgcgaagcggccgcgcttcgtcgacgaagacgcatggcggcgctacgcggcacgcctcgacgcattcggcgcgcacctgctcgacacgtacggcatcaagctcgcctaccatcaccacatgggcgcatacgtcgaatcgcccgacgacgtcgaccggctgatggcgctgaccgatccggcgaaggtgttcctgctgttcgataccggccacgcgtatttcggcggcgcggccgacccggtgacgctgttgaagaaacacgtatcgcgcgtggtccacgtgcattgcaaggacgtgcggccgcaggtcgtcacgcaggcgcgcaacagcggctggagcttcctgaacggcgtgatcaacggcaccttcacggtgcccggcgacggcgcgctcgactacgaggcgacgctgcgcacgctgaaggaagccggctacgaaggctggctcgtcgtcgaggccgagcaggatccggccgtcgcgccgagctatgcgtatgcgaagaagggctacgaatcgctgcgcgcgatcgtcgaccggttgagcgcgtgagccccgtcacccccgctgtcaccccattgcggagccccaccccatgacgatttctccctgctggtcaaagcatcgcccgagcgcgaaatctgcaacgtcacgccggaatcggccggctggaagcacgtcggctttcgcgcgctgcgcctgaaggccggcgacaccgaaacgctcgacacgggcacgcgggaactgtgcgtcgtcgtgctcacgggcacggtgcgcgcggaagtcgacggcacgacctacgatgcgctcggcaagcgcgacagcgtattcgaggacgtatcgcccgatgcgctctacgtgccgggcggcaagacggtcacgctggtcgcgacgcgcgatgcggaaatcgcgctgtgcaccgcgccgtacgcgagcggcgacaaacccgtgcaacgcctcgacggcgaacggatgcgccgctcggtacgcggccaaggcaccaacacgcgctacgtgtgcgacatcctgatgggcgacaacccggcggccgagcgcctcctcgtcgtcgaggtcgtcacgccggcgagtcattcgagcagctatccgccgcacaagcacgaccgcgacgcagcgcccgacgaaacctcgctcgaggaaacctactaccaccggatcgatccgccgcagggtttcgcgttccagcgcgtgtacacggacgaccgcagcctcgacgaagcgtgcgcggtcgagaaccacgacgtcgtgatggtgccgcgcggctaccatccggtcgtcgcgccgcacggctacaacctgtactacctgaacgtgatggccgggccgagccgcgcgtgggcgttcaagaacgaccccgcgcacgaatggatgctcgacgcggcgccgaagcgctgaatggaagacgggcccgcgcgcggcccgtgacgatgcgatgcccggcacgcgcacccagagccgggaacgccacggagccgccatggtgacgaccctctttcgcctcgatccccacccgttcgacgacgatgcgtcgaacccggcgctgccgcgcttcgatgcggcgcttgcccgccggatgggcgagatcgcggtcaacctcgcgtcgcgccgcgggctgccgatcgcggtgagcatcgtcggcgagcaggcgccgctgttctactgcgcgctcgacggcagccacgcgaacgacagcgacgcgatccgccggcgacagaacacggtgttgcgcttcggcctcagctcactcgcggtcggcgagcgctttcgacgcgccggctggtcgctgcagtcgcaggggctgtcggatgacgactacgcgctcgacggcggcggcgtgccgttgcgcgtcgccggggccggcatcgtcggcgcgatgacgatcgcggggctcgactcggaacacaatcacgcgctcgtcgtcgagagcctgcagtggcacgtcggccgttacgcgctcgcgccgcacgcgtaacgacaagggcggcacgaccggcgcaagcgcgccgaggcaccgccccgcccgatcagttcaacccgccgctcacgacgagatgctcgccggtcatccagcgtgcatcgtccgacgcgaggaacacggccaccgacgcgatgtcgtccggctcgccgaggcggccgagcggcgtctcgctgcgcacctgcttgtcgagatccgaaccgatgatgcccgcgctgtgcgtgccctcggtcacgatcatccccgggttgatcgcgttcacgcgaatcttgcgcgggccgagttcgagcgcgagcacgccggtgatcgcgtcgaccgcgcccttggtgccgctgtagacggcgctggcgggcggcgtgatgctggtcaccaccgagctgatgttgatgatgctcgcgccttcgccgagatgcttgacggcggcctgcgtcgtcagcagcacgccgaacacgttcgtgtcgaactgccggcgatagtgctcttcggtgatcgcctcgatcggcgcgaattcgtacacgccggaattgttgacgagcacgtcgagacggccgtacgtgtcgatcgccgtatcgacgatgcgctgcgcgtcggctgccttcgacacgtcgccgcccaccgcgaccgcgcggccgcccgcttcgacgatcgcgccgacgaccgcgtcggcacccgccttgctgctcgcatagttgacgacgaccgacgcgccttcggcggccagtgccttcgcgattgccgcgccgatgcccttcgatccgcccgtgacgatcgcgaccttgcctgccagcttgctcatgatttcattcctcagtcaaaagaccttcgatggatggcgccggttgccgcgcagtgtgtcgatgcggcgaccggcatgcatggcaatgtacggtgcggcaccgcagcgataaagcggctcgacacgaattgactggcggcgttttccgaacaatcgctcgcgcgccgtcagccggcgctgagccaggcgttcgcgacctcgccgcccaggccgtcgagcgcgccgtcgtagacgatccgtccgcgccccatcaccgcgacgcgccgcgcgagccgcggcgcgaactgcagccgctgctcgatcagcaggatcgcgacgccgtcggcctgcagcgcggccaggcacgcgccgacttcgtcgaccgcgagcggcgcgaggccttcggccggttcgtcgacgatcagcacgcgcgggcggccggccagcgcacgcaccagcgcgagcacctgctgttcgccgcccgacagccgcccggctttcacgtccgcgcgcgcggacagcagcggaaagcggtcgaacagccgttcgagcgccgcgcgttcggccgcaccgcgggcgccgcgcagcccgagccgcaggttgtcgcgcaccgtcagcagcgggaacacgtcgcggctttctgcaacgtaagcgacaccgcgccgcgcgatctcgaacgtgcgcgcgcccacgcattcggcgccgtcgatgcgcaccgagccggccgtgcgcacgagccccatcacggccttcgcgagcgtcgagcgccccgagccgttgcggccgagcagcgcgagcgtctcgcccggggcaagcgcaagatcgacgccgtcgagcacgggttgcaggccgtaccccgcgcgcaggccgcggatgtcgagcaacgcgctcacaggccgccctcgcccaggtaggcggcccgcacggccggatcggcgcggatcgcatcgggtgcgccggtcgcgaccaccgtgccgcgcacgagcaccgtgatgcgctcggcgaatccgaacaccgtgtccatgtcgtgctcgatcagcaggaccgttcgcccctgcgtcgtcgcacggatcagcgcgatcatccgcgccgcctgcgcgcggctcatgccggccgtcggctcgtcgagcagcagagtgcgcgccccgctcgcgagcgcgatcccgagatcgagcgcgcgctgttccgcatagcccagctcggcggccggcgtgtcgcggtgcgcgtcgaggccgatgtcgtgcagcacgcgcccggccgcgagatcgaccgacgccgattcgcgcagccggttccaccagcgccgccgttcggcgggcgcatgcagtgccgcacaacgcaggttgtcgaacacggacagccgcgcgaatgcgctcgtctgctggaaactgcggccgatgccgagccggctcgcgacgaccggcccgcgcccgcgcagctccacgccatgcagcaccacgcgcccgcgcgtgggccgcgtcgcaccggcgatcacgccgaacagcgtcgacttgcccgcgccgttcggcccgatcagcgcatgacgctcgccggccgcgatgctcagctcgacgccgtcgagcaccgtctgcgcgccgaagcgctgcacgacgccgtgcagcgcaatcgcgttgccgttcatcgtacgtcctcccgcttgccggcctgcccgcccggcgcgaagcgcgcgcgccagccccacagcagcgtgccgatgccggccgccgaacacgcgacggcccagccggccggcgtatcggcgtcgacgcgccaggcgccgaacgcgaagcctgcgccgtcgtcctgcgcgaagcgccacgcataaccgagctccgccgcgcagacgatcgcgacgccccagaacacgcacgcggcgaccgcgcacagcatgcgccaccgctcggccgccggcgcgccgcgccgcgatgcttgcgcgagcgcctgcacgatcccggcgatcccgcgcggcgcggccacgacgatcgcgacgaacagcacgccgagatacagcgcccacgcgcgcgacacgcccgcgacgacgatgctcagcagggtcagcacggcggcaccggccgccggcccgaagaacgtaccggtgccgccgatcaccgcggcgatcagcacggtcgccgaacgcgccatcgacacgctgtcgggcgtcgcgatttcgacgtcgatcagcgtcagcgtgcccgcgacacccgcgaagaacgacgcgcaggtgaccatcgcgagccgcgcgcggcgcggatcggtgccgagcgcggcgacgcgcgcgggattgtcgcgcaccgcgttcgcgagccgcgcgagcggcatgcgcgtcagcgcgtgcatggcccacgccgacgcgatgcaccacgcggcgatgaccgcatacgcctgcaccggtgcgccgaaatgccagccgccccacggcgtgccgctcgcgcggtcgatcggcacgccgccgattccgccgaaccacgcgggcacgctccaggcggcggccgcgacgcattcgccgagcccgagcgtgatcatcgcgaacgcggtgcccgaacggcgtgtcgcgagcagcccggccgcgaagccgaaaccggcaccggccatgccgccgacgagcggcaacagcggcagcgggccgccgaagtggttgaaccagtgcgcggccgcgaacgcgccgaggcccgcgaacgccgcgtggccgaacgacagcagcccggtcgtgccgagctgcaggttgtacgacagcgcgagcacgacgagcgcggccgtctgcgcgagataaccgagcaccgcgccatgcggccacagccacgcgggcagcgcgacgcacgcggcgaacagcgccccgcgcgccaggccggcggcgagcgtgcggctacgcatcggcgcgctcgccgaacagcccgcgcggccgcgcgaccagcaccgcgacgagcagcaggtacggcaccagcggcgcgagctgcgcgatcgataccgtggccacgctgtcgggcagcgcgatgccggcccatgacgcgaggtcgcgcagcgacgtatcgctcgcggccgcgaaggtctgcgcgcaaccgacggcgagcgacgccgcgaacgcgccgccgagcgaaccgagcccgccgatcacgacgaccgcgaacacgaccgaaccgacggtttcggccagcgcgggttcgatcaccgcgagcggcgcgccgatcacgccggccagcgcggccagcgcggtacccgcgccgaacagcgccgtcatcacgcgcggcacgtcgtagccgagcgcctcgacggccgcccgatgcgtgagtgccgcgcgcaccacgagcccggtgcgcgacgtgcgcaacaacgcgccgagcgcgacgagcatcgccgcggacattcccatcatgaacagccggtagcgcggcagcgcgaggccgaagacggtcgcgggcgcgccgtcgaacagcgccggcacggggccggcagcggcgccaggccccacacgagtttcgcgccctcgccgatcaggtacgcgagcccgaaggtcagcagcagttcgctcgtatggccgcgcgcctggacccggcgcagcagcgtgcgttcgcagccggcgccgagcagcccgaccgcgagcggcgcgaggaccagcgcgggccagaagcccgcgcgggccgcgatgctgtagccgacatatgcgccgagcatgtagaagctcgcgtgtgcgaagttgagcacgccctgcacgctgaagatcagcgtgagaccggctgacagcatgaacagcagcaagccgtagctgaggccgttgaaggcctggagcgcgaatgcgtgcaccgcgaagtcaggccgcgagcggctcgagcgcggcgcgcagcgcgtcgggcagcggcaccgggcggcgcgtgccgcgatcgacgtacacgtgcacgaaatgcccctgtgcggcgggcgacgcgtcgccctgcgcgaacagcccgacctcgtagcgcacgctcgacgtgccgagcttcacgacccgcaagcccgcgtcgaccgactgcggaaacaccagcggcgcgaagtagttgcactgcgtctcgaccacgaggccgatcgtctgcccgtgctcgacgtcaagcacgccggcgcggatcaggtattcgttcacgaccgtgtcgaagtagctgtagtagacgacgttgttcacgtgcccgtagacgtcgttgtccatccagcgggtcgtgatcggcaggaagtggcgataggcgtcgcgcggacgcggttgcggcttgtcggacatggcgatggcggtcaggacgaggaaagcgctgaggacgaagcgcggcggccgcgtgacacggcgcgccggcaagaagccgggcgccgcgatcgctcgcggcacggcggcggcaacccgactggccggcccgtcactggcccggccggtcgacgaattcgaaatcgaggccgcgcgcacgcatccagtcggcgagcgcgacacccgtgccggcgcgccacggcgcagcagcggcggatcgacgagcttgtattcgagcagttccggcgacagcgcgaccgtgcccgacgcgcgcacgtggtacgcgatgatcagttcgttcttgcggatgaattcgtagacgccgacgagcgacacgtgctcggccttcagggccgtttcctcgaacacctcgcgcgcgatgccgtcctcgggcgtctcgccgttctcaaggaagccggtgatcagcgcgaacatgccttcgggccaggccgcgttgcgcgcgagcaggatcttgccgtcgagctcgacgatcgcggccaccaccggcagcgggttgttccagtgcacgtagccgcatgcgtcgtcggggcaggcctggcggacgcggccgccttcatggtcgggatcggcgcgctcggtgagcgggctcgcgcagcgcgggcagaagcggtagtcggcggtggtcatcgatggggatctggcgggcgcgggaaaggcctcattctagcgagtttgccggccgcaagccgtcgcccgtgaaagcggacgacagtggccgccctcgcgcgacgcgtgccgaatcccgaccgttgccgctccccgcgcgcggcactccacgaaaagggggcttcacggctcggcgtgaagcccctttgcgcggcacgaccgcgaccaaggccacccggcgacggcatacgtgccgccatcgccggccatcccgtcaggcacgcacgccgggcgggtgtcggatcgaagccgcaatggctcgacgttcccggaaagcgtgtatcaccaccacgaacaccgcctcccggaatgcggcgatcagttccggatgtcgccgaaatcgaggcccgcgaccggcaccgccgccgcgcttccgctcacgctgctgccgcgcacggagccgatgttgaggccgaccagcccgccgtagaactggtcgtaaccggccgtgtacgcaacacggctcctcgagctcgagttctcgaccgtaccgaagtttccacccgccacgccacccagccgcgcattacgcccgccggacaccttgcctgacgacgacgacgacgcgatcctgcctgcgttgttgccgacgagaccgccgacccaactgtaatcaccgccctttgccgaacccgacgagtccgacgcattgatcgatgcgccagcggagttgatgccgaccagtccgccgacgttgccatcggttccggcaacgacgtcacccgatgcgctcgacgacgatacgctgccgtcattgcgtccgaccagaccgcccgcatcgccagctccgtcgacggtcacggccccgctcgcgctggcgctcgccaccgtgccggcgttcttgccgacgagcccgccggcgctgctgttcgcaccggccgatacgtcgcccgccgcggaggacgcggtaagggtgccgccgtttccgttctcgccgaccagaccgccagccttcgcgttgtcgcccacggtcacgctgcccctcgcgtcggacgcttcgatcgatgcggcgttgtagccgacgaggccgcccgccgtcgcgtagcggcccgccttcacggtcgcactcgacgaagaggccttgatccgtccggccttgtccccgccttcgttgaagccgacgagaccgccgacacgcccgccgctgcccggcgcgttgacgctgcccgcagccgacgagcccgcgatgatgccccggttgaccccgaccaggccgcccgtgccgcccgccgagcggctgctcacctgaacgtcgacgcggctgttcgcgatggtcgcgtcgccgaggtcggggtacaggaccgtgcggttttcgccgaccaggccgccaaccgccaacgcattcttgtcgccttcgacccggcccgacacgaacgcgcgatcgatcgaaccgctcagattgctgccgaccaggccgccgacatacgtcaggccttcgccgctcacgaacacgtccttcgccttcacgttcgagatcttgcccgcgttgacgcctgccaatgcgccgacgctgacgggagcgcgattgctgaccaaacgcttgcgccctgacgttctccagcgtgaggttggagatccggccaacgttgctcgcgaacagcccgacgaaggctgcgccgggattcacgaccgacaggttgccgatggtattgcccaggccgtcgaacacgccgccgaatgcgttgctgttgccgccgaggctgcggaactgcgcgccgttgccgttgatcgcattgcccagcacgtaacggccgttcaggttgccgtcgacgtcgcgcaaccccgcgaggtcatgaatcacgcgatacgcttcccgtttgccgagaacgatgcattgcgccccgacagcgtgaccaccgcaccgtcgttcgccagcgtatgcccgctgcccgaattcagctcgaggtgcgcgttttcgcccgtcagcgccaacgtgttgccgatacggacgcgcttcgccgcattcaccgccacgcccgcgttcgcgccgctcgccgtcagcgactgcttcaggtcgacgttgccctttgcgacgtcagcgtcagcgcgttgtcgcccgcccaggtcaccgcgtcattcaccgtcagatcgcccgacgtattggtcaacgcgacgttcgtcgtacccaggttgcgcgacagcgtctcccgtcgatcgcgttggctccggagccgaccctgcgttggccgcctcgatcgtccaccggcccgtgcggcccgacgccgcgcgcgtatccacctgcgcgtcgcgcgccaccgtcacccgctcgccacgcgtcgtcaccgtgccgcctgccgtcgatgcgtcctgcgcactcgcgtcgagcttcccgccgacatgaacctggccgccgtccagcgtgatcttcccgtcgcggctgctcaggcccttcgcctcgatcgcgccgctgttcttcaccaccgaacccagcagatcgcccgccgcgcgcgccgtcatcagcacttcaccgccgtccgcctgcagcagcccgccgttgtgcgcctgcgcgtccaccgccccgccttccacctgcaggctcagcagcccctggccgtcgaagttcacgttgaacgcattgcccgcgcccagcgccacgcgccccatctgcgcgcggatcacgcccgtgttcgacacccgcgcgcccagcagcgccacgctgccgccgtccgccgccgtgatcgtccccgcgttctgcaccgactggctcgacgtccccgcgaaccggtagcgccccgccaggaaatccgcgtccgacaggttctgcgtcgacgccaccagaccgcccacgttcacctgggcacccgcaccgaacatcaccccgttcgggttcaccaggaacacccggccgttcgcgtcgagctgacccaggatctgactgccgttcgacccgagcacccggttcagcgccatcgactggctccccggctgcttgaacgacacccgctcgccgctgcccacgctgaagtcctgccagttcgtgatcagcttgtccgtgtgctggtggatcgacatcgttttgccgtccaccgacgtgtcgatgttcgcctttcccgactcgatcacgccgcccgtcggcagcgcgtacgcgcccgacgccgcgagacccagcagcgacacgcccgccgcgagcaggcgcttgccgccgctcgacttgccacgacggcgcgccgtttccccgaccgcgcaccagcctccctgcgcttcattccataccaacgagtaggctttattcattttgggatcctcttcaatttactcaagaaagaccgtcttgccagacggactgcgatcacgctcgctcagaaatactgagcggcctgaacccatacgctcggcgcgcgggtcggcgagtcgcctccctgccgagcggcaatgcggcagtcagcgacacctgccgggtcgagccgtaccagctcgcgccgaagcccaccgactgcatgtgctgcgtattccgttcgcgcgtccatggatgccggttgagctgcacgccgcccgcgtcgacgaacgtgctgacctgccatccgggcgcggcgagataacgcagttccgcgcttgcctgccaaccctgatcgccgctgccttcgccgagcgcatacgagcgcacgccgtatggtccgccgaggctgaatttctccgacgaatcgagattgcgcgacgcaagctgggcgctgacctgcgcgtacacctggaaccggctgcccacggcctgaatgcgctgcaggttcaggttcagcttcgtgaaactgccgatcgcgttcgtcaactcgttcgctccgagcgcatcgttgctgcgcaagcgcccgacgccgaacatcaccgagaagccgttgcgaccgccgcccagccagccgtcctggctgttcccgctgagcgcgacagtccacaggccgacgctcttgtcgttgcgcaacgaaaagacgccgtattcgtcatgcaggttcttgttctcgtactgaatctgggccgtaaggcccgcgttgcgtgcgcgcacgatcggctgcgcgacgtacacggtctgcacgctcgcgcgcccgctcgcgtcgagatcggaaaagccgccggcgagccggtagcgcagcgacgaataccccaccccgacccgcgtcgacgccggtccgaccggcacctgataggcggcgcggtaatagcgttgccgttcattgctgacgagcccgcgcaggctcaggcgatcgccgagccgcagcggcgcattgacgtcgacgctgccgccgacgcggtaacgccccgtcgacggatcgccgaagttgtcgaattcgagcgccccggaagcaggcgacgcgcgcccggcctcgacgacgagatcggtggtgcctggcgcgtcgccgggacgcaacgtgccgcgcgcgccgacgcccgccagatcgtcgagcagcagcaggctgcgctcgagactggcgccacggacgacgtcgcccgcgcgcagtgccgcgagcggctggcgcagcacggcgtcgaatacgcgggaatggttctggatctcgatgcggccgtagcggccttcgacgacttcgatgcgcacgacgccgtcgtcgatctcctgcttcggcagataggctcgcgcgagcacgtagccgcgcgcgcgatagaaggcggagatccgctcggccgcgcgctgaagatcggcgaagcccagcgcatctccggccagatcggcgacgagcgcctgcagcgttgcgctgtcgaataccgtattgccgccgatctcgaacctgcgcacccaaacacgtgccccggtttcggcaggcgcctgcgcggcgctgccggacggcacgatctcaaggtcgggtgcggcttccgccggcaggttcggccgggacgtctcgatgtcgcgcatcgccgagccggcgttcggcgcctgcgcatacgcgtggccgaacaggctcgcggcacccgctccgcacagcagcgacaggcacatcgcgcggccgacgccggcggtcgctcgccgcatgccgcgagcgccgatcaccccggcatactcatcggcagcgcgaaggcccgccgccggaaaacggtcgatgtcgtcacgacaacggacgacgattctgattggttctacccacatgcgtcacggcaccctgaatcgagttgccggatactcgccggcaatcaaataattcggggcatgctaccgatcgatagttcgcgtgtatgtagggcacgtacgaaattagcgcggcatttttcgttcaattagagacgtgtatcagccttcgcgagctgaaacatcgcaatcctattcatttatcccgagcgatgccggcgtgcgacggcgatcgtcgcaaagcccgcggctccggccagcagcaccgcggccgcgagccagagcaccggcgtgaacgacgcgtaccgcgcaaccagcggcgccgcgacgagcggccccaggatctgcccgaccccgtacgacgcggtcgcataacccatcagcccggccgcgcgttctccgtggagccgccgcgcctcgcgcatcgcgaacagcgtgatcgcggtgaacggcaggccgagcagcgcgctgccgaccgagaagccggccgcgttcggccacacgatccccgccgcgattccgagcgcctgagtcgcgcagccagcggcgagcagcagccggttgtcccagtggccgggcaatcgcgaagcggcgatcgcgccgacgatcagcgccgcgccgaacatcggccagaacaggtcgggccacggcgagccggccggcagcgcggcgcgcgcgatcaccggcaggaacgtcgcggtgatgatgtagccgaagcccggcatcccgtacagcacgacgagccacgcagcgtcgacccgatggcgccgcgcgtcgtccggtgccgcgaccgtcgccgcatgccgggcaggctcggccgtcggcacggctgccgacaccggcgcactgccgaacgtgcgccagatcgcgatcgacagcacggccgacagcgccgcgaaaccgagccagccgggcgccgcgcgctggccggccagcgcgctgccgatcagccccgtcaccacgatgcccacgccgggccccgcgtagatcacccgctccactcgggcgcgtgcagttcggccagccgccgcagcccccattgcgacacgaacacgaacgtccaggcgctgacgacgcccgcgacgaagcgcaccacgagccacaccggcaacaggtggccgacgcccatcgcggcggtcagcagcacggtggcggcaagcccgatgcgcaccatccgtgcgggcgcggcgcgcaccgccgcgcagctgaccgcaccgacgaaatagcccgcgtagttcgccgacgcgagccaactgccggccttcagactgatcgagccgtcggcgagcatcagcggcagcagcggcgtgaacgcgaagcggccgacgccgagcgcgaccgcgagcccgatcatgcaggcgagcgcggccgcgcgggcgcggcggtcggcgtcggcatcatcgggcagctgtacgccggcggcggcgctcggggcatcggaacgggacatggcggcatgggccgcgcgcgaaacgcgccggccggatcggaaatcggaacgtttccatcgtagcttgaccaaacgttctcgaaaaatgaataattgagaatccattcatcgctcggagagaatcatggatctggcggcgctggcgatattccgggccgtggtgcgcgagaacggcgtgacgcgcgcggcggccaagctcaatcgcgtgcagtcgaacgtcacgacgcgcatcaagcagctcgaggaggaactcggcgcggcgctgttcgtgcgcgacggccgccggctcgtgctgacgccggccgggcacacgctgctgccgtatgcggagcgcctgctcgcgctcgccgacgaggcgcgcgacgcggtgcgcgaggacacgccgcgcgggcggctgcggctcggcacgatggagagcacggccgcgagccggctgccgaccgtgctcgcgcgctatcaccacgcgtggcccgacgtgtcgctcgaactggtgacgggcacgacgggctggctgatcgagcgcgtgcgcgacttcgagatcgacgccgcgctgttcgcgcgcccgccggcacccgacacgctgcccgacacattcgagaccgtgccggtcttccgcgaggatctggtgctgctcacgccgcgcggccatccgccggtgcgcacgccgcgcgacgtgatcctgccgacgctgatcgcattcgagcgcggctgcacgtatcgcaagtacgtcgaacagtggtacgcggcgcacggcgtcaagccggcgcgcgtgctcgaactcggctcgtatcacgcgatcgtcgcgtgtgtcgcggcaggtgccggcgtcgcggtcgcgccgcgttcggtgctcgacctgcagcccgagaccggcaacatcgccgcgcacgtgatccccgagctggagggcatcgacacgctgcttgcgtggcggcagggttatgcgtcggcggcgttggccgcgttgcgcgatgcgctcaccgaagccgcacggcagccggatggcgcggcgaagccgccggtggccgtgccggtctgaaccgccggcccccgcttccgccgcgcacaaacaaacggcccgaccggtatcaaccggtcgggccgtttttcatgtcgagcgacgccgccttcaacaagacggcatcgcatcggtcgtggcgatcagagccgctcttcgacccagcccttcacgccagccagcgcgccgggcaggttcgccggctcggtgccgcccgcctgcgccatgtccgggcggccgccgcccttgccgccgacctgctgcgcgacgaagttcacgagctcgccggccttgaccttcttgctcgcatccggcgtgacgccggcgatcaggctgaccttgccgccttcgacggccgccagcacgatcgccgcgctcttcagcttgtccttcagcttgtcgaccgtttcgcgcagcgtcttcgcgtccgcgccgtcgagcgtcgcggccagcacgtacacgccgccgatttcgacggcctgctgcgcgagctcgtcgccctggctcgacgcgagcttcgacttcagcgcgcccagttccttctcgagcgacttcacctggtcctgcacctgcgcgatacgctgcgtgagttccgacggctgcgccttcagcgccgctgccgcttcgttcacacgcgcgtcgagctcctgcacgtagcgcagcgcgttgtcgccggtgatcgcctcgacgcggcggatgccggccgcgacaccgccttcgacgacgatcttgaagaagccgatgtcgccgctgcggctcacgtgcgtgccgccgcacagttcgcgcgagaagccgaggtcgagcacgcgcacttcatcgccgtacttcgccgaacagcgccatcgcgccgcccttcaccgcttcgtcgtacggcatcacgcgcacgatgcccggcgcgttggccaggatttcgttgttgacgatctgctcgacgcgacggatttcgtcgtcggtcatcggtgcgttgtgcgcgaagtcgaaacgggtcttttccgcgtcgaccagcgaacccttctgctgcacgtgcgcgccgagcacttcgcgcagcgccttgtgcatcaggtgggtggccgagtggttgcgctgcgtgcgtgcacgacggtgcgcgtcgatctccgcgcgcagcacgtcgccgaccttcagcgtgccttgttccagcgtgccgtgatggccgatcacgtcggcctgcaccttcagcgtgtcagccaccgcgaagcgcgtcgcggcgttcgcgagcacgccctggtcgccgacctggccgcccgattccgcatagaacggcgtgtggtcgagcacgatgaccgcgtcctggccggtcttcacttcgttgaccgacgaaccgtcgacgtacagcgcgacgaccttcgcgtcgtcgaacgcgatttcctcgtaaccgtggaacgtggtcttcgcgcccgtgtattcgaggccctgcgtcgccttgaacttgccggccgcgcgcgcctgctcgcgctggcgcgccatcgcgtcgtcgaatgccggctcgtcgaccgtcatcccgcgctcgcggcacacgtcggccgtgaggtcgagcgggaagccgtaggtgtcgtgcagcttgaacgcgagctcgccgtcgagcaccttgccgcccttcgcctcgacgtcggccagcgcggcctcgaggatcgacatgccgtgctcgatcgtctcgaagaagcgctcttcttcctggcgcagcacgtcggtcacgcgctgctcggcttccttcagctccggatatgcaacgcccatctcggcgacgaggtcggccaccagcttgtggaagaacgcgcccttgcggccgagcttgtagccgtggcggatcgcgcggcgcacgatccggcgcagcacgtagccgcggccttcgttgccgggaatcacgccgtcgacgatcaggaacgagcatgcgcggatgtgatcggcgatcaccttcagcgagttgttcgtgaggtcgctgatctcggtcacgcgcgcggcggccttgatcaggttctggaacaggtcgatctcgtagttgctgtgcacgtgctgcagcaccgcggcgagacgctcgaggcccatgccggtatcgaccgactgcttcggcaggcgcgtcatgttgccctgcgcgtcgcggttgaactgcatgaacacgaggttccagatctcgatgtagcggtcgccgtcttcttcaggcgaccccggcgggccaccccacacgtccgggccgtggtcgtagaagatttcggtacacgggccgcacgggccggtgtcgcccatcgtccagaagttgtccgacgcgtagcgcgcgcccttgttgtcgccgatgcgaatgatgcgctcggtcggcacgccgacttccttcgcccagatgtcgtaggcttcgtcgtcttcctggtacacggtgacccacagcttgtccttcggcagctggtagaccgtggtcagcagttcccacgcgaacttgatcgcgtcgtgcttgaagtagtcgccgaacgagaagttgccgagcatctcgaagaacgtgtggtggcgcgccgtgtagccgacgttctcgaggtcgttgtgcttgccgcccgcgcgcacgctgcgctgcgccgtcgtggcgcgcgagtacggacgcgggtccgtgccgaggaacacgtccttgaactggaccatgcccgagttcgtgaacatcagcgtggggtcgttaccgggcacgaggctcgacgagcggacgatcgtgtggcccttcgattcgaagaatttgagaaatttctcgcggatttcggcagctttcatggcgtgcggggacagtctggcaaagacggcttcaaacgccggcgcccttggcggcgcgcggcggcatggattcggaaacggtcgattatacgggatcggggccggcttccgggcaaagcgccggcaaagcggctcggccatccggacggcccggctgggccacccggacggccgattcgccttaagatgctcggcatgccaattcgccttgcccgccaaggccagccatgaaaggagacgattcgacgatgggtgccctgagccatatccgcgtgctggacctcacccgcgtgctcgcgggcccgtggtgcgcgcagacgcttgccgatttcggcgcggacgtgatcaaggtcgagcgcccgggcgccggcgacgacacgcgccactgggggccgccgtacctgaaggacgcggacggcgcggataccgccgaggccgcgtactacctggcggcgaaccgcaacaagcgctcggtgacggtcgacatcgccacgcccgagggccagcagatcgtgcgcgaactcgccgcgcaaagcgacgtcgtgctcgagaactacaaggtcggccagttgaagaaatacgggctcgattacgaatcgctgcgcgcggtgaagcccgacctcgtctactgctcggtcaccggcttcggccagacgggcccgtacgcgcatcgtgccggctacgacttcatcgtccaggggatcggcggcttcatgagcatcaccggcgagcgcgacggcgagccgggcggcggcccgcagaaggccggcgtcgcgatcgccgacctcgcgaccggcctctactcgacgatcgcggtgctcgccgccctcacccaccgcgaccggacgggcgaaggccagtacatcgacatggcgctgctcgacgtgcaggtcgcgctgctcgcgaacatgaacaccaacttcctcgcgagcggcaagccgccggtgcgctggggcaacgcgcatccgaacatcgtcccgtaccagacgttccagacgagcgacgggtggatcatcgtcgcggtcggcaacgacgggcagttccgcaagttcgtcgaggcgggcggccggcccgagctggccgacgacgagcgcttcgcgacgaatccgtcgcgcgtgcgccaccgcgacacgctggtgccgatcctcgcggacatggtgaaggcgcgcggcaaggccgactggatcgacgcgctcgaagcggccggcgtgccgtgcgggccgatcaacgatctcgacgaggtgttcgacaacgagcaggtcgtcgcgcgcggcatgcaggtgtcgctgccgcatccgagcggcgcggacgcgaagctcgtgcgcaacccgatccggatgagcgtgacgccgcccgacgcgcgtaccgccccgccgctgctcggcgcacagaccgacgacgtgctgcgcgacatgctcggctacgacgacgcgaagatcgcccggctgcgcgctaaacaggcgatctgagaggcgatccgagaggcgatccgggcacggcgcccggcgcgggcgccggcgggcaggcggcggccgcagccgccccgcctcgcgccgtcagccgcggcgggcgagcgcgtcgagccagccgcgcgcctcgggccagtcgccgagcccgctgtccgcattgatgtggccgcgcgggccgatatcgtggaaagcgctgtcccatgcgttcgcgcaactgcgcgcgaacgcgggcgagccgtacggatcgtcgctgctggcgacgacgcaggtcggaaacggcagccgttcgagcggcacgggcccgaagccgtgcgcatcggccggaaacgcggggccgcccgggtcgggcagcgcgacgagcagcgcgccgcgcaccttcgcgagcgcggccgggcgcgcatagcgggtcgcccaccacgcggtggtaagcgtgccgagactgtggccggcgatcagcgccggcccgggcgcggcttcgatcgcgcgatcgagcgcgagacaccagccgttgcggaacgcacggtcccagtcgggcatcgcgacgcgcgagaaacgtgcatcggcacgctcccagcggctctgccagtgaagcgggcccgaattggcgtaacccggcaggatgagaacgggaaatgagctcatggaaggtgcgtcgacgggtgaaatcgttatatggcgtcgacgcagtgtcgcacacccgttcctccctgatgctgcctgtctgaaaccggaaggatgtgcaaggggccgggacgcgtgcgggacggcgtcgcgaccggacgacgagccgcgttgcacgcggctcgcgtcatgtcatcgatcagcgcacgttcgcgccgacgataccgcccgccgcggcgccggcgaccgtgccgagcgggccgcccgtcaccaggtaaccgagcgcgccgcccgcggccgcgccgatgccggcattgcgctgcgtatgcgtcatggcgcacgcgccgagttgcgacagggccgcgacgatcacggcggtacgaacgataaacgtggtcttcttcatcatgattgttggtgtcctctcgccgcgcggttatgcgaacggcggtatcgaatcggtgaagccatcataggcaacgccaaacggcccgggcaatccgatttacgtcgtgttacagccgacacaatatcgagataatccgtcgaaacccgtgcctgccgcgccgccagccgcgcgggacggaccccggtcaggtagaatcacgggattaaaccggcgcgacgcgccgacacaacctgacgccatccgcatgagcaccgaacgcaacgacgcccccgcggcttccaatttcatccgcaacatcatcgacgacgacaaccgcaccggcaaatggggcggccgcgtcgaaacacgcttcccgcccgagccgaacggctacctgcacatcggccatgccaagagcatctgcctgaacttcagcgtcgcacgcgactacggcggcgtgtgccacctgcgcttcgacgatacgaacccggaaaaggaaagcgtcgagtacgtcgactcgatcgtcgacgcggtgcgctggctcggcttcgactggcgcaaggacgcggtcgatcaccagtacttcgcgagcgactactacgacaagctgtacgaattcgccgagctgctgatccagcgcggcaaggcgtacgtcgacagccagagcgcggaagaaatgcgcgcgaaccgcggctcgctgaccgaaggcggcaagccgtcgccgttccgcgaccgcacgccggaagaaaacctcgacctgttccgccgcatgaaggccggcgagttcaaggaaggcgagcacgtgctgcgcgcgaagatcgacatggcttcgccgaacatgaacatgcgcgacccggtgatctaccggatccgctacgcgcaccactaccgcaccggcgacgcatggtgcgtgtacccgatgtacgactacacgcactgcatctcggatgcgctcgaaggcatcacgcattcgctgtgcacgctcgaattcgaggatcaccgcccgctgtacgactgggtgctgaacgaactcgcggaagccggcatgttcacgcgcccgctgccgcaacagatcgaattctcgcggctgaacctcacgtacgcgatcaccagcaagcgcaagctgttgcagctcgtcaccgaaggccacgtcgacggctgggacgacccgcggatgccgacgatcgtcggcgtgcgccgccgcggcttcacgccggagagcatccacctgttctgcgagcggatcggcgtgacgaagatcgattcgtggatcgacatgagcatcttcgaaggcgcgctgcgcgacgacctcgacgacaaggcagcgcgcacggtcgccgtgctcgatccgctgaagctcgtgatcgacaactacccggaagacctcgaggaagcgtgcacggcgcccgtgcatccgcaccatccggatcgcggcgtgcgcacgttcccgatctcgcgcgagctgtggatcgagcgcgaggatttcgtcgagaacccgccgaagggctatttccgcctgttcccgggcaacaaggtgcgcctgcgctacggctacgtgatcgagtgcacgggcttcgacaaggacgccgacggcaacgtgacggccgtgcactgcaactacttcccggacagcaagtcgggcaccgaaggcgcgaacaactacaaggtcaagggcaacatccactgggtcagcgcgaagcatgcgcagccggccgaagtgcggatctacgaccgcctgttcaaggagccgcatccggacgcgggcggcgcgaacttcctcgaggcgctgaatccggattcgaagaagatcgtccaggcatacgtcgagccgggcaacagcgacatcgcgccggaaacgcgcgtgcagttcgagcgtcacggctacttcgtggccgatcgtgtcgattcgaagccgggcaagcccgtgttcaaccggatcgtcgggctgcgcgacagctggggcaagccggcctgacggatcggacaggcgcggcgccggtcgcccgcgcctgagccgttcgtcatgcgcggacaacggctgcgccgatgcgcagcccgaccggccgctcgccggggcagcctgccccgaatgccacgcgaggaaccgtcgtcatgccctattcgctgcaggccatcgtcgccagatccggcgcatttgcgtccgcgccgctgccgcgcgggctgcgcgtcgtccgcctgcgcggcgacatcgacatgatcccgctcgacaccgcgttccggaacgctcacgacatcccgttctgcccgttgaccgacggggacgacacggtgctgccgccggcacttctgtcgctgtgtgaacagttgagtgctcaggctgcactggcctatgtcgaagccgaattcttcggcggcagcggcacccaggcgcatgcgcgcttcgcggatggccgcgcgagcggcccgctcgtcgtgtcggaccatgcgatcaacgaagcgcttcgcgatctcggcgtcgccaggggcgacgcgttcgacgaattcgaagcgatcggcctcgaccagcatcgcgacaccgatcgatggctgacctgactcgccggcggcgaatcgggcgaaccatgaaaaaccggcttgcgccggtttttattgcctgccggggttacgcgcccgtcaaccgccgatgcagatccaccagcgacagcttcgtgcgaaacagccgcgcgaggctgcggctcgcatacgcgtcgatgtcggccggcacggtccagcgatacgcatccatctcgggaatcatcgagccgtcgcggcggctcggaaacagcgacgtgcacgtgcactgcgcgggatcgatctcgccttcggccacctgcaccgcgaacaggtgcagatccttgtcgtgccggtacgcaaagcggccgagatcgagcaaccgggccggcgccagcgcgatgccggtttcctcgagcagttcgcgcagcgcggcgtcggccggcgattcgcccggctcgccctgccccttcgggatgtcccagtgcgtggtgtccgtcgcgtgcgcgaggaacacgcggccggccgcatcgaggatcacgacgccgcacgacaccgtgcgcggcgcgtcgccccgcttcatcacgcgcgtgctcagcgcttctgcaactgccacttgcccgcgtcggtcttgcagtagacgggcttgagcgtcatcgtctggcccttcgcggtgatttcggtggcgatttggcggcaggtcttgccgtccgtctcggtcgtggtcggcgtgagcttcgcatcgatctgcgtgccgcggccgctgctctgccacgccgtggtctcgccgtccttgccttcgtcgcgcacctgcgcggcggccttcgcgagcgacgcgcggtcggccttgctgaagtagctgagcggcgtgtcgttcaggaaattcaggttgttctgcgcatgggcgggcagcatcgcggctgcgcacgcggcgccggccagcacgcgcgtgacgacggaaagggatgcacgcatcgacatgttgttctccttggatgttcgatcgaacggcgcaccgcgcatgccggcgaactggcacgcacactacgcctgtcagcgagcgaggatagcatgcgtgccgcctgcaccgccttctagtggccggccggcgcggccgcttgctgatatccgtcagtcaacgtgccgaggaaggcgatcacgtccttgatctcggccgcgttcagcgccggctgctcgccgcgcttgcggtcgaacggcgcctcgcggttgatgttcggccagtagcgtttcggcaggtcgtcatagatctgcaccttgccgtgcacgaccggatagaacttctccggatgaatgtcgcgctcgacgtagaagcgcatcacgtcctcgagcgtgtgatagacgccgttgtggaagaacgtcttgcgcagcgcgacgttgcgcagcgacggcgtgcggaacaacccgcagaattcgtcgcggcccttcaggtcggtacgctcggggccgcacgcgccgaggtcgtggaaacgcgggtcgcgattgacgggcagcgcgcgattgcgcggcaccgcgatcgcgatcagcccgaaatcgctgaactgcggcggcgtgccgtcgagtgcgcgctggctgatgtggcagctcgcgcagttgcccttcttctcgtcgttgaacagctgcaggccgcgcatttcggccggcgtgagctgcgcatggcccgcgagatatgcgtcgtacttgctcgtgtacggcgagaacagctcgggcgtctgctcgaacgtctcgagcgcgcgcagcacggccttgaacgtggccgcgtcgtcgtcgagcaccttcacgccgaacaccgcgcggaactcctccgcgtacggcgcggccttcacggcctgcgcgaccttcgccggcgagctgttcatctcgaacggcgacgtgagcggaatgcgcgcctgctcggcgcccgtgtcgacgcgcccgtcccacgtgaggccgcccgtcgggccggcatcgacgctctcgtcgccttcgtcgtcggaatcgtggaagtgctcggtgaactgcggcacgccctgcaggtacttgagcgacggcaccgcacgaaagcccggatgcttcatgtcgtcgccgccgaactgcacgtccagcgcattgggcggcccgaatgcgtgatcggggctgtggcacgacgcgcacgcgagcttgccggaacctgacagcgtagggtcgaagaaaagttgcttgccgagcgccgtcatccggcgcacgccttcgtaaacttgtgcccgcgtctgcggctggttcgtcgcgaccacggcgccgctcgcggcaaccgttgcggacgcaacgggtgcgcgccgcccggcgcactcgcggcctgtgcggacggcgcaccggcaccgggctgtccgtcacagccggcaacggtgacgagcgtggcggccagcgcgaatgcgccggcgagatgcagccacgaacgcgcgaacgcgccggctgtcggttggcgaggcttcatcgattcgtcggaaagtaggttcaggagcggccggagtttatgtcagccgcatgaccgttgcatgacgactcgtcgacagccaatcgaaaggacgcctacacccgcctgtcaaatcgcaccctcaaaatgcgtgcagccggacatgccacggtcacctcgcgaaccggcggtacacgaatgcgccggttccccacgcgacaagagagagatagagagtacaacggatgaaaaaccacgcctggattcgctttacaccgatcgccgttgccgcggccgccgccctcaccgcctgcggcggcgacgacgtgcagcagcagggcctgtcgacggtcaagaacgtcgtcgtgatctacgcggaaaaccgcagcttcgacaacctgtacggcaatttccccggcgcgaacggcctgcagaacgtgaccgcggccagcgcgcagcagaaggaccgcaacggccagccgctcgcgacgctgccgaaggcctggggcggcctgaccgcgaagggcgtgacgccggccgtgaccgaggcgatgacggcgaacctgccgaacgcgccgttcgcgatcgacgacccgaacggcttcaacacgccgatgagcgtgacgacgcgcgatctgtatcaccgcttctacgagaaccagatgcagatcaacggcggcaagaacgacatgttcgccgcatgggccgactcgggcggcctcgtgatgggccactacacgcccgacgcgacgaagctgccgctgtggaagatcgcgcagcagttcacgctggccgacaacttcttcatgggcgcgttcggcggctcgttcctgaaccaccagtacctgatctgcgcgtgcgcgccgttctacgcgaacgcggacaagagcccggccgccggttcgatctcggccgtcgccgccgacggcaagtcgctgcagctcgcgagcaactcgcccgcttccgcgctcgacggcgcgccgaagttcgtgaactcgggcaacctgacgccggacttctacgcgatcaacacgatgcagccgccgtaccagccgagcggcaacaaggcggcgtcgggcggcgatccgaacctcgccgacccgtcggccgcgacgacgctgccgccgcagtcgcaacagaacatcggcgacctgctgaccaacgcgggcgtgtcgtgggcgtggtacggcggtgcgtggaaccaggcactgcaggccgcgcaaagcggcacggcgaacgtgatctacggcccgaacatgacggcgccgaacttccagccgcaccaccagccgttcaactactacgcgaaccaggcgccgggcagcacgagccgcgcgcagcacttgctcgacggcggcaccgacggcagcgagttcatcaaggcgatcgacgcgggcacgctgccgcaggtcgcgttctacaagccgcagggcaacctgaacgagcacccgggttacacggacgtcgcgagcggcgaccagcacatcgcgaacgtgctcgcgcacctgcaggcaagcccgcagtggaagaacatggtcgtggtcgtcacgtacgacgaaaacggcggcttctgggatcacgtgtcaccgccgaagggcgaccgctggggcccgggcacgcgcattccggcactgatcgtgtcgccgttctcgaagaagggtttcgtcgatcacacgcagtacgacaccgcgtcgatcctgcgcttcatcacgcgccgcttctcgctgccgcgcctcgccggcctgcaacagcgcgacgacgcgctgaaggccaacggcgggcagccgatgggcgacctgacgaacgcgctgcaactgtcgccgaacctgtaacggcatcgcgacagacaggcgggccggtgtcatcgccggcccgcacgcacgaagggcggcctcccggccgccctttttcatcggtgcgcacgcgtcaccagccgtacttcagctcgaccccgacatagtcggcgttgtgcccgcctgcctcgcggatcgcatcgccgacctggaaatgcacggcctcgaccgcaccgatcaggttcgcggcgatcgtccagtcggcacgcagctgcacgtacatccccgtccacgacccgcccttgcctgccgtgcccggcaccaccgcgttgccctgctggtagaccgcatcgccggtcgtctcgcgccactggaaaccgagcgcaccgagcagcgacaggttcggcgacggcttcagcgtcaccgacggcttcacgtggatcaggttcgaatacccggtgaagccggcgagcgtgaagtaatagccgttcggaaacagcggattgaaggtctcgacccggccgtcgtgcggatgccggtcgcccgacgccgcatcgacctgcagcgcgatgcgcggcgaccacggcgcgtcgagccggtagccggcgatcgagccgaccgcccacgcgcggatcgtgctgctgccgaccgtgcccgtctgcagcatcgtttcgagatcccagtcgaagcggccgtgcgtgccggtgtaacgcaggtcccacacgtcacggcgctccgcgccgctcgcatcgagaaagcgcgcgctgctgcggttgtagcgcgaccagtagcccgacaggtcgccgggcccgaccgactgccgctcgaagcgcacgccgctgaacgtgaggtcgcggttcgacacgtcgtcgaacgcggacacggtgcggttctgcaccggctgagtcgcatacgcgatgaagcgccacttccggtactcgtagtcggcccacaccgcatcgaacgccagccgcacgttcgggccgtcgcgcgcggcgatgaagcgctgcaggtcgaacgccatctcctgacggccgacgcggaacttgaacgtcccgccgccgagcgcccccgtgtaggtcgcgaacgcctgctcgagatcgagcgggttcctgtcgaccggcgagatcgtgttcttgccgaatgcgcggtcgtcctgcagctgcacgaagaactgccagtgctggccgagatgcgcgtcggcatgcacctcgacgcgctggatcaggtacgtatccgattgcgcggagccgatgccgaacagcggcgcgtcgttggtctcgaggcgctcgcgcaggttcacgccgagcgacagataggaggccggatcgttgccgagcgggatatatttcaagccgtcgagcggtgcgcgcggcacgcacggattcgcgagcaccgaccagtcttcctgccagcggttgaacagcacggtcggccgcttggccgtgcaggtcgcggcgggtgcgccatcggcggcggccggtgcggtctccgcatccgctcgagccgcatcggtacccgcgagcagcagccccgcgacgagcgacgcgcgggcaagccggtcgaggcgagcggctcgcggcgtcgcccgaagctgcccgcccgccgcggccgttcggtcacgctcgcgtgcatccgcgcggcccgctcgccggtcgcggccgccgcgcagcccgatcacgcatgctcccgcgcggcggtgccggcagacatccccgcgcaggccgccagtcccgccagcgcgacggccggagccagcagcgcccagaacccgagatagcgaaagcccagcgcgccggccatcgcgccgagcgcgaacgcgacgatcgccggccacatcttcgcgaagcgcgcgcgtgccgccgtgcgcacgctgtcgggcgtgccggcggacagcaggtcgacgacgtcgagaatcgcctgcgtgacgttgccggtcatcaccgtgttcggcacgccggcgcgcgcgatcacgcgcggatgcgcgttctggatgcccatcgcgaacgtgccgacgatgccggccagcagcaccggcaggctgtcggattgcgtgacgggcgacgcccacacgccggccgcgcagaagccgagcagcagcacggcctggaccgcatgcagcgcccgcgtgccctgccacgcgggccgcccggaaacgcgcgcgcgatcaggctgctcgcgacgacaccgcacacgaacgcgggaaacacgctcagcttcagcaggacgccctggccgaaccccgcggcccccgcgccgatcagcacgaagttgccggtcacgtgcgcggtgaacagcccgaacagcgcgacgaagctcagcgtgtcgacgaagccggccaccgcggcaagaatcgtgtcctcgtgcttcatcgcgccgcacccgcgtggatctcggcgacataaccgccggggaaccggaccagcgccgcgtcgcgcccgtccgccgtgtacggcggcacgagcacgtcgacgccggccgccctggctttctccagcgttgcggccaggtcgggcacctcgtagcccgtcgtctcgtgcccgtacggataaggcaggtggccgtccgtcacgagcaccgtcatcttgccgaagcccgacgtgatgcgaatgcggcgataggtgtcgttcgggcggccgatctcgacgccgggcgccttcagatcgtcggacaccaccttgccgttcgagaacttgacgaaatcgtgcacgaacttgcgcacgctctgcggcgacacgtacacgcgattctcggggatcgtctgcagtgcgtcgtacttcggcgcctgcgtgtgccagtagagctgcatcttcacgccgcccgtccacgcgatcaccgcatcgcggccgatcggatcggggaacgtgtcgacgatcacttccgcgccgtgctcgcgcgccaccttcatcgccgcgtccatgtcggtgacgagataacccgtgcgctccgcgccgaacggccaggagtcggcgtcttgaagccgaacaccgagatcgtgccggccggcgtgaacacgagctgcgacatcgtctggctcggcgtcggcgtgacctggaacacgccctgcttcgacttgctgccgccgaacgtcgcgacgaagctgtcggtgaagcgatcgaaatcctccggcgccacgtacacgtgcgtcgtgtcgtattgcggcccgacggcaagcgtcggcgtggccgccggcaggacgggcggcttcgcgtacgcggccggcgccgcgacgaggccggcggcgatcgccagcgcgagcaaggcggaacgaatcgttttcatgactggatgtccttgttgttgatcgtcatcgagtggcacggccgttgccggccggatacttcgcatcggcgcgccgcgtcgcgagcacgagtgccgcgatcagcccgagatgctcgaagaagctgttgagcgccatgaaacgcgcggcgcccgtctggttccagaagtcgttcgccaccgccatcgcgacgagcgtcagcatgccgaggccgccggcgccgagccacgtgaagcggcgaaacacgatgcacagcgagccgccgatctcgacgacgaccgccagtgcagcccacaacgcgggtgggtgcaaaccgaaatgcgcctgctccgcgattgctgcgtcgaagtgcatcgccttgttgatcccgccgatcagaaaggcggacacgagtgcaagtcgaaccagcgcgccgatccacggctgcgcgagcagcgcacgaatccacgcggggctgtaccggccggttgtcgtcgccatgtcagaccgcccagcaggaacagccgaacgcgccccagaagcccttcgtgtccgacgtcggcaatgcgctgccccacgcgctcgcgtgcgcgtgctggtgcacgttgcacgcattcgcgcagccgcacatcgcggcggccgccgccgcgcgttgcagcggtgcgccgctgcgctgcgtcgcgccccagccgccgtaaccgccgtactcgcgcaccggcgaccagtccggcatcgcgggcggaatcggcgcgtcatgcgacgcgaacgggcccgcgccccacacgatccggccgccgaccaccgttagcaacgcggtcgtgcccgcgatgtcgtcctccgcgcacgcgaagaagtcgcgatccggcacgaccacgtcggccagctgcccgaccgcgatccgccctttcttgccgacctcgttcgagaaccacgtcacgtattcggtccacatgcgcagcgcggtctcgcgatcgagcaggttgcgctgcggatacatgcgcaagccaccgatcgtcttgcccgtcacgagccaggacagcgacacccacgggttgtacgacgccacgcgcgtcgcgtcggtgccggccgacaccttgaggcccttcgacagcatcttcgcgaccggcggcgtcgcttcggccgcctgcgcgccgtagcgctcgacgaagtattcgccctggtacgccatccggtgctgcaccgcgatgccgccgcccagcgccgcgatacgatccatcgacttttcggtgatggtttccgcgtgatcgaagaaccagttcagcccttcgagcgggatgtccttgttcaccttctcgaacacgtcgagcgcgcggctgatcgtttcgtcgtacgtcgcatgcatgcgccacggccagcggttctgcgcgagcacgcgcacgacgccctcgagatcgtcttccatctgcgccggcaggtccggacgcgcgacgcggaagtcctcgaagtcggccgccgagaacaccagcatttcgcccgcgccgttgttgcggaaatagtcggtgccgtcgtgatacttcgtgctcttcgtccagttcacgaagtcttccttctcggcgttcggcttctgcgtgaacaggttgtacgcgatccggatcgtcatctcgcccgcgtcgtgcagcttgcggatcacctcgtagtcgtccggatagttctgcgaaccgccgcccgcgtcgatcacgccggtcacgccgagacggttcagttcgcgcatgaagtggcgcgtcgagttgtactggtattcgaacggcagcttgggccccttcgcgagcgtcgcgtacaggatcgtcgcgttcgggttcgcgagcagcagcccggtcgggttgcccgcggcatcgcgcaggatcgtgccgcccggcggctccggcgtgtccttcgtgtagccgaccacgcgcagcgcggccgcgttcagcagcgcgcgatcgtacaggtgcaggatgaacaccggcgtatcgggcgcggccgcgttgagttcgtcgatcgtcggcaggcgcttctcggcgaactggtgctcggtgaagccgccgaccacgcgcacccattgcggcgcgggcgtgatcgccacctgccgcttgagcatgtccattgcaaccgcgagcgacggcacgccgtcccaacgcagttccatgttgtagttcaggccgccgcgaatcacgtggcagtggttgtcgatcaggcccggcagcgcgccgcggccccgagatcgacgaccttcgtcgcgcggcccgcgagcggcatcacgtccgcgtcgtggccgaccgcgacgaagcggccgtccttgattgcgacggcggtcgcgacggggttcgcgcggtcgagggtcgtgaaccttccgttgtgaaggatcagatccggttgagtagcgggtgcgttcatcaatgtgtcctcgatccagtcagaaaccgagccagtgacggaccggtgcgacggccgcgacgccgaccagcatgccggccagcccgaccagggcaatcagcggaggtgcgggcgagcgcaccttgaccacgctgtacatgacgccgaccagcatgccggcacccaatgaaacgacatacgattccatacgctcctcacgactggattagaatgacccgcatttccgcccgcacgggcgccatgcgcacgcggcgcgatccgctgccgccccacccgcttcgcttgcccgccacgccttccagccatgcaacatcttcccgatctcgaagcctgggccatcttcgcgcgcgtcgccgagaccggttcgttcgccaaggccgccgacctgctcggcgtatcgcaacccaccgtgtcgaaagcgatcgcccgcctggaaaagcgcctcggcgcgatgctgctataccgcacgtcgcgcaagctgtcgctcacgccgaccggcgagctgctgcgcgatcgcgcgatccggctgctcgccgatgccgagctgatcgaaggcgaagcctccgcgcatgcgctcgaaccgcacggcctcgtgcgcgtgaacgcgccgatgtcctacggcctgtgcaatctcgcgccgctgttgcccgcgtttctcgagcgctatccgcgcgtcgacgtcgacctcgtgctgaccgatcacttcgtcgacatcgtgtccggtggcttcgacgtcgcgatccggatcgccgaactgaacgattcgtcgctgcgtgcgcgccgcctgtgcgcggtgcgccggccgctcgtcgcgtcgcccgcgtatctcgaccggcacggccggccgactcatccgggcgaactcgaccagcacgtatgcctgacctacacgaacattccgacgcccgaatactggcgcttccgccacaagacgtcgggcgaggaattcggcgtgccggtgcgcgggcgcattcgcgcgaacaacgccgacgtgctctgccccgcgctgatcgccggccagggcctcgcgctgcagccgtcgttcctggtgtggaacgagttgcaaagcggcgcgctcgaggaagtgatgcatgactggaagattcccgatatcaacgtcaacctcgtcacaccgcccggcatgctgcgcgccgcgcgcgtgacggcgttgctcgactttctcgtcgaacacctgtcgcacgcgccgtgggcactgccgcccgtctgaccgggcggccgcatgcggccggttacttcgccggcacggccggaatcgactcgtgcggcgtcgcggtgcgctgggcggccttgtggaccatcgtgtatgcgtagtcgacgcccatcccgtacgcgcccgagtgttccttcgcgatcgccatcaccgcgtcgtaggtgtcgcggcgcgcccagtcacgctgccattcgagcgcgacctgctgccaggtgaccggcacgacgccggcctggatcatccgctgcatcgcgaagtcgtgcgcgtccttcgacgtgccgcccgacgcgtcggccaccatgtagatctcgtagtcgccttcgagcatcgcgcagagcgcgaacgtcgtgttgcagacctccgtccacaggcccgacacgaccaccttcttgcggccgttcgcggccagcgcgtcgcgcaccttctggtcgtcccacgagttcatcgacgtgcgttcgagcgtcttctggttcgggaacacgtcgagcagttcgggataggtgtaacccgagaagctgtcgctttcgaccgtcgtgatcgtggtggggatgttgaatgccttcgcggccttggcgagcccgacgacgttgttcttcagcgtctggcgatcgatcgactgcacgccgaacgccatctgcggctgctggtcgatgaagatgatctggctattgtggggagtgaggacttcaagtttggcgttgctcatggcgcgaatcatcctttggtctggaaacgttcaaggcttgcctcgaccgggatggcggaggagccggctgtgcgttgccccggattggcgtgttccggttgcagccatttaatcggaaaagtcgcggctcgaacatccaagaaatggaatcgatcgaattccgaaagaggggtctccgagggctgtccgcccttttttccgcacgtaaacccgatacgcttccagcacattgaaggcaccgccttcgcgcccgatcagcctatcacgagaggttttcatcatgaaaccgtattttctgtcgctgttcgccggcatcctcgccggtgtcatctacggcgcgctcggcgtgaattcgccggcgccgccgatcatcgcgctcctcggcctgctcggcatgctggccggcgaacagatcctcccgctcgcgcgccggatgctgtccggccaccggctcaataccgcatggcgcgacgcacaatgcagccagcacatgttcggtacgctgccgggcggcgccgccaacgaccgcaagccgtcgtgacgccaggctcatgaccaacgtcgaactgtttcattacctgctgctgttgatctgcggcgcgggcgcgctcacgtggctcgccgaacgcatctcgattccgccggccgtcgtgctgctgctcggcggctgcgtggtcgcggtcgccggcaagcgcgtgcccgacatggacccggcgctgctgctcgtggccgtgctgccgccgctgctgatgtcgagcgggttctacaccgcgtggaaggaattccggcaggagctcgcatcgatcgcgtcgctcgcgctcggcgcggtggtgttcaccaccgtcgcggtcgcgctcgccgtgcatgccgtgaacccggcgctgccgtgggccgcctgcttcacgctcggcgcgatcgtgtcgccgcccgacgcggttgccgcgaaggcgatcctgcagcgccacccgctgcccgcgcggctcgtcgcggtgctcgaaggcgagcctcgtcaacgacgcgtcgggtctgctgctgtaccagatggccgtgtcggccgcgctggcggtatcgatcacggccgccagcgccaccggcctgttcttctcgctgacgctgatcggcatcgcggtcggcctcgcatgcggccatgcgatgtgctgggtgctgccgcgcctgcgcgacccgatgctcggcatcgtcgtgaccttcgcgatggcgtggggcagctacggcatcgcggaagccgtcgacggctcgggcgtgctgtcggtggtgacctgcggcctcgtgctcggcgtgcgccagcatcgcgtgttcgacgccgacatgcggatcaaggcgaaggcgacctgggaagcgatcgtgttcgtgctcgacgcgctcgtgttcatcctgatcggcctcgcgctgcacgcgatcctcgcacgcgtgaaccacgaaggcgcggtgctgatggccggcctgcgcgtcgcgctgcccgccaccgccgccgcgatcggcgcgcgcctcgtgtgggtgttcgtcgcgatgtggctgccgggccgcctgcgcgcgccgcgcgcgggccacgctccgtggtcgtggcgcgaagccgtcgtgctcggctggtcgggcatgcgcggtgtcgtgagcctcgcggccgcgatcgcactgccggccaccttccccggccgcgacctgatcctgttcagcacgttcctgctgatcatcgcgacgctcgtcgtgcagggcggcacgctcgcgccgctgatccgcgtactgaagctgcgcccggccgcgcggcacacgatgtccgaacacgccgtgcgcgcgcacacgtttggcgcggcgctcgccgaactcgacgcgctcgaacagcgcgggtcgagcctcgaacgcccttcgctcgaccgcctgctcgccgaataccggaaccgcgtgaccttcaacgaacgcgcgcatcgtcatggcaccgaaccggccaacgtgcgggcacgcatgctgcgcgtcgaactcgacctcgtcggcgtgtcgcgccgtgcgctgctcgacctgcatcgcgacggcaaggtcgacgacacggtgctgcaccggatcgaatcggaactcgatttcgaggagctgcgcctgcagcgcctgctcgaaccctgaagcccggccaagccgccgcctcccctttctccttatggaactgcaatgagcgaactgtccgtcgaagcaagcatcggcgccgtcgattacctcgtccacttcaccgacggcgtccaccagtggcgcgccgacgagcccacgccgctcggcggcggcgacaccgcgccgacgcccgtcgcgctgctgctgtcgagcctcggcgcatgcaccgcgatcacgctgaagatgtacgcgcaacgcaagggctggccgctcgccgaagtgcacgtgaagctcgcgcacgaatcgggcagcgcgggcagcacgatcgtgcgtcgcatcacgctcgacggcgacctgtccggcgaacagcgcgaacgcctgctgcagatcgcgaacgcatgcccggtgcacaagatcctctcgcatccgatcaccatcgacacggcgatcgcctgacgcgccccgcaccgaccacgagaatccccaccatgtccgcctcgatcaagaccctgctcacgccgcgcgaaagcgacatcggcaacctcgtcgtgcgccgcgtgctgcccgcgcgcgccgcacgcctcgtcggcccgttcatcttcttcgacgagatggggccggccgtgctgccggccggccgcggcatcgacgtgctgccgcatccgcacatcggcctcgcgaccgtcacctacctgttcgacggctcgctgatgcatcacgacagcctcggcttccggcagaagatcgtgccgggcgacgtgaactggatgacggccggccgcggcatcgtgcattcggagcgctcgcccgacgaagaccggccgcgcgagcagccggtgcacgggatccagacctgggtcgcgctgccggtcgagcatgaagacaccacgcccgcgttcgtccatcatccggccgacacgctgccgtcgttcacgcgtgacggcacgaccgtgcgcgtgatcgcgggtaccgcgttcgggctcgcgtcgccggtcgccgtgttctcgccgacgctctatgcgtatgcggaattcgcggcaggcggcacgctcgcgctcgatgccgaacatgaggaacgcggcgtgtacctggtcgacggcgacctcgccatcgacggcacgccgctcgcccccgcgacgatggccgtgctcgaacccgacgcgaccgtggcgctcgccagcgcaagcggcgcacgcgtgatgctgctcggcggtgcgcacctgccgggcgagcgtttcatcgaatggaatttcgtgtcgagcacgcgcgcgaagatcgacgcggcccgcgccgcgtgggccgaccagaccttcggcaaggtgccgggcgaagaaaacgaatggacgcgccagccggaacgcaaggcgcaacaggcccaataggcaggatcgcccgcaggcaaccgacggccggcacgcatgccggccgtcgccccgtccgtcttacgtcgacggtttcaatcccatcagcttcgccagtgtcggccagcggtcgagcgactcgatgaacgcacggcgcgcctgctcgtcgacgtaacgcccgggatcgagcgcgggcagatgccgggcgaggccgagcacgtcgttcggttgcgacaggcgatcgtcgtcgccgtcaccgtgcagcattactgttcgtcgatccatacgccatccggagttttcaccgagtaaccctcggccgtctgcatcgtcaccgtgccctcgttctcgccgaccatccgcgtacgcggcaggtcggccgcgtattgcgcgagcgtcgtgcccggcttgaacgggctgttcgacacgaggttcgacagcagttgcgcgagcgcgaggaagctggtcggctggtcgatcacggtcgtcgcgccgtgattgccggcaaagccgacgagccgcacgcccaccggcccgtgcacgatgcgcggcgtcgggatctcgcgcaggcccgcgacctggtacttgtcgccgcgcagcgcggcgccgtgctcgggcacgaacacgatcaccgcacggcggcccgattgcgcgatcaggtcggcgaggcggtcgaagtcgttcatcatcttcgtcacgcgctgcggatacgagtcgatgctcgtcagcgaactgccgacgatccggttgccgtcgtgcaggctgatcgtgttgtagtacagcgcgaccgggccttgcaccgacgcgcgctgcgcataccagttcgcgagcgtcgtgtagtcgtccttgatcgccgagccgtcgaacgcgtgcatcgcaacgggcgcggccgcgttcgagatcatcggcgcgtcggccacgccgatgttgtcgtggatcacctgcaggaaattgtcgaagtggccgtcgtggttcagcagcgactgcaccgagtaaccggcgctcgccagttgcgagaacaggtggcactgctgcggcgcgggtttgtacaggtcggcgtgcgcttcctgcccgcagctcgcgcgcagcacgcggatcgccgccgggccgctgtagctcgcggccgtgctgaagttcgagaacaggtagtcgaaatggctcagcatcggatggttgcgcgccttcgcggcatcgaggtcgtcccacgacagcgagcagatgtgcagcacgatcacgtcgaactgtgcggccggatcgctgccgaggtggccgaacgcgacctgtcgctgcgactcctgcgtgcggaacgtcgcgagcgcggcattgtggtcctcgggctggccggcgagcgtcgtgcccgccgcgttcgcctgctgcggaagcggcgcgacgacacgcgccatcagcccgctgccggcctgccacagcggcatcacgaccagcacggccagcacgaaggtcgcgacgcgcagccagcggttgacgatgaagtagacgatcagcacaccggccaccgtcagcaccagcacgggcggcagcaggcgcggcagcagctccatccagtagtcgaggcggaacgtgctgacttcccgcgcggcctcggcgagacgggcaagcggcggcgcatgcaactcgcgcgcgagcagcggcaccgcgatcgcgatcgcgacgacctgccggacgatgcgccacgcccgccgccggatcggcgcgctcatcgcgagcgccaccgcgaacgcgaggttcgcgagccagaacggctgcaggtgcccggtcgcgaacagcgcgaacttcaggatgaaatacagattccagaacgtcatctaacccactccatgatgagcgcgcgtcagtcgcgcgcccgatcgagtttcggcgccagcatggcctgcaggccgcgcgccgcacccttccacatccgtacatagccgtccaggccgatgcgcagcacttccttcagcccgcggagcggcgtgtcgacgcgctggccttcatgccagtcgagccacgcgtccgcgcgcccgaacgtgcattgcacgagctggcgctcctgttcgagcgtcagttcctcgaagctcacgccgacatgggtcggcgtcacgcggctcacgcgcaccgggaacgggaacggccggtcgccgcgcgtcacgcacaccgtcagcgtgtcgccgacggcgaccgggagccccggcaccgcttcgaggcccaggccgccggtcgagtagtcgctcgtgaagcatgcggccgtcgagccgtcggcgagcagcagcgtggccggcacgcgcatcgcgatccggtgcgtgacgcgcacctgcttggtctcgcgcgcgacggcgagcgcggcgccgagcatcgcgaggttgtacacggtccagccgagcgtgatcaggatcgtcgacgcctcgtcgccctggtcggccacgagccgccagatgccggcgaggatcgcgagcacgttcagcccgaacagcacgagatacggcttcgacgtcgaccagtcgacgtagccttcgtcgatcttgccgcccttgtcggtcacgttgaacttgccgtgcttcgggctgaagaacgcgacggtggtcggcagcgcgatgtaccacgcgagcaccgactcgtagacctcggcccagaacgaatgacggtagcgcccctgcatccgcgagttcgcgacgttcgcgagcacgaggtacgggatcacgtagctcgcgagcgcgagcgacgacgcgttgatgaagtacaggtggaagaacaggtacgcgagcgggatcgtcaggaacacgagccgcggaatcccgtagaagaaatgcagcatcgcgttgccgtagcagatccgctggatcaggccgagcccgcgcccgaggaacgggttgtcgatccggaagatctgcgccatcccgcgcgcccagcgcgtgcgctgcttcacgtggcccgcgaggctttcggtcgcgaggccggccgcctgcacggtcggcaggtacgccgacgtatagccgcgccggtgcagcttgagcgccgtgtgcgcatcctcggtcacggtctcgaccgcgacgccgcccacctcttccagcgcgctgcgcttgagcaccgcgcacgagccgcagaagaacgtcgcgttccacaggtcgttgcccgactgcaccaggccgtagaacaggttgccctcgttcgggatctcgcggaacgtgccgaggttgcgctcgaacggatcgggcgagaagaaatggtgcggcgtctgcaccagcgcgcacttcgggtcgcgcaggaacacgcccatcgtcgtctgcaggaacgagcgcgtcggcacgtgatcgcagtcgaagatcgcgatgtattcgccgtgcgtcttcggcagcgcgcggttgatgttgccggccttcgcgtggcggttgtcgtcgcgcgtcaggtagtcgatgccggcctcggccgcgaacgccgcgaactcggggcgccggccgtcgtcgagcaggtacacgcgcagcttcgcgctcggccagtcgatgctctgcgcggcgaataccgtcggcttcacgaccgacagcggctcgttgtaggtcgggatgtagatgtcgacggtcggccaggtgtcgggatcgtcgggcagcggcacgatcggccggtcgagcggccacgcggtctgcacgaagccgagcagcaggatcatccacgtataggcttccgcgccgtacagcaggtagcccgcgatggcctcgacggggctgcggaaatcgagcgtctgcgtggtgcgccaccacacgtagcgcaccgtcgcgagcagcgcgagcgacgcgagcgcgagcgtcggcagatggcccggcaggcggcgcagcatgagcgccagcaccgcgacgatcgcgaagaacgcgaactgcgcgccgggcatcagcggcgacatcccggccgcggcccacagcagtgcgccggccaccagcagcagcggcgcgagccagcggcgccggccgacgccgttcgcgcgcgcatcgagccagccgccccagcgcacccatggcagacgctcgagcaacgcgttgacgcgccggccgaccgcgcgcccggccacgtagacgggcacgacggtcttgtcgaaccaggcgagcggatcgcgcgcggggcggccgtcggccgcgcgcggcgcccgcacgatcgcacgccacagccattcgcgcgggctgagcggctgcagcacgccccactcctgcgcgagccgcagcgacgcgacacgcacccagcggcgcacgtgatcgggccggccgggcggcggggcgtggaagaacagccgcacgagccagtcgaccagcgtgcgttgcgcgggcaagccgatgccgcgcgcgatccagtcggccgtgcggcgtccgaacgcgcgcaggcgcggcgcgatgcgcgcgttcatcgcgccgctccgcggcgaacggccgcgcgtgccgccagccaggtatcgacccagttcgcgacgccgttcaggtcgtgcgacgcctgcgaatacggtgcgtcgtcgaagatccagctgccgcgcgcgagcgcttcgggcacggccgcatcgacgtggatgcgctgctcgagcatcgacgccggcccggcgaccgcacgcagcatcgcgagcgcgtcgcgctgcatgtcgcgcgccggattcagccggttcacgacgatgtgcagttcgccgcccgccccgagcgcatcgagccgcgcggccgtcgtcgcgcaggcggccggctcgggcggcacgacgacgagcgtcaggtccgcgcggcgaatcgcctgctcggcctgcgtcgacggatagcgcgcggtgtcgatcagcacgacgccgtcggccggcaacgcgatctcgtcgagcgcgcgcgacagccacgccggatccgccgcgagccgcgcatcgcatgcggccgcgccggccgcgtcgacctgcccgtaaggcacgaacagcacgccatcggcgttgcgccacgtgtgcgcatgccacggctcggcgccgccgagcacgctctgcgcgaggccgtgctcggccagcgtgtcgaggccgagcgtcgcgcccatcaggttctgcgcatcgaattcgacggcgacgaccggcctgccgcggcgcgccagcagcaccgcgagcgcggccgtgagcgtcgtgcggcccgcgcccccggtcgtcgacgtaatcgcgatcgtcttcatcgggccgcctcgccgtgacgttcgtcacgctcgccacgctcgcgcccggcgtcgggcagcagccgcccgcgcagcgcgaccggcacgagttcgcacggcaccgcgtcacgccggtcgatcccgcgcggcgcgtgaaaaccgcggccgatgccgagatgctgcgcgacgatccacacgggcaccgcgatcgcgatgccgacgatgaatccgatgacgagttcggcgatcatgcgaccccctccttgcgcagcggcatcgcgctgcggatggcgctgcgcttgcgcgcggcgagaatgacgggttccggcgccgcagcgtcggcggccgcggccgccggcgtcgcaccgatcgcctcgagcgcgacgatcgtatcgatcgcgtcgattgcaccgctcacttcgctcgcgtcgggcaacgcgtcggcgggcccggtgcgcgcgagcgggtgcgactggcgcccgccggctgcgcggccccgaacaaatcgctgtagtcggcgatcggcgcacgccggttctcggccttcagcgcgttgagttcggtatcgatgctgccctgcccgagacacacgacgcggtcggacagcgtgtcgaccggcacgtcgaagatgcgcgcgagcgcgtcctccgcgtccgccggttcgcacgcgaacaggaacacgtacaggtgcgcggcatcggccgtcacgacgtcgcccgcgcggcgcgggcggcaatgccgcagcgcgtcgacgtgcgacacgccgggcagcagcgcgatcttcgcgagcgtgtgcggcagcgcgagcacggcgccgcgatcgagcaccgcgcgaatccgcaggcagaacgcgccgaccggcagataaccgagcaccgaatcgccgagcgcggccgcgagcgccgcacgatagtcggccgcgacgggccgcgcatagagctggccgcgcagtgcgtgcacggcccctgcagtcgcgataccggcaggtcgcgtgcgatgacgcggctcgcgccgacgctcagcacgagcatctcgaactgctggcgcagcacttcgccgcgctcgacgaccgcgatcttcagcgcaccgccgcactgccggcgcagcgtgtgcacgtccgcgcacagcgcttcgagctgtgcatgcgaacggaacgcgagcaccgcggtcgcggcctgggcatgcgcgcaggcggcaacgacggccgcgttgtcctcgacgatttcccagccctgcggcgcgcggttcgtgccgtcgagcaccgcgcggctgacgacgacgcgatcctcgtcgctcgcgagcttcatccggttcgccggctcggtcgcgccgccgtcgatgctcgccgacagccggccgcccggcgcgaaacgcagcggccgtacctcgccggccgcgagcgtatcgcccgcgcgccagaaatcgacgatccacaacagctcgccatgggtgcgctgcaactgcgcgacgcccgagcagataccgtggaaaccgctgcgcggcgtgcgatccgcatcgcgcacgagcggtgcatcgtcggtgcgtgccgcgtcgtccgcgcgggtcgcttcgggatcgagcagcagcacgagcgcgatccggcgcgtgcggcaccagtcggcgagtgcgtgcgcctcgtcggcgagcgcgatcgggtcgtcccagctgaaccagcgctgcgcgccctcgacgaaatacagcgagcgtgcacgaaagccgtaacgcttcatcgcgcgcaggccgccggtcagccgcgcgaacgggcccggtgccgcgcggcgcggtgcgtcggccgtcgcgcctgcgccggtgccggcgccgtcaccgccggccggatcggccgcggccgcgggcggcatcgccagcacgttcaggttgcgcggccagccggccggatgcgcgccgtccgcgaagccgcgcgcccgcatctgcccggcaacgtgcgccgcgtcgcgcgcgagcacgatcgtcacgtcgcgcgtgcgcgcctgccgtgcgctctcccacacgagcgcatcgcaggccggcgtaccgccggccgcgtagatcgcgtacaggccgccggcttccagctgtgtccacgcgtcgggcaagccgtcgatcgcgagccggctcaccgtgccggcgcggccgccggccggccccgcgcccagcagcgcacgcaggcggcccagcaggccggcggcgccgagcgcgggacgggtggcatcgatttccgtattcacggcgcgttccctagtaatccgaataaagccgcacgggtgtcggcgtgacgagccagctgcgttgcgcacgggcatcgaacgcatagcgcaggtacacgagcgccgaactcggcgcgtagtcgtgcgaccggtcgacgtgcagttgcgcgccgacgctcaggtgcgggttcacgcgatactcgacgatcccgttgacgccgtacgagaacgacacgccgcgcgtcgagctgcccgcgtacacgaacccggccgccacctgcgcggcccgctggtccgagaacgtcgggtaatacagcgaatccttctcgtagctgttcgagatcccgcccgtgacggtcaggtcccacgacagcgcatcgtgccgccccgcccattcgatcggtacgccgagcgacaggtagcgctgcgggctgtagtaaccgccctgcccgtacgtgtagtagcgcaggttctgcgcgtagtgccacgcgttgccgacgagcccggtgctgaccttcatcgtcgcgcgctcgtacacgggcaccgtgaagcccgtgcgcagcgtgacttccgcgttgcgctcgacgtttcggccggacagcacgcccgcgccgagttccgcgaacaggttcgtgcggccgacgtcgaccgacgtgcgcaggttcacgccgtcgcggcgcacgccgccccagaccgcgcccgtccacgggtcgcgcatccccgcgtacgacagcacgctgctcgtttccggccgccgcgacgcgttcaccgagaagctggccgggcccgcgtcgaagcgataacgcacaccgccgacgaggtaatgcacgggaaaaccgagcggcgacgtgccgaggtcgacgcgccatgcgtccgacagatagccggcgccgagcgcgacgcccgtcgtcgactggtgctgcgaacccggcggattcgcgatcgatgcgggcgtcagcgcgttctgcgccctgagcgccgcgaacgtgccgaacgtcttgagcgaatacgcattcgggttgctcgtatcgagcgtgcccgggtcgagatgcacggtgtcgatctgcgcgaacacgtgaccgtcgtagcggaccggcatctgcatgtagatcggcacctgctgcgcgcgatacgaagagatgccttcgtcgcccgatttgtacgcaggcgtccagccggtctcgatctcgggattgcgccgctgctcgagatccgcgaacgcggcctgcgcgggcgtcaggccgtcacggcccgggctcacgcccgtcgcacgctcctgcgactgcgacaaccggtacagcgacgccgcgtcgtcgtagcggccctgcgcctcggccacgcgcccggccgcgaccgtcacgtcggcgcgcgccggatacgcggcatgcagccggtcggtcacctgcgcggcttcgtccgcgcggcgcagcgcgttcaggcggcgcacggccgacagttgcgtgtcgacgtcgtcgtccggcgtgcgcgcgagcaccgcctgcacgcgcgccagcgcggcggcacggttgccgctgtcctcgtcgatgcgcgccagcgcgagctgcgtatcggcatcgtccggcgtgcgcgcgacgaccggcgcgagcgcatcacgcgccgcgtcgtaacggccttgcgcgcgttcgagatcggcccgttcgagcgcatgacgcttgtccgcgcggccggccgggctcgcccgatcgagcagcttgcgcgcctgcgcgtagtcctgccgcgcgatcgcatcgtcggtctgccgcaacacgagccgcagcgactggtcctcgatccgcgccgtctgcgcgggcgtcagcgacggctcccggcgcagcgtgtcgagccacgcggcaagcgcgtcgtcgcgccccgcgctgccgagcagatcgccatagcgcagccgcacgtccgtatcggcttcacgcgggtgcgcggcgatccagtcgtgcaacggcgcgaggccgcgatccggttcgcccgcgtcgatccattgcgcgccgatcgcggcgagcatgtcgggatcgtccggcgcgctcgcctgggcctgcgcgagcgacgcggcgaacgccgtgcggtcgccgcgcgcgagcgcatcgcgtgcgtcggccagcgcgcgttgcgcatcgagcttgcgcgcgagcgcgcgcattccgtccgtacggtgcgcgtcgtcgaccggcgcgagcgcggcctgcgcgcccgccacgtcgtcgagcgaattgcgatacagcgcggtcgcgtagcgcatctcgggcgtcgcgccttgcgcgagcccgtcgtccatcaccgtgcggccgagttgcggcagccccatgtcgcgatagaggcgcgcgagcgcgaagcgcgtccacggcgcgtcgggcgccgcgcgcacggccgcctcgtagcgctgcgcggcgggcccgcgttcgcccttgtccgccagcgcgcgcgcctggtccgcgagcaggtcggcacgcaggccgtcgagcgcgtgctggccgtcgcggcccgtcacgcggccttgcagcgcgtcgagcagcgggccgatccggtccgcgcggctggtgttctgatacagcgtggccgtatcgcgcacggccgcgaggctcggcgaacgcgcggccagcagctcgcgcagcaacggctccgcgcgcgcccagtcgcgctgcgcgagcaacgcatcggcaagctgcagcttcgcgtccggactgtccggctgcatcgcgagtgccgcacgcgccgcgcgctccgcgtcctgcggacgtcccgcggcggccgccgcgcggccttgcgcgagcagccccagaactgcgcggtgcgcgcgaggccctgccatttgccgcgctggtcggtcgcgagcgtcgcggcgcgcgtgaacagcgcgcgcgcctcgtcgtgccgcccttcacgcaggcgcagcaggccgagcccgccgaccgcgtcggcgtcgtccgcgcgtgcgcgcgcgcgcgcgtcagcagcggatcggcgccggccaggtcgccgcgcgcgagcgcctgcaggccgcgctgctgcgcgatgtagtcgggattgcgctcgagccggcgctgcgcgtcgcgttggcgatccagtgccgccgcgcgatcgacgaattcggtgtcgtccggcacgagcacgaggtacgcatgcagcgcatcgagatacgcgggatcgctgccggccgactgcagcacgcgccgccactgcgccattgcctccgtatggtcggcgtccgcgcgcttcgcgagcgcccacgcgagccggtttgcctccggccgcgtgtcggcacgctggttcaggagccgcacgagcgccatcgccgcgctcgtgtcctgcggatcggccgcgaccgcgcggcgcaacgcggcgatcgccggctcgcgcccgcccggcgcattcgacacgatctggtagtactcggcgccgagcgcgccctccggcgcaccgttcggaaacagcgcgacgatccgccgtgccgcctcgtcggcacggccgctgcgcgcgagcagacggatctgcgccatctcgccgcgcccgctcgtcgcgacgcgatattcgtcggcgacccgccgcgtggcgggcgcattcggcgactgtgcctgcaggcgcgcgagcgaggcctgtgcgcctttcgcgtcgccgagccgcagcagcacgcgaacctgttcggccagcagctcgggatcgcccggcgcgatcagcagccccttgcgcagcgcgtcgcgcgccaggtcgtcgcgatgcttgacgccccacatccgcgcggtgtcgagctggcgctgcgcatcggcggacgcggcggccgccggcgtcgcggaggatgccatcgtcgtgcccggcgcggtgcccggcgccgccgcgcataccgacgacgcgagccacgcgaatcccgcgacgtgcggcgcggcgcgcttcagcgggcggcgcacgagcggcctcccagcgggcgtcgagcgtgccgtccgcgccgaaccggtagcgtccgtcgcgccagccgagcccgaacagcgtcagcacgctcgtgtagtaaccgggcgccgactggcgcgcgagcgtatcgacacgcgccgcctgcgcatcggcgagcgcgcgctggccgcgcgcgtcgaggaacggcacggcggccgccgaaaacccgccgttgccgtcgttcggccccgcgacgcccgtcgtcgtatcgaccttctccggcggcgcgccatgcgcggcgatatggtcggcgaacggcgcaaagcgtgcgagcagcggcgcggcgagcggatcggcgcggtcgagcatgccggcccacaggtacacgcggatcgcgttgtacgcgctctgcgcatgcgtgtcgcgatcgggcccgaaacccgtgcccgcgcgatacagcgcccagtcgggcgaaaagcccttcggtgccgtgtcgagcagcacgcggccggtactggcagcgagcgcggcccagcgccggtcgtcgggcaggcgcgcgccgagcgcgcggatgacctgcggcggcgaatagctcgggttcaaacgccactgaccgtcggccagcttgaaccccgtcggccccggcagcagcgtgaggccgaggcccggcacggtcgcggtctcgtcgtcgagcacgcgcttcgcgagcagcgcgccgcgcgccgtgtagctgcgctcgtgccacagccgtccggcctcgacgagtgcatacgcgatccacaggtcggcgtccgacgccgcgttcgcgtcgagcacgcgccacgcgccgtcgggcgcacggccccacagccacgccggcaggtgcgcgctcaggtcgccctgcgcgagattgttctcggtccatgcgaggatcgtgtcgaacatgcgccggtcgttcgcgaccagcgcgaagaagagtccatacgcctgcccctccgacaccgtgcgtgaatcggccgagccgacgtcgatcacgcggccgtcggccgagatgaaatcgcgcttgaacgcgtcccagcgcggccacgccgcgccgcatcccgcatcggccgcgccagccgcacccgcggcgtgcgcgcgcgttgccatgccggctcccgcgcacgtcatcgccaccgccagcgcgattgccgcgccgacgcgccgcgccggccgcgatgcccgtcgcttcgccataacccgcgccatccgttacatccccgtcgacgcgcggcgattctctgcagcacgctgaacacgccgagcgcgagcagcagccccgcgaccacgccgaccgcgccgagcacgaccggatgccgcgccgcttccgtccacacgcgcgcataccacggcacgaagccgaccacgtaaggctcgccgacgcgcaggctgtcgacctgccccggccgcaccagcgcgaggtcgccctgcagctgcgacacgagcccggcgttctcgaacacgtcgagcagatcgccgaggcgcggctggtcggtcgccgtcagcgcgaccacgctgcgccccggctgcccggcagctcgaacccggcaagcgccgcgagcgagcccgtctgctcgatgtgcgcgccgccttcggccaggccgacgccgttgcgccagcgctccttcaccgagaacgcgatgcgcgcggtgccttcgccgcccgcgctgccctgctcgccgatcacgagcggcagcgccgagcgccagtgcgcgagcagcggcgacgcgggcgagccgtcgatcacgagcaggtccttgctgcccgacagcgcggcgacgtcgccgggccgcgcgacctgcacgcgcagggccggaaacccggtccattcgcccatgtggccgagcatcgtcaggtaggcctcgagctcctgcggcgacggccggtcgggcatcacgacggccgtctgcgacaggtcggcgaagcgcgtgaacgggaagccgctgttcgcgaagaacgcgaggttcggcaattgcgcgtaatggacgaagtgcgagaagtcgatcgtcgaatcgggatcgatcgccgcgcgctgcggctcggtcgccgtgctcgagcacaggcccgtcttctgcgagtcgagcgtgaagcggaactgcagctggttgccgctgccgacccggaacgccgggatgtcgacgtcgctcgtcacgcgcccttcgggcaccgacagcagcggcagctgcatgcggccgtgcgcgtcctcggcttgggccggcccgagccggtacgacttcacgagctgctcgttgatctcgacggcgagcgtcgagttgtcctgcacggtcggcgccgtgtagcggtagcgcagcgtgatcggcacgcccgcgccgttccacgaatgcagatcggccggcacgcgcaggttcaggcggattgcgtcgggcgtcgtgccgcgcacttccagctggcgcgtatcggatacgagctcgcggaacgcgatcggccggttcacgggcagccagcgcggcgcgtcgtacggcttgcgcggcgcgccgggatcgacgtgcgccaccgtcgccgccggccccgacagcgccgcgcggcccagcacgagcgtcgcgaccgcatcgtcgacctcggccgccgtgcggcccgtgacgacgagcagcttgcgccccggcgcggccgggttgtcggccaccgcgagcagcgggccgttgatcgacggcagcgcgaggccggccggcagcgtcgcggccgtgccgatcaccaccgcctggtcgtccgtcggcagcccggacgacaccgggaaccgcgcatgccggtagtcggccagcgcgccgaaccacgacgcgagcacgcccgcgctgcgcagcgtcgccgaatccggcgacgccggcagcacgaacggcaaccgcacgcggccgttgtcgcgccggtcgaagaacggcgcgggcagcagcgcgagatcgttcggcaggcgcaccggcgactcgtcgagaatcagctcgctcttcgggctcacgtcggcccacagcgccgagttcgacggatcctcgcaatggtcgagcgtgtagtgcgcgatcaggcgcaggccgatctggttgaaatccgagaaatagcgcggatcgatcgggatttcctgcgtgaccgtccggcccgcctgcgcggcgtcgaacggaacggtcgcgatcacctcgccgttcaccgacaccttcaggtgcgacatcgggaacaccagcgacggtgaataggcgtaggtcaggcgcagccgcgcgccggtgaccacgcggtcgagccgcacgcccgcgttgatcgtgcgcgcgtcgtcggcaccgcgcaggcgcagcggatcgaacgcaccgagcgacgcgaacggcaggtgcaccgtcgtcgccggcaagccggcggacggcgcactggccgccgcgagcgcggccgcgagcaccggcgccggcatcgcgcccgaggccgcggcggcggcggcggccggcacggccggcatcggtgcggccgacagcgcggcggcgtgaaacgcgccgaccatggcggccgacaggacgaacagcgacacggccggcttcatgcgccgctccgtttcgtcaggatcgtcaggtcattcgttgcatcggaaccgatgcgcgcaaagcagctatgcccgtgagtgaacaatcccactgcttcccctcatatctatccaactggcctgattcatttatcgaaacgatgcggcgatttctttaatcgcctgtcatcgtgctgcgcgcgcgcctggcaccggcacgcgcccattcgtcacactatctcaaaaataggacaaaacttaccccgattcgcgacgatgaagcgaaaaacctcaatccagtcgaaaatgctgcgcgagagggatgaatggtaagaattgcgccgttgtcgcccgacgggccgaacggcatactgccggcgcggttcggccggccggcggcggtccgttgcagaccgccccggaacgcgccgccgcgaagcggcgcgtatgctaccgcaatcccgtgccgccggacgtgctttctttcacggaaaactgacttgaatcaaatcgccgacaccgccactccgtccccgataccctgctgcgaatcattgccgcccagaccgagatcgcgaagctgggcctcgacctcggcagcgtgatggcctatgtggccgagcaggtgccgcagctcaccggtgcgagcgccgccgcggtcgaattcgccgagggtgacgacatggtgtaccgcgccgcgtcgggcaccgcggccgggatgctcggcctgcggctgcggcgctcgggcagcctgtccggcctgtgcgtgcagcaaggcgagctgctgcactgcatcgattcggaaaccgacccgcgcgtcgatcgcgacgcatgccggcgtgtcggcctgcgctcgatgctcgtgatgccgctcacccatgccgacacgacggtcggcgtgctgaaggtgatgtcgccgaaagtcgacggcttttcgccagccgatgccggcacgctgcggctgacggccgacctgatcgccgccgcgatgttctacgcggcgcgcaacgaggcgaacgaactctacatgcgcgcgacgcatgacgcgctcacgggcctgccgaaccgcgcgctgttctacgaccgcctgcggcagtcgatgcacacgacgctgcgcgcgaacggccggctcggcatcctcaacatcgacatggacgggctgaagccgatcaacgacgggttcggccaccgcgcgggcgacgcggcgctgcgcgagatcgccacgcggatgcagggcgcggtgcggcgctcggatacggtcgcgcgcatcggcggcgacgaattcgcggtgatcctgccgaacatcggcaaccgcgacgacgcgcatgcgcaaagcacgcggctcgcgcgccaggtcagcgagccgttcgaattcgagggcgcccgctgcggctcggcgtcagcgtcggaatcgcgctgctgcccgacgacggcaccgacatgaccgcgctgatcgagcatgcggaccaggcgatgtatgaggtgaagcgcacgcggtcgcagcggacggctcacgcgtaacgcgcactcgaagacggcttcctcgatgcacgggcggccggaacgacagcgtcgaccacgcgcggcgagctcacacggccgctgactagccgatctgcgaaacggcaatcgcgagcccgaccacgagccactgcacgatcgcgacgagcacacctgcgcggcacagcccgaccgcgccgcgcacgcgtgcgtcgagcgcacgtccggccttcgacgcgtcgatccagccgagatcggcgagcgcgcggtcgagcgcggcgagggcatcgtcgaccgatgcgtcgccggccgccgcgcgcgcaagcgcggcgaacagccggcggtcgatctcgatccgcaccgcaacccacagcgccgcgatccccgacccggtgctgacgacggccagcagcacgcgcgcgaccgtcgccggcgcccagcccgatgcgatccaccagcccgcgccggccgcggccagtgcggccgcgatcgcccacgcgcctgcatcgagcgcgccgcgcgcgcggcaatcctgaatggcgcggacgggtcgcgcatcacgcacctccgcgccgcggcggccatcgatccagtgctgcagcacggccacgccgtcgtccgaccacaccgcatgcggccgcaccgcgcgcaccgcggccagcgcgtcgcgcgcatcgccgaatccgcgtcgcgccgccagccacgcggccgcgcacagcacgctgcgcccgtagccgagcgcgcagcagaccagcacgtcgcgcccttccccgtgcaggcgttcgagcgccgcgacggcctgcgcaagttgcgcggccgtcggcgcgacgaggtcgagctgcggcacgctcgcataggcgagcgatgcatcggccgccgcccagcgcggcatttcggccgtcaggtcgaccagtgccgtgaaaccgtggcggcgcacgtcggatgtggtcggcgtgcggccgagcgacacgcgttcgtcgatccgcaccggcgccggctgccggaacgtccacagccgcgaattgacgaatgcgccggcgatcgtcggcgcgagcagccagcggatgacgaccgggaaacgcccgtgcgcatccttctggaacgcgccgggtgcgccgcgccggtagatccacgcgacacacgcgagcgccagcgcgacccacccggccgccagcgcccagccgggcgcgcgcggcacgcaccagagcgccacgagcgcgaccgccgccgcgccgagcgcataacgacgcgcgagcgcgcggccggccgcgcccggcgacgcatcggcgcccggcagccggcccgcggcatcgcgcagcgggaacaggaacagcgcgagacagccgacggccgcaccggtcggcacgtcgatcgcgtgatgctggtaggtcgtcagcaccgacacgccgatcgccgcgaaccacagatggagcacgacgcgcgcgagcgtgccgcgcacgtgcttcgcataaacggcccacagcacgacgagcagcccgatgtgcagcgacggcgcctggttgaacggcttgtcgaaccccatcagcagcgtgaacagcgcaccggccacgccgcccgcgtcgggccgctcgaacccgaagcgcagcggccacgcgatgaagcacgcgaccgataccagttgcacggtcaacagccgtttcacgtgatcgagcaggtcggcgcggcgcgtccagaagaagaacgacagcgcatacagcaggtcgatcgaccagtacggcacgatcgtccacggcacgaacgggatcgcgtgttcccagccgaacgcgaaggtcggcaccgccacgcggcgcgcggcgagccagttcgcgaagccgtaggtcgagaagaacacggcgcccatcaccgcgagccagccgagacgcagcgcgaacgacgcgtcgcgtgcgccggccgccgacgccgccaggccgcgcgcgtcgccgccgaattcgctcatgacgcgtcgacccgctgcgcgaggctgaccgtgaaaatgcccatttcgtcgatccgctggtcgagcttgcggaaccccgcgcgcgcgacgagttcgtccatctcggcctgcgagcggcggcgcatcacccaggtcgcctcgccgcggtgattgttcagtgcgcgtgcgatgaattcgagctgcggatgccacggctgccccgtatagacgagataaccgcccggcggcacggcctgcgcgagcccgcgcagcgagcgctcgatcagcgcgttctcgccgaacagttcgtagaggcccgacacgatcgcgagcgtcggacgcggctcgagcgtcgcgagcgacgcctcgtcgaacgcgtcgccgcgctcgaagcgcgcgatcggctcgaggccgcgctgcgcgatcagcacgcgcccggcctcgacgttcggcgggctgtagtcgcgcagcgtgatgtcgtcgggcgccgcgccgtcacgctcggcggccgacgcgatcgcgtcgagcacgtagcgcccgtgcccggccgcgatgtcgacgatccgcaccggcgtgccgtggccgcgcaggcggccgatcgccgcgccgatcagctcctgcagatgcaccttgcgctggcggatgccgacccagcccggcgaatcgagatacgtgcgatcgatcagcgcaccgacgccgagccgcccctgcgcgcggttgcgatacacgtaatcgagcgtcgagcccgaatcgaaaccgagccgcagcccgagcgcgataccgtccgacagcgcgccgccggccttcaggccggctcgcgtgagcgcccagtacgcacgcgcgaacgcattcgcgggcgggcggccgagcgccgcgtattcatcgtggaacgcaccgcgccggtcggcatcggcgagcgacacgcgcgggctcggcgcgtcgaattcgcgcagcacgaatgcgcgcagcggcgcgagcgcctgcgcgcgatcgcgttcgccgagcgtgtcgtgatagaagcccggcagcacgatgcgctccttgcgcgcggcgccgaggcgttcgaagaagcggtcctgcgggccgcgatgcacgacccagtcggcgcccgagatcagcagttgcgtcggcacggtgatcgcggccgcatcggcgacgatccgctgcgcggtgtcgtgcaggtcgagcagcatgttgaccgcgatcggccgcgtgatcagcggatcggacgcataactcgcgatccgctcgggatcgtgcgtgaggaatttcggcttcacgtagctgttcacgtagaacagcccgcgcagcttgtgcatcagccgcaggcccggccgcgcgaacggcacgtagagcttgatgtgaaacgccggcgacgcgaccacgagcgcgcggatcggcggcgcgtagtcgtgcacccaggtggccgcgagcaccgcgccgacgctctggccgaccacggccatgtcctcgatcgcgatgccgtgcgtgtcgcggatatgttcgacgaaggtctgcaggtcgcgtaccgacgcggccgcgctcgggctgtagccgcgtgcgccgggcgagcggccgtggccgcgcgcatcccacgcgaagaacgcgaaatccggcaggtcgagctcgtcgacgagatgcgcgacgcgcgccgaatgttcgtggccgcgatgcagcagcacgatggcgccgcggcagcgcgggcccgttgcgggccagtgacgatagaacagcgtttcgccgtcgtgcgtgatgaagtcggcctcgcgggccaggcgtgcgctcatgcgttttctctcgtttcgttattcgaatcttggtgcgccgccctccggcgcccggtaccgccactgcctttgactgccttgactaccctttcaaccgcccttttccgcgatgccggcctgcacgcgccggaccacggtcacgatcgacagcacgatcagcagccgccacagccatgcggcgacaccgccgactggaaacccgagcccgatccacagcgcgaacgcgccgagggcgagcgcgcggtcgctcttgccgaacgggccgtcgtagcggcggctcacgccgaccagcgggccgatcagccccgcgcattcgacgatcaccgccgtcagcgcgaacagccagacgtctgccggagcgaacgccggaatcgcgagaaacggcagcaccagcgcgacatcggacacgacgtcgccgagttcgttgagatatgcgccgagcgtgcttttctggttgtgctcgcgcgcgagcatcccgtcgatcgcattgagcgccatccgcacgaacagccacagcgggatcagcaggaacagcgcacgggcaaacacgccgagcccggcgagcgcgccgacgacgatcgagccgccggccgcgaacagcgtgacctggttggccgtgacgccgcgctcggcgagcgagttcgcgaacgggcgcagacggttctggaatttgggtttgagtgcgtagaggctcatcgtttcgtattcgttctattcgcgcggcacagtcggacacctttcccgccgccatgccccgggcggcgaaacggccctggacggccttccatggacggccctaatcgtcgccgagcggccccgatgcgtcaagcatgcgcccggcgcgcaagcgcggcgccaatctggcgtttttgacggaaactcgcgataatccgctggcccgagcgcagcacgatccattcgaactgcaaacgggcactcgtgcaacagccgattatcacgccgccgaccggcgcattcgccgcgacgcaacagcgtgtggcggcgaatcgtccgattatcgcgaacctgcgacaggcagccacgaatttgaaaaatttaaacaagggccgtccggcgcgcatcctgccgcgccggcattccgggttccgcccgccgcgcatgcgccgcgggccatgcaggcaggcaggaggcgcgacgccgatgaacatactcaacgtctggcagcgcgacttcctgctgtccatcgtgcggctcgtcgccggcgcgtatccggtctggcatcaggcgccgccgtccccacgcagaagatctacttctcgaaccacacgagccacatcgacacgctcgcgatcctcgccgcgctgccgcgcgacgtgcgcgcggtcgtgcggcccgtcgccgcgcgcgactactgggacagcagcgacgcgaagcgccacatcgcgcagaagctgctgaacgtcgtgctgatcgatcgccaccgggaatccggggcgacccgctcgaccccgtgcgcgacgcgctccggcagggccattcgatcatcatcttcccggaaggcacgcgcggcgccgagatcctgccgcaaccgttcaagagcgggctgttccacctcgcgaccgagtttccggacgtcgcgctcgcgcccgtctatctcgagaacctgcaacggatcatgccgaagggtgcgatctggccggtgccgctgatctgcaaggtgcacttcggcgcgaacgatgcgctcggtgcccaggaagacaagccgacgttcctcgcccgcatgcgcgacgcggtcgtcgcgctcgcgccgccgcagcggccggccggctgaacaccgcccctcctttcccttttccggatatccccatgcgaactctcttctgggaactggtcgcgggcgtcacgggcgtgctcgtcatcgccaccgtgatcggcgcgatcctcggcgcgcgcagcggcggcacgagcgcgaccatcgtcaacctgaaccagcgcatccgtgcgtggtgggcaatgatcgcgatcatggtcatcgcgatcggcctcggcaacaacgtcacgtatctcgtgttcgcggtgctgtcctacctgacgctgcgcgaattcatcacgctcacgccgacgaccgcgagcgaccacacgacgctgttcatcgcgttcttcgtcgcgatccccgtgcaatacctgctgctcgggatcaactggtacgggatgtactcgatcttcgtgcccgtgcacctgttcttcgcgatgtcgctcgtgtcggcgctcacgcaggacacgcgcgaattcctgagccgcaacgcgaagatcaactgggcgctgatggtgtgcgtgtacgggctgagccacgcgccggccgtgctgatcctcgacattccgcgctacacgggacagaacgcgctgctgctgttcttcttcctgctcgtcgtgcagatcagcgacgtgctgcagtatgtcgtcggaaagctgttcgggcgccgcaagatcgcgccgcagctgtcgccgtccaagacgatcgaggggttcgtcggcggcgggctgctcgcgacgctgtgcggcgcgtcgctgtatcgcgtgacgccgttcagtttcggcgccgcgttcgggatctcgctcgcgatcgtgatcgcgggcttcgtcggcggcctcgtgctgtcggccgtcaagcgctcgctcggcaccaaggactggggttcgatgatcgcgggccacggcgggatgctcgatcgcgtcgactcgatctgcttcgccgcgccggtgttcttccacctcgtccggtatctgtacgtgtgacgcgcgggcggcaccgcgccgcccgctccttcgcgcgaacggtcagtatcctgcgcgcaacgccttcggcaccacgtagcggccgcgcgccgcgtcgaacgtcaccgtgtagcgcgcgtgaatcgccttgccgccgcgcgagcccgtttccgtgaccgtcagcggatagacatcgccggtgccggtcgtgtcgggcacgatcgaaaacgtgcggctctcgcaatgcgacttcgcgttcccgcaatcgagcgaccccgtgttgtcgagcgcttcgtcgatgcgcggcgccgcctcggcgatcgcgttgccgaccggcagccagatcgatcgcatcgccatcgtatagccctgcagcgtgacgccgtcgccgatcgtgaagccgaacaggtgcgggccgtaccgctcgatgcgcaccgtacccggctcgccgcgcttgccggacgcgatatccgtcttcttcaccaccggctcgagcgtcttgccgtccgccgcgggcttcagcacgtacaggtcgatggtgcccgtcgtgccgtccgaatccatccccggcatgccgtcctgcacggcggcctcggtctcgccgcacaccgcgagcagataccgcgggccgtcggcggtcgcgacgcgcagcgacccgcacggcgaataaatgaaatcgcccgcgtccgactgccagcccttgcggtccgcgcgccagttgccgtagtggtcatggaggaacgtgcgcagcaggcggtcggccgcgaccagctcgaccgcctgcgccgtcgcgggcagcaccgtcgccggcaccgcacacgcaacggacagcgccaggcgtcgcaacaggggatgaaccgatgaaatcatgtcggcgtcggcgggaacggaatgcggtacgcaaagtaaacggctggcggcatcgacgcgtcaccgaggttgcgcgaccggttcgggatcgaacgccgccagccccggccatgccgcccgcccccacacaccgtccggtgcaagccagcgctgcagcgtggcgtcgtcgaacgccttgccgaacgggtcggcgcgaaacccggccacccactgcttgcggccagcgatatacgcgctaccgaaatccgtccagctgccgaaacaatcctgcgcgcgctgcgcgttgagcaacagcacacgccacgcggtgtccggctcggtccagcccatcagcatcgccacgcgcgcgaggaacgccatccgcgcacaggcgaacgcgagtgcggcacgcgggtcatcggtcggctgcagcgcatgcaggtcggcccgaaaccattgcgtctcgagcacgcgtgcgaggtgcgcacgcgcatcgtcgtccgtcgcgtcggtgcgcaactccatctgatgcagcatctgcgcgcgcaggaacttgcgcgacgtgtcgttcaggtggctcgtatccgcatcgtcgaaacccgagaacccggtcgcctccacgtacggatgcgcgagcagcagcgcccagtgcttgcgggcggacaaggtcgaatggcgcgcaccgcgccggcggaggtagcgcacgatacgccacagcacgaacaacgcgacgatcagcttgaatgtcatggtcttcgccccgtcattcgccggcactggcgccgtgcggcgcgtcatagccgggccagcgcacgttctcggtcgcaaaggcgggacgtgcgtcgtcccgttgcgcggacggcaccgcgggcgccagcgtcgcgcgcaccgcgtaacgcaccgagccggcacgcggcggccgcgcctgcagcagttcgggctgccgcgcggcgaccagccactcgacggtcggcgtcggctcggcgagccgcccgaacaattgcggatggcgcgcgacgagccgtgcttgcgacgcggcatccgtcacgtcctcgatcctgcaccaccccgacgccgtatggaccacgccgagcgcgatgcagtcgggcggcgtgttatccgtcgtccccagcgtattcaggcacgccagcacgtcgtcgacatagcgctcgaccggcggccggttctgcttgcccttgacctgatcgacgtcgaggccgccgtccgcgcgcatcgcgacactgatcgtgatgtgcggctggccgctcgcgtcccggaagctcagcagccgcagcgtgcgcgcctcgatcgcttccgcgtagcgcccgccgtagccgcccgtcagcgcctgccggtcggcgaactggccgaggcaatggcgcatcacgtaactctcgaacgccatttcggcgcgcagcagcgcgctgtcgggcaggaattcgacgaagcggccgttcacggtttcacaccaggtgcgcagcgcatcgggctggctctcgcgccagccgcgcgcgatccgggccgccatctccgcatgctcgcgttcccacatcgcgagcgcctgcgggcaattgacgcggtcgagcttgccctcgagcccggtccccttgcgcgactcgaggaactcgacgagcgtggtttcgagcgcgagaagctgcggatcgcccgggtcgacccagacgacgggcgccagcctgccggcgtcggcctcgccgatcgtcttcgcgtccgcaccgaagcgccgcgcgacccacgccggcggcgcggcgttaccgagcgcctgccgcgcgtcgtcgagcgacccgatcgtgcgtgccggctcgaagttcgcgacgacgtgccggcagaaatggttgagcagccacgcacgcaccgcgtcggcatcgcctcgcgcggtgctgcgcgcggcgatcgccgctttcagcgcatcggcgttcagcgcgttgcgcggcgcatagccggcccgccgaccgacggccgtcattgccagaacttccaccagcgcttgcccggcgcggccgtcgccgggcccgccgccgcaggcggcgcaccggcctcgctgatccgccgctcgatcacgtccatcttcaggtcgagcggttcggcggcgtgccggttgccggcgagcacccgttcgtagaaatatttcgcgtccggctggcggcccagttcgtacgccgcgtcggcggcccggagcagcacgttcagatcgcgcgacgcgtcggcctgcgcacgcgcggcgtcgtacagcgccgatgcctggtccggatgcgactccgacatgtgggccgcgaacacgaggcgggcaatcagtgcctcgtcgggcaacctgccgtcgagctggtcgtgctcgcgctgccagccgacgaggcgctcgagccagatcggcaattcgttgcagcgatcgacgcggtacagcgcgcgcaccacgtcgcgcacgtaccagttcggctcgtgccggctgtaaccgtattcggcggcgtagtgccacagctgctcggcggcttcgagcatctcttcatccttctcctggcacgcgagcacatagcgcaccccgtcgtaatgctcggcaaacgaactcgccgcgatcccgctgcgatgcaggaccagcgcttcgtcgtagcgctcctcgccgcgatagaggatcgcgaggttgttgcagagcatcgaatacaggtgcgcgcacgcatcgtacggatggccgttgcccgtctcgaagaagcgctccatgcaggcgcggccctgctcgtacgcggcgatcttcaggcgctcgagatcggcgcgcaccggcgcctgttccgcggccggcagcgcgtcgatcgcctcctcggccctgtcctcgatcgagcacgcgtagccgtagctccacaagccgctgcgcagcggcggcggcggcagcttcatcgcggcggcgacacccagcgcccgaatgcgcgcatcggtcagcatgaacccggtgcggttgtcgtacatctcgccttcctgcgcggccgcgagcaggcgcgcggcctgggtcgtcgcgtcgatgcggccggtttcgccgtcgtagacggccgcgagccgcgcgatccacggatggccgggcgcgcgccgcagtgcgacctcgcgcgcggcgtcggcgatcgcgtagcgcaacgcgtcgccttcgagcgagccgaacgcggcaaagatctcgccatgggtcggcgaacgcgcggccagcgcgtcgggcccttccgcgccgagttcgacgagccgctcgagcgtcggctggaaacccgctgcgcgcatcgcgcacagcggccaccagaccgacgtgtcggtcggctcggccaggcgcgcatggatgatctgcccgacccggtcgagcatgctgctttcgatctggtacacgtggaagaacgccctgcgccctgcctcgtcgaaacggcccgcctcgagcagccacggcagttcgtattcgatgaagtcgtctccgccgcccgattcgaggctgtggcgcgccatctcgcaacgggccagcgcgcccgcgagatcgccttgcgcgtgtgccgcccgcgcggcgagccgcgccagcctcacctcggcctcgcggcgaggcggcagcgcccagtcggcaatgcgcgactcgacggcctggcgaatggtgtcgaactgcagcggcgcgatctcgatcatcgcccggccgatccgcagccagtcgtcggcgtcgatgtcctggtccgccgctgccgatgccatcgcagccaccgcggcctcggccgccgcacgcgcgtcgtcgtcccggtcgagacgccgcagtgcccacgcgcgcaggcattgccggttcgcctcgtcccacgcgcgaaacgtggcgcggtcggcaatcgcgcggttcagcgcatgccgcagttcgatcgcgtcgagcgcatgctccgcgtggtcgaattcgagcgtatcgagaatgcgggcgcggacgtagcgatcggcatcgagcgtcggcgacgtgcgcaagacgtcgtgcatctggccgatcgcctcggtgacggcgtcgttctcgcccaggtgccgggcgacctgcagccggtatagcgcgagttgcatgcggatgtcgggccgcgcctcgggcgccgcgtcgtgcacgcccgcgccgtcctcgtcgagcaccgcgcgcgcggcggcggatcgccggcgtgcatccacagcgtgtgcaggcgcgcgatcgcgtcgagcgaatcggcacgcaacggctgcgcacgcagtcgtgccgcaaggtcgctctcgcggctcgaatcgctttcctcgagatcggcttcaagccggttcatcagtgtgtcgagcggctggcccgtcagggcatcgtcgtcatatcgatattggaatgggcgtttgtagttgtattggcgctgggagtcatcgacttctccatctcggaatcgcgatagcttatcaggagacggcgaccgtgcgcggcctcgccattcgcgtcgcccggcgttacgatctcgttcttcatccccggacaggtcgatgcgcacggtgcgacggcgcgacgcgcgccgaccggtcccgccgacccggaaaccgcatgaacctcaccttgcaggatgtcgcgtggcatcgttcggtcgggcggctcatcgagtcgctcgaccagccgggcttctggctggcgctgatccggctgatcgaggaatacgtcgcggtcgacagctgggtcgtgctgaccttcggcgacggccgcccgcaggtgttcgccgaatgcccgtacgaaggcggcggccccgacccgctgttccgcgactacgtgcagggcctgtaccagctcgacccgttctacatcgcgaaccgcgacgcgccgaggagcggcctgttccggctgtcggacgtcgcgcccgaatgctttcgcgataccgagtactacacgctctatttcacgcacaacgtcgtcgaggacgaggtgcagttcaacgtcgtgctcgacgatgcgcgcacgctgtgcctgtcgctcggcagcaagcggcgcttcagccccgggcaggttgcgctgctcgacctgatccggccgtgggtggccgcgctgatgcggcagcggctcgcgttcgagcccgcctccgccgagcaggcgccgccgcgccgggccggcgcgcacgatggcttcgagcaggcgatggcgcggctcggcacgcccctcaccgcgcgcgaactcgatgtgatccggctgatcctcagcggccgctcgaacaaggaagtcgcgaacaagctgtcgatttccgccgaaacggtcaaggtgcatcggcgcaacatctacgggaagctcgcgatcaattcgcaatcggaactgttttcactgttcctgaaggcgcagaccgacggatagcgcgctccgtcgcgcccgttttcgctccctgcctgcctctttgcggcggccttcgacggccgcggccggatcatgccgatgccgtcgcggcccggtgcgaacccgcgagcttgaattcgccgaccgtctgcgcgagctgagccgcctgctcgcgcaacagcgcggcggccgcagccgactcctcgacgagggcagcgttctgctgcgtcgagtgatcgagctgcgacacggcctggttcacctgcgcgatcccggtgctctgctcgttcgccgcgaccgtcatttccgcgatcacgctcgtgatgccgcgcacgccctcgacgatctcgtccatcgtcgtgccggccgtcttcacgagccccgatccgccttcgatcttctcgacggacgactggatcaactgcttgatttccctggcggccaccgcgctgcgttgcgcgagcgtgcgcacctcgcccgcgacgaccgcgaagcctcgcccgtgctcgtgcgcgcgcgccgcctcgacggccgcgttcagcgcgaggatgttggtctggaacgcgatgccgtcgatcacgccgatgatgttcgagatctcggccgacgccttcgtgatctcgtccatcgtcgcgaccacctcgctcaccacctcgccgccgcgtacggcaacgcccgacgccgattccgccagccggctcacctgcgtggccgcatcggccgagttgcgcgccgtgccggcgatctcctcgagcgccgccgcggtctcctgcaggctcgatgccgcgtgttcggtgcggctcgacaggtcctggttgccctgcgcgatctccgcgctcgccacgctcacggattcgctgaatccgcgtatctgcagcaggatcgcgctgatcttttcggcgaacaggttgaaggcccgcgcgatctgcgcggcctcgtcgccgccgtcggccggcagccgcttcgtcaggtccccgctcccgctcgcgacgtcggtcagcgcgtcgcgcacgagcagcacgcgcttgaatgccgcgttcgtcaatgcgccgacgagcgccgccgcgacgcaggcgacgacgaggatcgcaatgagcgtcgtcgtcgcgacggcgcgcatgccggccgtcacgtccgaccggtcgagcgccatgacgagcgaccagtccgtcccggcgatcgggcgcgcgcggagcagcttggtcacgccgtccacgtcgatcgccaccggttcggtcgccgtctgcaggccggcgagacgctccggcgtcagttcgggcgacagctcggcggccggcttcatgatcagatcggtcttcgcgcccgcgatcaggcgcccgctcttgtcgaccaggaacgcgaaactcgacggcgtcggatgcatcgacgccacgatcgcgctcgcgcgctccatataaaggctcgccgcgagcacgcccttgagcgtgccgccgcgaacgatcggggcggcgaacgcgaacgcgggcttgccggtcgacgcgtcgcggtacaacgccgtgacgacgagccggccggcgtcgaccgcctgcctgaaccacgggcgcgcggtcggatcgtagccggccgcgagcgggacgttcgaatacgcggtgcgatccggcaggccgagcgtgagcacctggaaaccgcccgatttgccgagcagcgtcagcgccggcagcggatcgccttccccggcgtcagcgtgtccgcgagcgcctgggtctgctgcgcgcggctcgcgacccactcgtcgagcgcgagcgcgtggccggtcaggacggactgcaggttctggtcgatggtcgtgtcgttgtgctgcttgacgacgtagtacacaaggccgcctgtcacggccagggccgtgaccacgatggcgacgcaggtcgccagaatccgggcgcgaatcgatgacagcatgatgacgttgatctccggttgccgcgttgttttcggttggtcaaatgggcactcaaccgtccttaacgaccgcacgcgatgcaacttgaggttcgactggtcagaccggcaaaaaagttgagcccaggccggcgacagtacgcgggatcaataccctgacgggttaacacgccggcgggatgggaaaaccggcggttcggcgcatactcgggcgttccgacgtccaacgttgcggagccggccgcgccggccccgcccaccgaaatcgcccatgaaactgaagctcgacatcgtccagctcgccggtcgcgacggcgacacgcactacaacctgcagcgcacgctcgaagcgatcgcgacctgcgcgccgggcaccgacatcgtgatgtttccggaagcgcagctcaccggcttcctcgatccgtcgaacctggccgaatgcgccgagccgctcgacggcccgagcgtcggcgcggtcatcgcggccgcacgcgcgcgcgacgttgccgtcgtggtcgggctgatcgagaacgacggcggccgcttctacaacaccaccgtgttcgtcacgccggacggcatcgcgctgcgctaccgcaagacgcacctgtgggtgagcgagcacggcgtcgtgctgcccggcgaccgctacgcgacgatcgaatggcacggcgtgcggatcggcctgctgatctgctacgacaacgaattcccgaaaccggccgcgcgctcgccgaactcggcgccgagctgatcctcatcaccgacggcaacatggaaccgtaccgcccggtccaccgcacgtcggcaacggcacgggcgatggagaaccaggtgttcacggtggtcgccaaccgcgtcggcggcagcacgcacgacgtcgtgttcgcgggggcagcctcgcggccgatccgttcggcaacctgatcttcgaggccggcaacggcgaatcgcgccacgcgatcgagctcgatttcgaccagctcgccgcgtcgcgcgcggtttacgactatcgcagggaccagcgcctgcatatcgccggcgaacgtatcgagcatgcggacgggcttcgcgagttgctgattccgtgacggggctcgcccgcccgggcggcgccgtccgtcacgcccgtcacgccggctccggcacctcgatcgccagcagcgccgaactgaccgacttgccgtgcgcgtcgagcgcgagcgagcgcgtgacgccgccaccgagcgcatcgcgcagcacgaaattgaatgccccgagcgccggcagttcgtaccgcacgacgtcgccgtgcacgatacccgcgagccacgccttcaccgcatcggcatccaggtgcgtgcgcagatgatcgtaatggcgcggatcgcggcaaatcaccgacacgttcagcgtattgcccttgtcgccggtgcgcgcatgcgcgagttcacgcagttgcatcatgcctccacgaatgaaaacgacggcgtcacggccgcgcgcggcagcagcaccgactgcacggcgatcacctcgcgcgtcgacttgaacgcgccgccgccgccggccggcccgttcgtatagagcgtctcgacttcattgccgatccgcgccgcttcgccggcgctcgccgcgcggccggccacccgcacacgcacctcggccggctcgccgcgcacggccggcgtcgcgtcgccatacagcgcatcgacgccgatcaggtcgaagcgcagctcggtcgcggcgacgccggtcaatgccagccgctcgcggacgatcccgagcgcgagacgcgcgcgttcgagcgcgcccgggccgccgtacgagatctggccttcgccgatccagccgtcgacatacgccaccgacaccttgagcgtgtcgggccgcgccgtgccgcgcccgcccgtcacgcgcacgcggtccgccgcctcctcggcaacggtgacttgcgtgaaatccgcgacgacgtcgggctgcaggtaccgcaccggatcgtgtatctcgtagagcagctccttgcaggtcgccgcgctcacgcggccgcccgcgtgcggcaccttggtgatcacgaccgagccgtccgccgcgacttcgccgatcggaaacccgagccgcgcgaggttcggcacgtccttgtagccggggtcggcgaaataaccgcccgtcacctgccccgcgcattcgagcaggtggccgacgaccgtcgcggccccgagcgtgtcccagtcgtccatccgccagccgaacgcgtggatcagcggcgcggcgaacagcgacggatcggcgacgcgcccggtcaacacgacgtccgcgccggccgcgagcgcatcgacgatcggcgcggcgccgagatacgcgttcgcggacacgatgcggtcgcgatacgcggcgacgtcgtcgcccgattcctcgaagcgaaacgcgccgcgcagtacgacgtcgagcacgtcgtcgccttcgacggccgcgaccttcagcccggcgacgccgagcgattgcgcgatccgtgcggtgcgccgtgcggccgcccgcggattcgccgcacccatgttcgacacgatgcgcacgccgttcggcacagcaaccggcagcacggcgcgcatccgcgcgtccagcagcgggtcatagccgagcgacgggtcctggcgccgcgcctgctgcgcgatcgcgatcgtgcgctcggccaggcattcgaagacgagatagtcgagctgcccgtgttcggccagctcgacggcgggctcgatccggtcgcccgagtagccggcgcccgcgccgatgcgcacgcgccgttcaggttgctttgctgtcatgtccataccgtcgtcgtccggcgggtgcgccgcctgtgaaaatcaaaagatgcccagcacgacgcacgcgatcgtcatcacgatcgacgcgccgaacagcagcggaaacgtgaacttctggtgctcggccagctcgatgccgcacaggccgacgacgaggaaggtcgcgggcgtcagcgggctgaccgggaaaccggtggtcatctggccgagcagcgcggcctgcccgacctgcacggccggtacgccgagctggccggccacctccgcgatcacgggcagcacgccgaagtagaacgaatcgggatcgaacagcatgctgagcggcatcgacgcgaggccgagcgcgaccgggatgtggccggccatcgacggcggcacgaagccgaccgccgcctgcgccatcgccttcagcatcccgctgccctgcatgatccccgtgaacacgccggccgcgagcaggatgccggccatcatcagcgccgcgcgcgcatgcgcgtcgatgcgcttcctctgcatgtcgacgtccgggtagttcaccatcagcgcgatgcacagcccgaccatgaacatgatcgccggcgggatcttctcgcccatcacgaccatcgtgccgagcacgacgagcgtgagcacgaggttgaaccagaacaggtgcggccggcgcagcgcctgctcgtcgggcgtcagctcgcgggtcggcaacggaatcgacgcatcgtcgcgtgacaggccgagccgcttctcctcgcgccgcccgagccagtacgcgacgccgaacacgaacacgagcccgatcgcctgcaccgggatcagcggattgaacagcgccgacaccggcagatgcagcgaagcggacgcgcggatcatcggccccgtccacggcaggaagttgatgcccgcggccatcgacaccgcggcggccagcacgcgccggtccatcttcagccggtcgtacagcggcagcacggccggaatcgtcacgagaaaacacacggcgcccgagccgtcgaggtggatcagcagcgcgagcagcgtcgtgcccatcacgatgcgcgtcggccgcgtgccgaccgcgcgcaggattcggtcgatgatcgggtcgagcgtgccggcgtcggtgatcgtgccgaaatagaggatcgcgaacacgaacatgccgaccacgggcgcgaggcccttcagcccgtcgacgacgaacttgctggtgtgcagcccgaagccgccgatcagcgatgcggcgatcggcacgatgatcagcgcgacgagcggcgacatccgcttcgacagaatcgcggccagcagcacgacgatcgtgccaagcccgagtaacggcagcatccgtgtctcctaccttgtcttttgttggagacgagcgtaaggtcggcgcagcaatagcacaattgaaatgatttgatcgcagcaatcacgaaccgttatggatctgaatcttcgcgacattcgcgcgttcgtcaccgtcgcgcacgccggcaacttcacgcgcgccgccgcgcgctgcacctgtcgcagccggcgctgaccgtgcagatccgccggctcgaggaaatcgtcggcgcgcgcctgttcgaccgcaacagccgcagcgtcgcgctcacgcagaccgggcgcgagctgctgccgctgctgcagcgttcgctcgacgacatggagcgcgtgctgcgcgacgcgcgcgcgctcggcgaaggcacgagcggcacggtgcggctcgcgtgcctgccgaccttcgcgtccagcgtgctgccggagctgatccagtcgttccggcgcgacgtgccgcgcgcgggcttcgagatccgcgacggcgtcgcgagcctcgtcaccgcgctcgtgcgcaacgaggaagccgatctcggactgacgggcggagacacgttcgatgcgtcgctggaggtgctgtatgcgggcgccgaccggctcgtcgccgtgtgcccgaaggatcatccgctcgcgcgcaagcgccgcgtgagcaccgccgatgtcgcggccgtgccgctcgtgctcaccgcgcagggcacgagcgtgcgcagcgtcgtcgatgccgcgctggacgcggccggctgcacgcccgacatcgcgtgcgagccgacctacatgatgacggccgtcgcgatggtgcgcggcgggctcggcgtgacgatcctgcccgcgaccgcgcgcgaggtgcgcgccgagcccgagctggtggcgaagccgatcgacgatcccgcgttcgtgcggccgatcgcgctcgtcacgaagcgcggccgcacgctgccgcgcgtcgcgcaggcgttcgcggaaaccatgctgacggaattgaaaaagcgcgcgtgatgcccggttcggcttacttcacgtccggatcgacgtgcagcgattcgccgatcgcatagaaattgccgccagcgatgtagtgcaggctgcgcagtgccggatcggccgattcgaaataccagtgaccgtcgcggaacacccgcgtgtcggaccacgccgcgaccacctcgccgatgaacaggtcgtaggtctgctggttgtgcggctcgggaaccagcctgcacgcgagccagcccgagcagccggcgacgaacggcaggtcgtggccttcgacgtcgaacagcgtgacgcccgcctcgcgcagcttgtccggacgctccgcgagactgtggctgccgaccgcgtgcgtgagctgcagttgcgcggccgtcggcacctggatcacgaacgtgccgctgcgctcgacgagctcgcgcgtcttcgcggacttgtcgagcacgaccgtcagcttcggcggcaggaagtccagcgcgcacgcccacgcggcggccatcacgttgtcgacgccgtcgtggcgggccgacaccagcacggtcgggccgtggttgaggagacggtaggctttcttcagctccaccggagcgatgtgactgtccatacggattccctggagaacggcgcgcacggacggatgtcgttcggcgcgcggcgccggccggtgcgcaggtgcgtggccgggccgaaggccgcattctcgcacccaatttcaatcggtgccgacaacgccgccggtcacttcgcgaacaactggccgatatcgcggaacgccttgaattcgagtgcattgccgcacggatcgaacaggaacatcgtcgcctgttcgccgacctgcccctggaagcgcacatacggctcgatcacgaaggtcacgccgaacgatctcagccgctcggccagcgcttcccagctcgcccagtcgagcacgatcccgaaatgcggcaccggcacgtcgtgaccgtcgaccgcgttcgtatgcgcgctttcctgcgatgcggtcttcggatgcgcgtggatcacgagctgatgcccgtagaagtcgaagtcgacccactgcgcgctcgaacgccctccgccagcccgaacacacggccgtagaaatcgcgcgcggccgccaggtcgtagaccgggatcgccaggtgaaacggggaaagactcatggttgcctcgtgatggaacgctcgcgtggcgcgaggacggcaccatggtagtcaaggtcgatcgaaaatcaaatcaatatatagtttcgtcattcacaaacggaattgatgaatgatccgcgaactgaaaaccctcgtcgccgtcgcccgggaaggcacgttcgccgcggccggccaccgtatcgggctcacgcaggcggccgtcagcgcgcagatgcagcgtctcgaagccgagctcggcttcgcgctgttcgaccggcagggccggtcggcgcggctcaacgaaatgggccatcacgtgctcgaccaggcgcaggcgctgctcggcctgtacgagaacctgagctcgacggcccccggctcgccggccgccgtgcgcgtgacgatcggcgcgatcgcgtcggtgcagagcgcgctgctgccggccgcgctcgccgatttccatcgccggcatcccgcgtgccgcacgcgcgtggtaccggggctgtcgatcgagctggtcaatcgggtcgacgcgggcgagatcgacatggccgcgatcatccggccgccgttttcgctgcagagcgacctgcactggacgacgctcgcgcaggagccgttccggctgatcgtgccgcgtggcgtgaaaggcaaggactgggccgaactgctcgcgcgcgaaccgttcgtgcgctacgaccgcgcatcgttcggcgggcgccaggtcgatcgtttcctgaaaagatgcacctcgcggtgcgcgacacgtgtgagctcgacgaactcgacgcgatcgtcaagctggtcggaaacggcgtcggcgtcgcgatcgtcccgcagaccgccgtctatcgccgctggccggccggcgtgcgcgcgatcgacctcggacaccatacgttccaccgcgacatcgggctcgtgcaccgcgcgcggcggacgatgtcggaaccggcgcagcagctcgcgcaactgatcgaagcggcgtcacgacggcgcgcgccgccgcaggcggcatagcgccgacgtcgtcggtcagcgccgcccggccgcccagtcgaccgccgcatcgaacagcgcgacaccggccggcgacaggttcgcgaacgtgtcgttgtcgaggaagaacatcacgcggcgcgccggcgcgagcgcttcgtagtccatcgtcgcgcccttctcgtacgcgaagatcgcggccttgtcgggttggccgtacacggtcgcgatcgtgatcgcgccgagccccggcttgccccagctcatcggcgcctgcttgccgtacacgctggtcgcgccggccgggagcccggccgagatcgggtgtggcgcattgacgagccacaggtagcgttccttgcccgtttcgccgaagtcgacgtcgtgacgcttgcccgtcatcgcgagatcgtctagcaggtcgttttcccacgtgacgagcggcttgtcgagcgtgcgccagccgggccgcacgttcttcgacgacaccgtcgacgagatcacgacgaggtcggcgtcgcgcgccgcgtcgggcgtcgaggactcgtcgatcaggcgcaccgcgtagccgcgttcgccgagatgctggccgatgcgttcgtcgaccttcaggttcgggccgcgcagctgcacgagcatcgcgacgcgcgtgacggcctgcggtgcatcggccgcccgcgcgggcgcagccacccctgccccgaggcccaggcccgcgccgatcgcgagcaccgagcccgcgatcgcgcgcaacgcgcggcgccgcgcaccggcggcaatggcgcgcacggcgccggccttcatgttccggttcatctggatcttctccgaagccgcgcaccgccgtgacggccgcgcggcgattgcgtggtcagaactgcagcgtggtgagcagcgacacctgtcgcgcatcgccgatcgcgacgaaatagcggttcgcgctcgacgggtaataggtgcggttgaagaggttcttcacgttgagctggaacgacagcttctgcttgccgatccgcgtgtcgtaggtcgcgaacgcgtcggcgagcacgtacgacggcagcgtgaagctgttcgccgaatcgccgggccgcgcgccgacgtagcgcacgtccgcgccgatgcgcaggtcgtcgccgccggccagcgtgccgacatcgtagacggccgcgagcgacgccgtatggcgcgcgacgttccacagctggttgcccgcgtaaagcggatcctcggtcgtcttcgcgtcgatgtacgcgtagctcgcgatcacgttcacgcgctcgccgatccggcccgacacgtcgagctcgatcccgcgcgagcgcgccttgcctgacgtgcgccagtcggtcagcttggtcgcgtcgttgtattgcgacacgagcacgttcttcttgtcgatgttgaagagtgccagcgtgcccgtcatcccgcccggcaggtcgagcttgccgcccacttcccacgcggtcgcttcctcgggcggcgtcgcgccgtcgatgatgtagcccgtcatcggcgcgatcgacgaagacggcttcagcgactgcgaatagctgccgtacagcgagaatgtatcggtccacttgtagacgacgcccgcgcgcggcagccacttcgagccgctgagatcggtgttcgcggtgaacggccggccgcgccccgcgacctggttgtacgtgatgtagcgcagcccgcccgacacgatccacttgtcggtcaggtggatcgtgtcctgcacgaacgcggacgcatcgtgcagcgtgtcggtctggtcgctgtcgctcgcggacaccgtgctcgacggcggcagcagcccgtagacgggatcgacatagctgaacggcgtcttcacggcctgccgcagcatgtccttgcggtagatgcgacggtattcggtatcgaagccgacctgcacgtcgtgccgcatcccgccgagcaccagcttgccgttcacgtagccgattccgtagctgtcggtgctgagcgagccgtgcgtcgcatcgttgctgcgcgacagcgtgcccttcaccggatcgacgcccgtcgtgcgcaactggttcgcgtcgtaggtctcgcggttgtagctgtagccgagatgcgcgctccagtccgcgttgaactggtgatcgacgctcagctgcgcgaggtgcgattcgccgtccatgttgttgaacggctcgtcgaggcgccgccgcgcgggaatgtcgagcggcgcgttggtacgcgggtcgagcgccgtgccgcgatcgaacggcgaatggaaggtccggtactggtaggacaccacgacctgcgtatcgcggccgtaccacgcgagcgaggggcgacgaaggtctgccggtattcgccgaagttgcgccagtactgctcgttcgattgatcgacgatcagccggtacgcgagcctcgaatcgccgagcggccccgtcgaatcgaaggtcgcgctgccgccgttcttgccgtgcccgaacgtcgacgcgccgagcgagatcgcgttgtagcgcacgagctgcggctgtttcgtgacgacgttgaccacgccgcccggatccatcagcccgtacagcagcgacgtcggcccttcagcacctcgacgctgtcgaccgccgcgttgaacgcgcgcccctgcacgagcggcatcccgttctgcatgaccgagccgtcgcggttgccgccgaagccgcgcttcatgatcgtgtcctgcgtgcccgcgagcgtgttgccctgcgtgatgccgctgacgttgccgagcgcgtcgtccagattgcgcggacgctggtcgcgcagcacctgcgccggcacgatgttgacggcctgcgcggtgtcgagcagcgggatgtcggaacgcagcacgcccgcctccttcggcgcgcgatagctttcggcgcgcagcgcgctgtcgcgcaccgtgatcgccggcaactcggcgcccgcggccacgccggccgccacgggtcgtgcgaccgtgccgtccgcgcgcttcagcgtgtagccgccgccgggctgccgcaacgcgacgagccccgtgcctgccaacaggcggtcgagcgccccgtcgacgtcgaagcggccctgcacgccgccgctcgtcaggccggccgtcagctcggccggaaacgcgagcaggatgcccgcgtcgcggccgaaccggttcagcgccgcttcgagcggcccggccggaatgtcgaacgcacggcgtgccgcgcgctgcgcggccggcgccgcatcggtgtcggtgtcggccagcgcgggcagcggcagcagcgcggacaccaggacggcaccggcgagacggcgcgcgaggtgcccgggcgcggcaggtgcggccgggtgcgcggcgcgcggcagatgtcggtcgggcgccggacggcgccgatacgtgagacggatggaaaccatgatcgggaagtcggtggacgatgggccagtgctgctttcattacccatgtcacgcgaacatcgagaaacagctcaggtcggcggaaattttttcgacacgctcaggaacgggccggcacgaccgtcgcccagtagcgcgtcaggtagtgcacatcgatcggcaacgtcgccttcagcgtgtcgagcacacgcgcgggatcgtcgagcggataggtacccgacacgcgcaggtcggccacggccgcatcgcagcgcaggctgccgcggcgatagcggtcgagctcggcgacgaggtcggccagccgcatgcgcgacgcgaccagcatgccgcccgtccacgcggacgcatacgcatcgagcggtgcctgcacgccgatcgcatcgcgcgtgaaatccgcgccctcccggccgcgatcacgcgcgcgcctgccgccgcatcgtccggctgcacgcgcacggcaccggcgaacacttctacccgcgtcgcgccgtcgcgctgccgcaccgcgaagcgtgtgccgagcggccgcaactcgccttgcgcggtcgcgacgacgagcggccgcgcgggcacgcgatcgtcgtggccgctcgtcaccatgatcgtgccgcgcagcaggcgcaggcggcgcgcggcggcgtcgaagcgcacgtcgagcgccgtgtcggtatcgaggacgacgaccgtgcgatccgcgagcgtcaccgtgcgccgctcgccgaccgccgttcgcaggtctgccggccagatcgccgcgccgcgcgggctcggccatccatgcggcgccgcccgcgcacagcagcacggccagcgccttcacggccgcgcggcggcggcccgcacgcggcgacagcagcgccgcgtgcgcggcctgcgggtcgagcccggccgtgagcccgcccaatctgtgctgcatcgtttcgatatggcgccatgccgcgtcgtgcgccggatcctccgcgcgccagcgcgcgagcgcggcgtcgaacgcttcgccggtgcggccggcctgccggtcgacccaccattcgaccgcgcgacgcgcaacctgcggcggcaccgccggcgctcccgggcggccatcggtcaggccgccatcgcgaagaaacactgcgtgccggccttcacgagataacgcttcaccgtcgcgagcgacacgccgagttcgcgcgcgatctcggcctgcgtgagcccgtcgagttgcgcgagcaggaacgctcgcttcgccgcgagcggcaggccgtcgagcagccggtcgatttcgagcagcgtctcgagcacgacggcccgctcctccggcgacggcgcatgcgcttcggcgctgcgcgagcgcatcgagatacgcgcgctcgacctgctcgcgccgccagtggttgctcagcacgcgctgcgcgaccgtggtcaggaacgcgcgcggttcgtcggcgccgatcggctcgtcgcgtgcgagcaggcgcatgaaggtgtcgtgcgccagatcggccgcgcggtgcgcgcaaccgagcttccggctcaaccagccgcgcagccacgcgtggtggccggtatagagggcgtcgatttctcgatggagggacagctggtcagcagacatggccgggttccggggtgcgcaggcgtcaacgatcttgtaaatgagaatgattattatatacaagaccggatcgacgaccggcgtgccacgcgcgcaacgacaacgcgacaggaagggagacgccgccgcgatgccgtcacccgacgcgtcgttaacacgttcattacaccgcggccaaatcgattcattaaatagttatttgacggatcgataacaatatccgggccgcctcgacgccccgtcaaatcgatcgagattatcgcgagatatgcaagccggaatggccaaattgcgaaatgacaatcaattgatacgcaattttcaataattcaaatccctcgatcgtcgagactggagcacatccctgtctgcctcaagccacaaaagagaatttcatttttccgttttaatcgcactcggtagtctcctgccattccggatcacgaatacaagccaatgcgcaaggagatgaaatgaaacgcacgaccctctcgctgatttccatcgcgtcattcgcggcgatacctgtcgcgcacgcgcagtcgagcgtcacgctgtatggcgtgatcgacacgtcgatcacctacgtgaaccatgcgcagggcaaggacaacgcgtggatgctcggcaacagcagcgcgggcaacctggccggcagccgcttcggcgtgaaaggcaccgaggatctcggcggcgggctgaaggcgctgttccagctcgagaacggcttcgacccgagcaacggccggcagggccagggcggccgcatgttcggccggcaggcgttcgtcggcctgacgagcgatcgctacggcacgctcacgttcggccgccagtacgatccgctcgtcgatctcgtgcagggtatcaccgccgacaattatctcggcagcgtgttcgcgacgcccggcgacgtcgacaactacgacaacagcttccgcgtcgacaacgcggtgaagtacacgtcggccgtctatgcgggcctgcagttctccgcgatgtattcgttcggcggcatcgccggcagcaccggcgccgcgcaatcgtattcggccgccgtgtcgtacaacaacgggccgttcagcgtcgcgggcggttacttccacgcgaccaacagccccgcgtcgaacgcgctgcgcaacggctggaccagctcgtcggacggcaccttcgacggcccgatcaacaacggctatgcgagcgcgcactcgatcggcatcgcgcgcatcgcgggccagtacgtcgccggcccgttcacgttcggcctcggctacagcaacgcgcagtaccgccgcgacgccagctcggtattcaactcgaacgagcactacaacaccgggcaaggcttcgtgaactaccaggcgacgaacgcgctgctggtcggcgtcggctacagctatacgcgctcgggcggcgacacgtcggccacctatcaccaggtgtcggccggcgcggactacaacctgtcgaagcgcaccgacgtctacctgaccgccgcgtaccagcacgcaagcggccagaccggcgacggcaacggcggctcgatgggcgcgcaggcgtcgatcggttcgtacggctacgcgggcaccagctcgcagacgatggtcaacctcggcctgcgacaccgcttctgatgcaaaacggccggctgtccgccatgcggccggccgaatccgcatcgaccgatacggcggcaccggccgcctgcgtgtttcccgatcgccttttcatcgcccgtttcaccccggatatcggctgcctgccgattttcatccggtttgattcagcaccgatttcctggaacgaatgacgcgatgcgtcagtattccggcgccgccattgcctcggcattcaccgtgaaatccggccatatttaccgataatgcttcgccgcacgccgcgatcggacacgataaaaggcgtgtcgggcgcatgggcaaatgcaaaggaaagtttgacgtgagccatttgcctgctcgctatggcacacttcgcgtctcgcgtaatttccttgcaccgggcgcccggattccgccccatcctgccatgccgcgtcagaccacccgttcgatcagccgagaaacgctgaaaatcgcctcgacgattgcgctgtcgtgcgcgctgcacggtgtcgcgcgggccgattgcctcgacgacgcggccgcgttccagcacgtgagcgtcagcctgatgcgcggcatcgcgcaggtggagtcgggcatgaacccgaacgccgtcaacaccaacacgaacggcacggtcgacatcgggctgatgcagatcaacagcacctggctgccgacgctcgcacgcgaaggcatcacgcgggagagcctgttcgatgcgtgcacgaacgcgtatgtcggcgcgtggatcctgtcgcagaacatccgccagctcggcgccaactggaacgcgatcggcgcgtacaactccgcgtcgcccgacaagcgcctcgcctatgcgcgcaaggtctatgatgcaatccggaccatgccggattcgccggatactcccatgcccatccttccaccgtcctttacgccgccgcaacaggcccaggcgtacaacccgttcgcgagcctgagcgtgtccgccccgcagcaggtcacgcgcccgcgcacgatctcgtcggctccgccgcctgcgcccccgcagggcggccccgccggcccggccggcacgtacaacttcggctggacggtcaccggggcggaccaggccaagccgacccaggtgttcgacgacggcgcgcgggtctacgtgcagttcagcgacatgaagcacctgccggcgatcttcaccgaaacgtcgtcgggccgcgtgctgatgtcgtgggagctgcagttcccgtatgccgtcctgacgcgtcccgcgcaaacgttaatcttccagctcgggccgttcgaggcgcgtgcgcagcgtggcggagccgggacaacggcgcaggcaacggctgcgccgggaacgccgcgttcgggcgcgacggcggcaacggctgccaccgcgccggctgcgaaacagccggctgcgaatgcgtcgaccaggcggaccgcatcgtccgatgcgctctggtacatcgacacggcgtcgacgtcaggttcggccccgaccgcgagtaccgccaatacgtcgacggcatcgcccccgtcgaatacgccggcgacgtggcccaccgcagtgacgtcgaacacgcctccccggttgcgacgcctcaggcgccggccacgacgaagccggccgcgcgcgtcagcaccgacgcgctctggtacatctcgaaataacgcacgggccagccgcgcgtcgccggccggcgtgggtcggcggccggccgactatcgaacgaccgtcgtaccggacggtgcggatacggtcgacaccagcgagtggtacacgtccgcgacgcgatccagaaaggatttgtcgggcgcggtcgcgatcttctgcatcgcccgcgtattcatgtagttcttgatcgacaccaggtggctccacacggcctcgatatcgctctcggccatgctgtcgtgcacgtgcttcacgaacagcggatacatcgcttcgacttgcggcaggcgctcgccaggattgttccacagccagaacagcgcctgcgcctgcgggtcggtattgaacatcgacgccggcaactcgccgtcgagctgcttcatcgcctgcttccgatcgaacccgtatcccgggcgcgtgccgtgctgcttctggtagtcgatttcgcgcaccagcttctcgtaacggccgtacgccagcggattcgccgcgccgccgagccacccggcttgcgctgtgtcgcggccgtgcgattctcggcccggtcgtaccacatgcgcagccactggatgtacacgaccatgtggcccttgagctcgccctggatgtccttcggcaggtcggtcacgacgaccgggcgcggcggcgtccggtcgggcacgcggcaaccgtccgtcatgtcgggcagcggcttcggattgagaaaatcgagcggcccggtcgacggcctgggcgccgccgacggatagccgatgccggcgcccagcggcgacagcggcggaatctcgcgcgtcgtcgccacgagcttcttgacggccacccggtagtcgagctggaaggcctggacctcctgcggcgcgacgatctgctgatacagcgcgccgtcctcgttcgccagcgcggtcaggctcggcattggaatgcccgcgccgtatgcgcggtggtacatcatctcgagcggcaggcgcgcaagcttgtcggaaatgccgtcttcgccttcgatcgcgccgccgcccacgtccacctgcgcgccgggaaagaggcgctcctgccgccggccacgcatgtcggccggatcgacgccgagcatcgtcaacggcttgtacacgcgcagttcatgcgcggccgcgtagtgcacgcatttctcgatgtccggcgacaagatcagatccgacgacaccgcgttgctcaacggaatgtagcccgtcagcaggttgtcgtcgaaacggttcgtcacgcagtcgaacaggcccatgaacttgatcttgaccgccacgccgtcgtacttcccgcccttgcaggtttcctcgagcaaccgtttggcaaaggccagcgcgaggccgccgcccatgtcgtacccgaagatcgcgacatgaatcttgttgatcgtgcccgcctgcttcgcgcccgccacggccgccttgaaatcctcgtccgccgccttcaggcgtgtatcgacgccggtattgaacagcgcagcgccgagcttcgtgtcgcgcgaaagctggaacgactcggccagcgcgccgagcgtttccttgccgacctccttcaggaccgtcttcggaatccggtacggatacttgacgacatcgcgccagaaccctcgccattcgcgcttcaggtaacgcaacgcgcggttcttttccgcccccggccgcgcgaccgctcgctcgagccgcttccgtgcgtcgcccacgccttctttcgccttgtcgaacaccgtgccgaccgtgtcgccgacgcggccgctcagcgtggaattccccttcctgccgctctgcttccacgcgtcctcgaccgtcttcatgcccttctccttggccttgtcgacggtcatctccttgagcttgtcgccggccttttcgccggcggtgtcgagcgccttgtccttcaacacctgccgaagcacgccggcttccgggtcgaaatcggcgccgagccccggatagtagaagcgccgcatgttcttgttcttcttgtcgtatgcggcgttgaacagcttcaggatgttggttcgtggtccttccttgtcgccgaaaccgaatccgtcgaaatagaagctgacccacagcatgtgctcgcatgcggggcacatctgctcggcttccgccctgacgcgatccgtctccgcgcttgcggcatccttcttcaggttgatttcggccatggcgctcacttctcctgggtcggcttgagctcgggtgcgttcatgtcgtcgacccactgcagctcggcggtaccgttcttgcggaaatacacgcgcagatagcgcgacgtcggcgattccggctgcggaatggtcacgtcgatcgtcttgcgctccggctggatgccgcgctgaatgtcggccagcggttgcgcgaattcccagtacagcttcaccttctgccccggcgtcaccttgcagccacacgcaaagccgccgccgccgccgaatgcctcgccgtcctcgcgcgccgccggattgccgaagcacccggacttgtgctcgttgtcgagccagaattcgtgcagcttgcggccgtactcgttgtatccggtgacgcacacgttatgcggctccgccgacacgtcgacgccgtgcttgccgcatgcggcgagcacaccgagcccgaccagcgccaaaacgtgcatccctgccctgaatttcatcgataccctcgcaaacttgcgtcgttgttgccttcaccgcgcgacggcggatcgaaccggttatgtacgtcgtcgccacggacgaacccgttcatcgcgatcgcgacgaacgcgccgacgacgggaattgcatggacgagcgtccaccacccggacttgccgatgtcgtgccagcgccgcaccgacaccgcgaccagcagccagatcatcacgatcgcgaatgcccatccggcaaggtcgacgatcgtctgtgccgccgcgcggcgggcagatcggcgagcgcgtcgaacaccgaaccggcgaccagcaacggcaccgtcacgctccaccattgcatgcgcccggccctgccgcgcaacgaaaacagcgcaggcacgctcatcgctgcgcctcctgttccatcgcggcattcgctgcctcgccatgctcgagcaggcgatccagcaatgcgtcgcacaacgcgtcgtgatcgtgccggtgcgcggcgatgcattcggcgacgctcgcgtcgtcgagccgcacgtggccgaccatcgcgagcgtcgcgccaatccggtaggcgagcctgtcgtcgttcagcccctgtgcatccagcacgcggaacagcgtgagcatacgcgcgtatgtgtcgaacggatccgcgtcggccgggatccggccgttgcgccgcaattcggccagcacggcgtccggccggctgccgcggcgcaacgcgtcgagctcgcgggcgtccacgcgcgcgtagaagatccgctcgtgccggcgcggatgccgcaccgtaccgacggttccatcgcgacacacccaggtccacgacacgcacggcgacaacagcgcctgatagcgcgccccggacagtgcgcctgccagcgtctggaacaccaccgcatcgtagaaccgcagcaggccgtcgcgatcgtcgggcaacgtcacgcgcgtcctgataccaagtttcggtgcgagttcgtcgagcggatagacgctgaccagcgacagaaacgcgaacggccgccgcgcgagctgtcgttcgagcaacgccgacacgtgcggcgcacgatagtcgcacaccagcgcgcagacttccgggttgctcgcttccggctggccggcgagcaggttgtgaacctgtccttgtgcgatcagctcgcgccacggcgccgcgttgatcggcagttgcgaagcatcggccagcagatagcgatgggtatccggaaacgccgcgtgctccgcggcggccgtcgtttcccaggtctgaagcagcgttgtcatcgccgtcacccgcgcgtggcgatcgcttcgtggcgatgcgcgagatcccgcatgcattcgacgcacgcgggcttgttcatcgacggcagctgcacgttcgcggaacgcggcccggtcagcgtgtgctgggccgcatgaaacgtcgccttgccgggcgcgccgatcacgatgtcgttgccttccatcttcaggaacgcgttggcggccgtcagcagcagccgcttcggcgactgcagcgcgacactcgcctgcgcgctcgacaccgtcaccgcgcgctgcgcattggcgtcgagcgtcccggcgttctgcgcctgcacggtgacggcgcccgtcgccgcgtgcagcgcgatgccgacggccggcaccgggcggctgccgcccgaggtgccgtgcgtgtacagcgcgatgccttccttcgcgacgatgctcgacttgccgtggaccgtgacctgcacgtcgcgtcctgcgctcagcgcggtttgcgtgcccgacgtccacacgtggcttcgcgcggtcatcgcgacgacgccggcctcgccgtgcgcgacgagatgcggatgctgccacgcaaccgcaccgccgccgccggcaccgcccgcgccgttgccttcgcgcgtcgcgccgatcgacacctggctctgctgcagccctcgatcgccgcgagcggcgacgcgtcgctcgcgccggcactctcgacaccgggctgcgccgtgctcacacccggctccgcaccctgcttgcgcgcgaaatccgcgagcccctgcagcatctcgcgttgctgcgcgagcacctggctcgccgcgctcgcgtccatctggttcacgcccggcgccgtgctgatcagcaggccggcaccggcgcgcagcgcaccggccgcctgcgtcgacagttcggcgccgtagccgcgatcggccagacgccggttgtcctgcacctgcttgatgtggccgagcgtcaggccgctgtcgtgatcggtcgtgtaaaggcgcgcactcgactggccggccgtatcgtcgagcatgaattgccgcgagccgcccgcgccggtctggctcgcgctcatgtcctgcgtcttgaagccggtcagcacagccgcatggtcgttgccggcaaaccaggccgccgcattggccgtgctgccgctcgggccgcccgcgaacgcattgtgctgcgcgttggcgttgccctgcccgttgtacagcgcggcgaccgcaaccggccggtccggctggccttccagccactcggtccagacttcctgcccgacgcgcggcacgctcacgccgccccagttgtcgccgccgaccggggtcaccatgcgcgtccaggtgccggcgccacgatcggccggcgcattcgccgcgcgcggatgcgcttcgcgactcgcggaattctgcccacgctgcgcgtgatgctggatccgatccggtggtcgcgttcggtgtgaaccgaatcgcccgcgccgaccacgacggttgtctgtgcgcccggcatcaccgcgaccggatgcacgcgcgcaccgtgcccgttcgacgccagcggccgataggcctggtcgaacggcaacgcggcgaagcggttccggtacacctcgttgccgtccaggagcgcgccgccagcgtgcgtcgtggcgtcgattgccgcatgcagcgcctgcgcgccgccgtatccggcggactcgccgggcgcggcgtcgggcatcggcggaatctcgcccagtcgctgcgcgatcgcaccgtgcacgtcggcgcccacgttcgcacgcgcgtcgtgctcgacgcgcaggcacacgaacgtgcgcgatgcatcgagcgacggatgctgcgacatcgcgaagtgcagccccggccgcagatcgcgacgcgtgccgctgccttcggcctgcagcgccgccacgcgctgcgcgtcgagttgctgctgcgcgcgctgttcgccgatcgcggtggtctggaacgcgtacgggccggcgacgtcgcgatcctcgcccggcacgaccgcgccgtccgcgcgcacgccggacggacgggtcgacaggcttcgatgatcccagctggcgcgcgcgacgctgccgatgcgccagcggcgcgcgtgcaggaagtgccggatgccgccgcgcggatcgccgtcgctcgtctggtggaacccgacgacctcgggttcagccgggtcgaaacgctggttcgtatcggcgagaacgagcgtgtgcttgccgaggttcgtcgactgcgcatcgccctcgtgttcgaaccagtagaagatgccctcttccgcccacagacgttcgagaaacgcgaagtccgattcgccggcctgtgcggtcaggctgcggctcgcatatcgcgcaggatcggcgagcgcccagcgccaggccggcgcgaccgcgccacgcgcgtagtgcgcgaaaacctgttcactgatctcgagcacgctcgcgttcacgaagttgtagctgtcgacgcgctgctgcagcagcgcgagccacggttcgacgacgagctgcacgcgcgcgagcccgccgttgtagccgacgagctccgcggccatcacatggccgtggaacgggcgccgtgcgtcctgcccgtcggcggcctgccattcgatcaggatcggcgcaccgatcagcttgtcgagcggcacgtcggggcgctcggtcagcgcggtgacctggaaccggaagccgctgtgatcgagcgactcccatccgtgcaggctcggcgacgagcttgtccgcgccgagcggcgtggtcagccacagaaaccggtcgtgctgcgaccagccgcggaagaacgcctggatgaggtcagattgggtcggcatgatgggtgggttcggggttcgcgggggtacgttcagttcctggagtcgaagcatcgggttacgcattaccgttcggtcaaatcgacgtcggacagtttgtccatccgtatgaatgctttgcctttcatttccaagggcttccgatcgaacgaatatgcgaggaccgatccgacattccggcccggagccgaagcgatctcgttattggccagaatccgctgcatctgctcgatttccggccggtaacgatcgttcagttctcccgtgtatttcccgattcccacatacttcgccggcggcatgagatcaagatccagcccatgcgaatagtaggcgacacgattgccgtcaaacgtgaaacccaatggaggcgcaggcttgatctgccccgggctgctccggatttcgaaatgaccatgctcgtcgcacgcagacgccatgtccatcgcgcaggaagcaatgccaccaacaccaggattcgtataacgcgcatcacgtcagggtcacttcccgtcaggttcacgttttccaaccgattcgtcggcgtgaagatccgtccgtccatttcctgcggacgcaggatgtcgacgttcatcttgccggcgaagacgtaggtgccgggctcgacacggcgcatcggcgaattggcgtcataggtcagatctgcgtaaggcacgaggaattccatcttctcggggtggccaggcttgacgacgatttcgcgccgattacgacgcgatgcgtcgttcagatatttgctgaccagcctgacgtcgaaacccacgagtttgttgccgccgctgatctccatgtattgcacatcgggcctcgccagatctggcgaccaacgatcaggaccgtcgatcgccacatcctgcttgccatcgtttgcgaacgtcacgtcgacgacaagatggtcggcggtggatcgcaccgaaaattccggacgaaaattgatctcgtgcgtaccacgcgccagcagatcgtgggcaaggtcataaagcaccgaaaggttctcgttgaattgatcgtcgaactgatagttgtacgtgccctcgtaatggtggccgtccttgtcgaacgaatagacgagcacggaccccttgttgatttcgcggatctggggattttcctgctgctcaacgtcgccttgaccatatcgacatgctggcgataggttcccgtgagatccgccgtatatttcccgattccgacgtaactcgatggcggcatcgggtcgatgtcccgcccacgcgaaaagtacgacaccgttcgaccatcggccgtgaagaccatcgatggcgaaggattgagctgtccctgtccgctacgaatctcgaaataatccggacgatcatgtgcgagcgtcatttccgccaccccgaaagaaatcgttgacatcaccaggaacaggatcgagcgcttcatttcagcacctcccattcaatcccggttttcttgttgaaccagttgcggaagccgtacatgtagtacttcgcaatttccggcttctccgtgtacaccccggcccatcaagttcgtggggtctcgcgctgccagttgtcgacaagctgggccatcttcacgtcgaccaggtgttgcgagttgatgtatttgccatacaccgacccgccatccaggaaatactcatcgggccagccgaacaggtggccggcctcgtgcacgatcgtatgttgcgttttcagcggcacgtaccgattctcccggccgttccactggacgttcacttcccccagttccccgaatccgcccgggtcgccatcggaaacagattgacctccgcatggcatcgcccaatttgaaccagttcgacttccagtctcagcttgaccttgcatgtacatgcactacccagcgggcattctttcggctgcatcgaatagttccctctattcagcccgtcctcgatgcgcttcttgaagctcgacgatatgggacccagaccacccggccggtccacgatcttaatcaccaggtctttacggtttccatcgctattgaacggcaccgagaacggttttcctgtcgatggatccatgtagacggttccatctttgatccagtactggtccttcaggttgatcttgatatagatcatcgccgttacggtcgccgtcgcgggtgcgtatccgatgtcgtacgaatcctccgtgccggacatattcagccagattcgcttcttgtccttgagtaccgccttgccgtcctctcccgtctggaaatagctgacgcatccggcatcaacggtatgaagctcggtgggaatcgcggggacgtgaagattgcacggcccgctttgcgcagccgggcctttcttcggcatgccttccagttcgctggacaccggcggcggagtcgaataaccgagcgacgggccgggcgccgcattttgtcccgacgaagcgggtaccggtgcaggcatggatcgactcgactcatctgccaacgcctgcgggacaagcggcaagctacctgctcccggagccggcatgtcggccatcaaagccgtcgcgcccgacgctgccccactccatgccgccccgcctgccgcccccgccgcactgcccccgccgccaccgcccctctccccgccgggctcgccgccagcgcctgtacgaggaagtcgcacggatcgccctgcggcaacaccggcagcgccggaagcttcacgctcgcggcgcgcggccccgggaacggatgcccgcccgacttcaccgcgaactgccccggcgtctcgacgatgatgtcgccgcccttcagcgtgatccggttcggcccctgctgcagcacgatcgcatcctgcgcgagcacgtcgacgcgctcgtcggtcgacgtcacgcgcacggtctggtccgcgagaatctccatcgtcgacgcgtgcgcctcgacgctcaccggtccttcgcccgcgatcgccttgagcccgcctgccacgctgtacaggcttactgcatcgcccgtcgccgcggccacggtcgcaccggcgcccacgtgcgcatcgccttgcgacgtcacatgaacatgctgcgccgcatacgacaccgcgctgtccggcgtcgtcaccacgatgttctccggcgactccatcagcaccgcgggtgtcgcgaatcgctcgacgggatcgccgccgtcgcgctgcgtgccgctcggcttggtcgcgctctggccgcccacggtccccgcatacttgccgtcctgcgcaggatcgatcgccttcaggaaatccgtcagcgccgcgttcgcgctcaggccgactgccagcgcgccggtggccgcccggtcaagttcctgcgcggtttttcggcgtccttcaactgcgccacgcgttcggcgacgtccatctgcgtcgacgcaccgaactgacgcgcggtactcgataccagcacgcccgcgccggcccgcacaacgccccagccctgcgtcgccagttcgaaaccttcgccgcgataggcgccgcgcatcgtgccctgctggtcgatcagataaccctgcgcgaggcgcgtgccggcggtcgaattgttcagctcgtggcgcaattgcccggccgcatcgtccatcacccagcggctgcccggttgcccgtcgagcgtttgcgtctgcaggcccgtcagcgatcctgaatgattcgcgtcgctgccttcgccggccgagaacggcggtcgcacccggccgccgtacacctggccgaggacgacgggcgcgtcgatgttgccggactcgaagccgaccaccacctccgcccccacacgcggcgcgaacgcatgaccgaaattcggcccggcggcctgttcggcaacgcggaccaggatgcccgaccgatggtcgcccggcgcatggccggccggattggagcggctcgccgtatcggtcagcccgccaggcagcggcgcgaccccgcgcatccacggaaactggatgcggacctgatgatcgcgcgtgctgctgacgcggccgcccggctcgccgaccacgatcgcggtctgcacgccgtgcaccgtcggccggtcgcgatgcggcggcacgatcggcgtgccttccggcaccgcgacgaagcggttgcgatacaggcccttctcgagctcgccgcgtccgaacagctgcccgatctgcgcgccgagattgttgacggcctcatgctcgatcgacagcggcacgaaccgcacggcgccgctcagataatcgttcagcgtatgcaccctgccgacctcgagcgtgcgcgacgatccgccgccacggtaaacccgtttggcgagctgcaacgcgtcgagacgctgctcggcgtaacgctgcgcgtcgccgctcgtgtcgaagcggccggcacgctggccgtcgtagacctcccgcaccggcagcagcggcgcgtcggcgtcggccggctgctgcgcctggccggccagcgcaacgagctcgctggctttccagctcgtcgccaccacgcgatccggcacgagctgacgccgatcggagaattgcgtcatcacgccgtccggatcgccgacgtcctgcgcattgaatgcgatcgcactgccgtcgggcagccgcgcgtgacggtcgaacacgacgaccgtatgatcgcccgacggtgcgttccccgcgtcctgcccgtgctcgatgcgaaacgacaacccggcttccgacaactgccgcaacacgaaatcgagatcggtttcccgatactggccgcgcaggcggaacgcacgcagcggctcgattcgctcgtagcgccgatgcgcttccgggtaatcgccgaacacctgctcgcagatgccctcgacgtcaagatcgacgaaatacaggcaattgcggcgcagctgcagcagcgcgagccacgattccatcgtgagccggtagcgcgtgaactcgccgtcgctctccgcatacgcggcatgcgtgacgtagccgttccagcagcgctcgcccgccgccgtcgcaaggcgcagccgcacggcgctgccgatcagcggcgcaagatcgagaaacggctcgctcgacagcacgtcgatctcgaaccggaacgattcgctgatcccttcacgaccgtgaaagcgctcgaccacgaatgcccccggcatcgcggtatcgatctggatatggcgggtcgcttgcccgtaccccgttaatgcggcaacaagatccatgtcgtttctcggcaatcgcgcgcgaatgcgtttcgcgtcggctggttcgtatcgaatcggttctgcggtgcaacggcgagcggccgccgcgcgcgggagacagtacgccgcatcattgcgggaacatcccgttcatgttgaccttgtactgcagcatcttgcgctgcgcctccatttcttcctgcacgctcggtacgtggggcgcatcccagcgcacgccgttcacgtagacggtgcgccagcgcaggtaaccccagacgaacgaaaactcgcgtcccgaatcctgcaacgcgagaccgcccgtgacatcgggatcggtcagcacggcactgtcggtcggcgcattcgcgtccttggccgcgcgtgccttctgcgcggcctgctgtgcggcgtcgtagcgcttcaggatatcggcctgccgtgcgctcagcggcgagcgcggttcgggctcctgcaccgcgctgaccccgggcccgagcccgagcgcactcgcgcccatcacctgcatgatctgcgacggccccggcaggccaagttgccgacgcttctgccacgccgcgtgctcgcgctcgaattccgcctgacgggttttcagcgccttgatctggttgtagttccagacgtcgtcgtcgtcgccgagcggcttgaaccacgcgcgcgagtcgtgcatgaagttgtcgtacagcgcgctgatcggcgcctccggcggccccatgttccagtcgcctcgcacctcgagccactgttgccacttctcgtcgagctgcaactggaaaaatcctcggcgcgcttcgcactcgcgcgtaccaccggaccgacgagcggaagcgcggactgcaggccctggacgatcggcagcacggccgggaaatgacggctgccgccttcgggttctgcgtgagcttcttgctgaccgcgttccccgcgtaacgtctcacggtcgggccaccctgcttctcgcactcgagcaggtcgcgccattcgagccgcagttcctcgttcgcgctgtcgagatcgacggcatcctgcgggtacgcggccttggcggccaggaacgatggttgcgtacgcaagttgtcgaggcgcatcctgcgccagcgcaggtacagcccgtagtgcgcgcgcatcaggcccggcgtgccgtgttccctggcgtagtagtagtccgcgctcgttttcacgtaggcggaaaacgcgcgcttgagcgcgggcgaaaccgcaaacgccgcggccgcttcggcggcgacgccgggcccgttgatgtcgagcggaacaccggccttgcgcgcttcgcgatacatgtcgagcagcggtatctgcgacagcttgtccgcatcgcccgtgccacgtccttgctcgcccggtccataaccgccgccgacgtccgaatggacgcccggatagacgatctcctcgcgcccgtcgatcgacgcatcgatcaggtcgagcgggaacgatccgcgcggctcgtgtgcggcgaccatgtggacgcagcggcggatggagtgcggcagccccatcagttccttgcgtccccagccgccgtgcccgtcgaacaacgtcgcggccgtgctttgcgcgatgccgaccgacgcgaccgtatcgaacaggccgagaaagtcgtacgacaccggcacgccgcacaggctgaaatcggcgtcgagcgcatcgttcagccaattcgagaacgtgcgcgcttcggcggcgccgcgcgaaaagccgaacacatacaggcggatgcgctgcagtttcggcttgcccttgaccagcagatcgccgacgcgctccttcagctgcgcgcaacgggcccgcaacgcggcgcgccgcttgtcgtcccacgcgcgcatggtcgcggtccagttcgccgtatcgacttcgcccttgagctgtgcccagatcgtgtcgcgatcccaggtgagttcgatcccgttctgctcggctgccatcagcttgagcgcgccggcgctcgaactgccgcgcgcgttgatgtcgccgagactgcccggcttcggcggcgtgccgccgagatcgatgcccttgaaattcaggtcgacgctgacggccttcgcgagcgccttgtcgctcttgccgagcgccgcggacagcgaattgccgaacgcgtacgcatgcacgacgttgtggatctgcagcagcgcccagttgatgcgccctcgccggcccacccgtcgcggcgcccgccgcggcctgcagcccgacaccctgatcgccgacctcgtcgacgaagggcgtgccgacgcccgccacgtagatggcgctgtgatacttgtcgcgggaaacacgtcgaacaggcgtgcgacgttgctgtgcttgccgccggcgcgatcgcgatcggcgttgttgcgcgtgccgtcgaagaagatgccgacatgcagcgtcttgcagcaactcatcccgtcgtcgtcgtgcaggcggcgcatgatcgcgtcctgctcctccggggtgacgaccgcaacgtcgggccggtcagcgctcgcgaagcggaaactcatggcgtgatcctcttgtcgggattcgggcactgcggatcgccgttgcgcaacgtgaagtgtcccggacacgcttcggcgggcgcctgaagattttcgggaaaaccgcggtagccgggcatccactgcgacgcatagaccttgattcgatcgtgcggaaagaacaggacccacaggaagccatccgagaacgcgtcgtagcgctcgaccggcacgacgcggctcgcgagcgccttcggatccttcctgtacaggttgtcgtcccgccactgcaggttgacggtcaaccccggatgccattgcttcggtaacgcgacgcagcagatgatcgcgccgccgccgctgccgatgcgtgccggaaccgccccgccccaggtgccgtcgacgtagaacgcgccgatcggaacgtcggtgtagttgagggcattcagcttcaagcccatcgtgtcgggctcggccggcgcgctcgatacacccgccacacccgacgccgcaaacgacgcatcggtggcacgcgagcatcctgccgtccccagcaggatggccatgaacatcagcagccgagcggcaaacgtcgtggaaccggcattcagactcatttctcgatcctcttgtccgacgccgtccggcgcggatcgctatcaacagtgtgctccgtcgcatgccgcgccgacacgtccgtgtcgccgttcgcatgcacgcgaacccgcattgttctacgcggacgacgcggcaggcgcccgctccgtcgccagatacccggccgccacgagcgcatcgagcgcgacccgcgacgctgccgcgggcggcccgtcgtgccgcgcccacgccgcgctcacgcacgcatgggcttgcgacggcgttgccagcagccggccgaaactctccggacgctggcggacatgaaaaagcagcgtgtcgatcttcgcggcctgccgcagtcgttcgacctggtccccgtcgagcacgtagggctcgccgctgcgcccggcacccgcttcgccggcggccgcttcgcgcgcggtgtcgacatcgagcgccacgagcgccccggtgcgatcgaacacatgccacgcgtcgatgccgtccgtgaagcggcgacgctgcgcgggcgtgagcgcctcgagccaggccggcaggcaacgcgtatcggcgaaacgcaccaggaacgcttcgccgtcggccgccgcgctcgcctccatctgcccgcgcagatgcgcggcaagcgcgcccgtatcgcgcgcaccgcgcaacaggctcaccatcggacgtccggacgtctcgcacaacacggtcccgagcatcgccgcgcgcgctgccgcgtcggcaggcaacggcgcgaggcacggcgaaatcgccgccaggtcgtcgccgtcgtacacgccttcgtacagcacgacgacggcatcgttgcggtcgaccgcgggcagccggtcacgcagcgccggcgcgaaacccatgtcgagcagcagatgccagcggccgccggccggcgcgcgctcgaacagcgcgttcagccgatccggcgtgtcgtcgggatagcggtcgatccagtcggtcggctcgatcttcatgctcagattgccttgcccgcaagcgcgctgcccgactgcatcgcgtgcagcaggcattcgacgcacaccttctcgggaaactgcggcaatggtgtactcatttgatctgggcccacgaaagcatgctgcgcggcatacacgacgaatttgcccgggcagccgaacgtgacgtcgccgccttcgatcgtcacgtgcgcgccgccgctcaccgcgagatgcaccgtcttcttcgcggcgatctcgacatccgcgctcgcggacgcgaccttcaggtcgtcgcgcgcacgcaggcccagcacgtcgcgctgcgcctgcagcgtcagcccgtccttgccggcgatcatgctcatgccgacgccgtccgcatggctcgcgccgcccagccacccgatgccctgcccgctatgaatgcgcagctgctgcgcggcggcgaggttgaagtcggcaccgctgccgagcgacagcgtttcgccggccgcccattgcagcgcctgcccggcgatcaacccgtgtccgcccgtgcttcgatcccgagcaccgcgtcgcccgtatgcggcagtgcgttgcccgtcgatcgctgcgcggcatcggccgatgcctgtgcgtagccgttcgcgccgaccgtcgtcgcgaagctctgcgcgagcgcgtcgagcggcgcggccttgccgttcagcgacgactggcccgcctgctccacgccgcgctgcgcggcgaacggcagcgtcccgtgcgtatcggcagtcttgtcgaaccggccgaccagcgcggcgtgccgcgcgagcagcgcctgcagcgcggatgcatcgcccgccggctgtgcggcgccggagggcgcataactcgacaccagcaagccgcgcgtcgcacgcatcgcaccgtacgcgtccgagcgcaattcgacgccctggccgcgaaaactgccgagatagttgtcggactgatgacgcagatggccgaggttcagttgcgtcgccgcgtgcgtggtcgccatctgcaggcgccccatgccgtcggaatcgtccgcgaccagttggttgtgaccttgcccgtcgaacccctggctcttgaagcccgacagcgcgccggcgtgattgtggcgatccgtgccgccgccggcgccgtgccacgcggggctcagcccgctcgcgagattgccctgcgcgctcggcgcatggtcgcccgcctgcgtgtagatcgatgcgtcgagcggtttcccggccgcgccgcccggcgaaggcgactcaccgccttcgccgcggccgttgaacaggccgccgagcacgatcggccggtggatcagcccgtggtgaaactgcacgaggacttcatggccgatgcgcggcacctgctgaagaccgtgcccgtcgctcgcgagccgttgaatcgcgcgcgtcggataggtgcccgtatcgtcttcggcctgccagtggaaccggacgcgcaagcgcccctgcgcgtcggcatgcaccggccccgtcgaaccgggctgcgcgctgccggtcggaccgacgacgatcgccgtctgcgcgcccagcgccgtcgcaaccggattgagccgctgcccggtcccgtccgccagcgtgggccgccagacttgcgagcgcggcaccgcatcgaaccggttcgcgtaaccccggcctgcgcttgccggagcacgcgcggatcgagcttcgccgccggcagcggcccgagttgccgctcgatggcttccatgacggtcggcgggagattgttgatcccgacgtgctcgacgtgcgtcagcagaaaatcctcgggcgccgcggcaccgcgcacggcttgccagccggaatcgacgagcttcagcgcgcggccggcgcgcgccgtgcgcagcgtgccgtagccggtccagaaacatgcgcgcgacacgatcgcgtcggcctggcgccgcgccgtgtcttccgcgtcgcgcagggtgtcgaacgcttccggcccgacgtcgtcgtagagctcgcgcgtgccgttcggccggccgagatccgtgctcgcggtggtcgcgcggttcgcgcggtagtcgctgctgatcagcgtgacgcgatcggccgtcagcgacagcgactgcccgatcccgaggatcacgtcgtcggcgtcggtcgctgtcccgctcgagcggcgcggcaccccgccgcgtcgcgccgacgtctcgtcctcggccagttgcgcgctgtcgtcgaagaccagcatcgcatgcccggcgggcgcgtcctcgtcctcgacgaagcagaacccgaggccggcctcggccagcagatgctgcacgaattcgtagtgtgtatgagtgcggtactgcacgcggtacgcgaccggagccagcgcgtcgagacgccggcccgcatccggcgtgaggcgccaccgcgcgatcccggcgtacggcgcgaacaccgtgtcgagcacgtcggcgagcgtctgattcacgaaggttcgctcgtcacgcgcatgcgtgagcgccgcgagccacggcacgatctggagatgatagcgagcgagacctgcgtcgtaaccgatgcactcggcctcggcgacgagtccgctgcgcagcgtcgtcgtgccgttcgcaagcgtggtgcgaatcgcgacacgctgcccgagcatcgcgtcgagatccagtgcgggatccgtcgacagcgcatcgacgttccattgaaagagatcagagagcgattcgcgaccggtccagcgctcgatttgaaatgcagcaagcgcgccggatccgtccagcgaatacaggcgattgaatgcgccgaatagagacgcaaattccttgatgacgctcatgcgattcccgctctctcaggatttgacgtttttaggtgcataggctgcgacgaacacgagacgatgcatgattgcctgcatcgcgatcgccacgcccaaccggcaggaaacacacggaattccccagcactgtctggtacgggcacctgccccgccatcaggcggaacgcacgccagtcggccgaatggatgcgcccctttttctgaagcttactattttaaattacacagtcagactccgctacaggcaaacacctgataaaaacgcgagaccttgacgtacgggcttcacacacgataatggctgctttcagttcgacagctacctgactattcaatcgaatcaggcaattattgccgaaaggtaataaatacctgattcagtcgaaatagattcgaaaagcgtcgtcgatgacatccgggatcgggaaatccggatgcagcgacgacgatcccgcaaggaggcccatccgtatgacccaacccttcatcgtccttggcgacaagcacagccatggcggcaccgtgaccagtgcatccacgctgtcgtcggtcgacggtcgcggcatcgctcgccgcaacgacacggtgacgtgtccggtgcacggcccaaatcacatcgtcgacggcgacgacacgatgatcgtgcaaggcgaaggcgtcgcacgcgacggctacaagacggcctgcggcgccgtgctggtcgcgagcaaaacggcaggcagtgacggcaactgacacacgacgtcggcaagtcacggggaatcgacggaaatgatcacggggttgcgcaaaacggcattcgtcgccgcgctattcgtcgcggtgtgggtcgccgtgttcgtctggtggaagacgacccgacatgcaccgaccaccagggacctcctgctatacgggctcgtgctgccggcggcgctcgccgtttgcgtggcatggttgcgccgggggctcggccagggctcggcacccgcggcggccgcaccggcgacgtcgtccgcgtcgaaggacgcgacggccacgcaggatgccgagtcgcacacgtggtctgccctgctgctcgacagcagcgtccggctgccgacgggtgcgacgaccgcggaaatcgatgcggcggcccgggaagggcatcccgtcgcgcttcaccccaaactgcaacgcccggacggaaccggcgtattcgccagcacggtcgattcggtgtcgcccgaccggttcgatgcaagcctcctcgcgccgggcacgcaggaaactctgcgggacgaacactggcgcgggctgctgctggccgccgatgcgctcgacgaattgcgcgagcggcatgccgtgctgtccggcgcggacgcgtcgccgctcaggctccacctgctgatgccggaccgctggcaaccggtcgccgcaacgctcgccgcatggctcgatgcgcacacggcacgggaagccgtcgcgccgggcatcgttcgcgcgcaactgcgcacggtcgccgatcccgtacaagcgtgggcggtcatcgacgaactgatccaggcgttgcacctgcaaccgtccgccgatctgcacgtcgtgctcgcattcgactccaccgcaagccaggatgccgtcgacgcgctggaccgcacgggccggctctacggccgcgatcggccggacggcgtaacgcctggcgaaggcgcatgcgcgctgctgctcgctcatcccgacgccccgcatgcgacgcccgcgccgtcgctccatcgcatcgcttccgcgcgccgcgcgggttccgccgatcacggcaaggccgaatcgacgacgctcgggcagctgctcaccgctgcgagtacacgcttgtcgatgctgcatcccgacctgacggcgcccggattcgtcaccgacgccgatcagcgcggcagtcgtcgcaccgaagtcgtgacggtcggcgaacagacctggggcgacgaggccgccgagcgcagccgccacctcgggctcgccaacggcgcaagcggcgcggcactcgcgctggcggcgctggcggtcgccgccgatcgcgcgacggaggagcggcaagcggtattcgcggcatcggtcagcgatccgctcgcacgcggcgtgatgctcgtcacccccgcgacgacggccgacaccgccgctcccgcgcggcaatccgggacggccaccgcataaccggacgcagcggccgaatccctcacccgcgccgcacccagatcaccttgccgtcgcgaatgccgaggtcgcgtcgctcctggcgatagtccatcgtgcccggcagcgatttgccgtcgcgctcgagcacgcgccacaggcagccgtcgagcagcgcggccgcatcggcctcggtttttccgaccagcgcgtcgtccggcgcggcgtccgccttgcacgtgctcgtggcgcccgacggcgcggggttcatcaccgcgccgccggcggtggcgttggggtgcttcgtgttcatgtccgcacatcctgcaaaggttgcgctcgcaacgagtgcaacgagtatcgcgatcgtgttcttcatcggtttctccctgtcgcgccccggtgcgccgtgtacggccttcgtgcacggcccggcgtcgcatgaatgatcggtgccgcgcgccgccgaccgttcctcgacgaaggccggccggcgcatgtcggcggtgacgcgatacggtccggccgtggcggcgaaccgggtcgcaagtccggcacggcgccggacccgcctgcatgttaccgcacgcgatttgccgcgacggctgcaacaccgacgccgacgcccgcgcgtacggcatgcgcgcgccggcaactcactcagaacttgtaggtcacgcccgcgatgccgtaatagttgctgcgcgactggacgatcggactgtcaccgtagcgaccaagcaagcgcgtcacgcccccgtcgcgagcaccgaccagtgctgcgacagcgtccagttccacgcgatcgccatcgacgcgctgtcgatcccgccgctcgtcgaatacggccggaaccggctcgtcatcgactgtgcgtcggtcacgccgtagaacgtctgcgtgtagcgccccgagcccgcgtgcacggttcccgtcacgatgatctcgtgctgcgaggtcttgaacacgggcaccgcgagatccacgtgccccgacacgccgcgcgacgtatgcgtcaccggtgtgtcgatcgtgacgctcagctccgccgcgttgaagagcgtcacgcccgcgcgcacgcccaccagcaccgagcccggaatccggcccatgcccttcaggtagtcggagcccggcatgtcgaagcggttctcgtccgcacggcccgcgtcgtagctcacggccgccgacaggaacacaccgtgcggcaggtcgagccggtagccggcgccctcggtgctgtcgatgaagaagccgttaccgaacttcgcggaaagccccggcgcaacgacgccgcggtactggttgctgcccgggtagcgcggtgcgaaaccgccgccaagcgacagcgaatactggttttccgcgtgggcggcggcggcgagggtcaggccggcgagcggcatgcaatagcggtagcggcgaagtattgggcgcacaatattgagatagaagtgacggagcccgcagtctaggtgccgccctgcgccgagactgtcctgaatcttcggagaatctgtgctcaattgtgtttgattgttcgagattgtcgtaccgctccccggcgttcggtgcgccggatagaatctgcgggccgcgccgcaccccggcttgccacggcttgagatggcgcgcgcatcctgaggagaccatgaacgaagatccgctcaaataccgcgtactgctgatcgaggacgacgaccgcctcgcgcagctcgtccgcgaatacctcgacagctatgaattcgcggtgacggtcgtccggcgcggcgacctcgccgtcgcggcggtgcgcgagcaccagccggccctcgtgatactcgacctgatgctgccgaacctcgacgggatggaagtctgccggcgcatccgcgcgttcaccaacgtgcccgtgctgatcctgaccgcgcgcgcggacgtctacgaccaggtcgcgggcctcgagacgggcgccgacgactacgtgacgaagccgatcgagccgcgcgtgctggtcgcgcgcgcccgcgcgctgctgcgccgtgcgcagccggccgccgccgacacgcccgtggccgcccccgaagcgctcgtgttcggcgagctggcgatctcgccgccgaaccgcaccgtgacctggcgcggcgagccggtcgacctcaagactgccgagttcaacctgctgctgattctcgcgcgcgcggccggcaccgtgctgagccgcgacgacatcctgaagcagctgcgcgggatcgagttcgacggactcgaccgctcggtcgattccggcatctcgaagctgcgccgccgcttcgaggatgcgtcgtcggagccgcacaagatcaagacgatctggggccgcggctacctgttcagcccttccgcgtgggacgaataaatgctgcgcccgttgatcaggctgtacctcgtcgtgatcctgttcgtcgtcgcgtcgatcctgttcatccagttgtcgttcgaccggatcttctacgaacgcagcgcacaggcgcagcgcgactcgctgacgacctatgcgttcgtgctcaacgactacctcgaacgccatccgggcggacagcgcgcactcgcgctgcgcgagctcgcgagacacggcaacgaaggattcggcttcctgtcgatgaccgccgcccgtgcgcagttgagcggcgcgccgctgcgcgacctcgatgcgggccggatcgcgatcagctacaacggcaaggattactacatgccgctcgcggacggtactgtcctgcatgcgcggccgatcgaagcgtccgatctcgacatcaagatctatgcgtacctgctgctcgcgctcggcacgctgttcgcggtggtgctgtggatccactatcactggcgcgacctgcgcaagctgcaggatgccgcccgcgcattcggcaccggcacgctgtcgacgcgcgtgaagctgtcgggcaagtcgaacatcgacgaactgtcgcaacagttcaacgacatggccgagcgcatcgaggcatcgatcaagcagcagcgcgaaatgatgcacggcatctcgcacgaactgaagacgccgctcgcgcggctcgagttcgggctcgcgctgctcgccgagcccggtgaaactggccggatgcgcgaacgccgcgacgcgctgcgccgcgacgtgcgcgaactcgacgagctcgtcaccgagctgctgacgatcggccggctcgaacagggcgcgagccagctcgcaccgatggaagtcgtcgtcgacgcgctgatcgacagcgtggccggcaacgtctcgaacgatatcgccgatcgcggcatctcgctcgacgtatcgacgctcggtgcccccgcgacccacgtgtgcgacccgaagctggttgcccgcgcgttgctgaacctgatccgcaacggcgcgcgctatgcatcgcgcaccgtgctgctcgccgccgccagcgacgcgtccggcgcactcgtgctgagcgtcgacgacgacggccccggcattccggccgccgaacgcgcccgcgtgttcgaaccgttccagcggctcgactccagccgcgaccggcaaaccggcggcttcgggctcgggctcgcgatcgtgaggcgcgtcgcgcaggtgcacggcggcgacgtgcggctcgaggattcaccgctcggcggcgcacgcttcgtgatcacgctgcccgtgcgaacgctgccggacaacctgttcgacgtgccggataccctcgcgcagggcgacgcattcggccgcggcacgggcatggccatcccgcggcaatgacgcgcgcggcaggcgccctcgcctgagcgcccgccgccggtgcacacgcgttgctcagcggcggcgcaacagcgcgacgaagaacaggctgccgaacatcgcggtcacgatcccgatcggcagatcctccggcgccgcgagcgtgcgggccgccacatcggcccacacgagcaggatcgcgccggtcagcgcggcaaccggcagcagcctgccatgctcggcaccgacgacgcggcggcacagatgcggcgtcaccagcccgacgaagccgatcgccccgctcaccgccaccatcgcaccggtcgcgaacgacgcgacgacgaacacctcgcgccgcatccgcgcgctcggcaccccgagtgcggccgcggccacgtcgcccgacatcagcgcattcagttcgcgccggcgcgcgtacagcgcgccgccggcaagcaccgcgcatgcggccggcaccggcagcagatcccagcgcgcaagcccgacgccgccgagcatccagaacagcaccgacgacgcggcgcgctgatcgccgagatacagcagcaggttgccgaacgcagccatcatgaacgacaccgatacgcccgcgagcagcagccggtccgattcgagccggccgcgccggtaagcgagcgcgatgacacaggcggtcgccgcgagcgcgcccgcgaaggcggcagccgacagcgtgaacgggccgagtgccgcgccggccagcacggtgaccgcgacggcgccgagcatcgcgcccgcgctcacgccgagcaggtgcggatcggccaggcggttcgcggtcgccgcctgcaacgcgacgccgaccgctgccagcgtcgcgccgacgatcgcggcgagcagcgcgcgcggcatccggatcagccagacgatgctgtcgtcgcccgctcccgccgcgaacgcgccggcctcgccaaacgccggcacgatgtgcgtggcgacgatccgcaccgccgcccgcatcgcgatcggcgccggaccgaacgcggccgatacgacgatcgacacgaccagcagcagcgccagcgccggaagcactgtacgcatgccgggccgcgcagcacgcacgtgcccgctcatcgcgccggcccggcgaacgcggccggatacagcgcgcgcgccagcgtctcgacggccgcgacgttctcggggcccggcgtcgccgcatcgtagggaatcacgacgaagcgccggtcgcgaatggcggccacgcgcgcgagcgacggctggctcagcaggaactgctgcttctgcgcggccgtcacggccgaatagtcgacgatcacgatcacctgcggatcgcgcgcgaccacgctttcccagctcacctgcgtccagctgcgcggcaggtcggccatcacgttgcgcgccccggccgccgtcagcagcgcggtcggcatcgcgagcgcgccggccgtcatcggcttgtcggtgccgctgtcgtagacgaacacgcgcagcggcgccggacgcccgatcgcgcgcgacaccgccgcgagacgcgcgcgcatcgcagccacgacctgcgcggcgcgcgcgtcgacaccgaagatccggccgagattgttcaggtcgcggaacacgtcgtcgaacgacgcggccgtctgcttcatcacgtgcgagcacgattcggtcagctcgtaagtccggatgccgaacggcgcgagggtcgccggcgtcaccgcgccgccgacatgcatcccgtagttccagcccgcgagatagaagtcggcacgcgcggccgccagcacctcgagcgacggatactggctcgcgagttcgggcacgccgcgcagcgcgtcgcgcacgcgcgcggtgcccgtcttccagccgccgatgccggtgtagccgacgagccggtccttcaggccgagcacgagcatcatctcggtcaggttcacgtcgttgctcaccgcgcgcgtcggcgcgcggtcgaacgtcacgtcgcgatcgcaactgcgcacggtgacgggataggcacccgcatgcgcggccgcgcagccgagcagggtcgcggcaaccaggcggcggaatacggacgacgacgcagactgcaacgcggagggcaggacaggaaacggcatggcggtcattccggatgaagcggcgtgatgcgcggccgacccgtgaccggatggcgatcgacgagcgcgacgacgccgaacacgtcgcgcagcagcgcttcggtcagcacgtcggccggcgcgcccgatgcgacgaccctgccgtgcgcgagcacgtggagccggtcgcaatacgcggccgcgagattgagatcgtgaatcgtggcgagcgtcgcgatgccgaggcgccgcacgcgcgcgagcagttcgagctgatgacgcaggtcgagatggttggtcggttcgtcgagcagcagcagttcgggctgctgcgcgagcgcacgagccagcagcgcgcgttgcttctcgccgcccgacagcgacgcgaagcgttgcgcgcggcgctcgacgaggccgacgtcgtgcagtgcggattcgacgatccggcgatcgtccgccgtctccgcgtcgaacggccgcttgtgcggcgtgcgccccatgccgaccagttcgtcgaccgtcagcccgaaatcgtcgggcgtctcctgctgcagcaccgcgatgcgctgcgcgaccgcacgcggccgcatgcgccacacgtcctgcgcgtcgagtgcgacacggcccgcatcgggccgcgcgtaacggaacacgcagcgcagcaggctcgtcttgccgctgccgttcgggccgaccagcccgacgaactcgccgtcggccacgctcagcgtcaccgaatcgagcacggcgatcgcgccgccgggagaccagctcacgcgttcgatgtcgagcatgtgcgccacgggaggctcgccgcgccgcactagaagcgcatcgtcgcgacgagctccgccgagcgcgacgggccgagcagccattgctcgccgccgttcgacgtcgtcaccgcgtacgtgcggttcgcgagattgcgcaggtacagcgcgagctcggtgcgcgacgtcggctgccagcgcagcgacgcatcgaacaccgtgtacgacggcacctgtatgcggttcgcgtcgtcgccgtacgtcgcgccgacgtaacgcatgcctgcattcgcctgccagcgctcggcaaacgcccagccgagccacaggttcgccgtctgctgcggcacgttggccggcgcattgccggcgcgcgacaccgtcgcgctgccgaccttctcgttgaacgcgtcatagcgcgcgcgcagcagcgcgacgttcgcgtcgaccatccagccgtgcggcagccgcgcgccgcccgtcagctcgataccgcgcgacgattgccggccgacctgccggcgcagcgcgggattgaacggatcggtgctgagcaggttgcgcttcgtgatgtcgtacaccgcgaaggtccagtaggcgcggccgtcgagcagcgtctgcttgacgccggcctcccactgttcgccggtggcgagccggtagttcgcctgcgacgcggacagcgtcaacagcgagccgaggccctccgcgcctgtcgtgtactgcgcataggcgctgagcgtcggcgcgacttcgaacacgaagcccgtgcgccagccgacgttcgcgaagcgcttgtcgaagccggcgccgctcgccgcctgctcgcggctgaacgcgatgtggtcgtagcgcaggccgctcacccacgcgagccgcggcagcacgtcgagccggttctcggcgaacaccgctgcctgccgcgcccgcgtgctgaactgcggcaccgtcgggtcggggctcgtgaacacacctggatcgaaaccgtgcgcgggcaccgtcgattcgccgccgtacggcgaattgttggtgccgctgaacgtgacctggctgaattccgtgccgacgacgaagcggttcgcgcggccgaacagcgtaccgtcgaagcgtgcgctcagccgatcgccgatctgccgctggtgatggccgatgtccagatagtcgccgcgcgtgacgagacccgtcgcggtgtcgagcgcatacgcttcggcattgcgccagtggcggttcgacgtcaggtagtagagctggttgtcgattgtcacgccggccgtcggccggtagcgggccgacaggcgcgtccactggtcgtagtaggcaatcgtcgcatcgccgacgttgtagttgagcttgcgcagcgacggatcgagcacgccgttcggtgccggcacgccgtggtaggtcgccggcatctgccgaccgtagtcgaagtcgagcgtcagcgtgagcttcgggctcacatcgaacttcaacgcgccgccgacggccgtcgtatgcgtatcggcccgctcggcgaggccgttcgcgcgtgcatcgctcgcgtagaagcgatacgacagcctcgggcccagcgcgcccgtcgtatcgaacgcaaagcgcttcgcgccgtcggggccgacgccggcctgcagcgtcgtctcgcgcgtgcgctgcggtcgcttcggcaccacgttgacgacgccgccgatcgccccctcgccatacagcaccgacgccgggccgcgcagcacctcgatgcgctcgaccgaccacgtgtcgaacgggaaggtgatcgtgccggccgccggcatcagccgcacgccgtcgagcagcgtcatcaccgattcctgcccgctgaagccgcgcacgctcaatgcggtgccgccggtaccgggcgccatcgcgctcgcgaaccccgcggtgcgcgtcaccgcatcgagcaccgtgcgatcgccgcgcgcctcgatcgtgccggccgtgaccgactcgacgctcgccggcgtatcgagacttgccagcccgagccgcgagcccgtctcgagcggttgcgtcagcgggtcggccggtgcggatcgcgcgctgacgttgatcgccggcagcgcatggcggtcgtcgggtgcaggtgcggccgcttccgcggcaagcgcggcggacgtcgccatcgcgcaccccacccaggttgcgcaaccatacgcggcacgcgagcgccatccccgtcgcaccggcgcgagccggcgtgcagccgcgcgtcgcgcgcccgcatgtgtttcgtcttcgtcacttcgtatcggtcttcgtgtggtttcgtcgcacgtggcttgcccgacagcctcggacggccgttgatccaaacgtcggatgatacgttatatcaatttatcccgtcagggttttgtcaggatccgtgggccagcacgcccggcttatggctggaacccgtgacaggtcgccgcggcagcatcactggataaatcggccggtacgccggctcacgtgtcgacgacacgaccgcgtcggccgccggaaagccagtccgcccgatgcatgccgctttcgacgccgcgatgcaaacgcaatcgcaaaagcgcaccagctctcgtcgacctgccgctcgcgaatacgcgacaaccgtcgcgttgcatgacgtcccggtcgcaccggagaaacggctatcggccgatgcgctgttcgcattcgatcgtggcgccctggccgatatcctggccggcggtcgtgccgacatccgccggatcgcggccacgccgagcgccaagcgtctccgtcgggattgcgacttcggcacacgcagacgaccgctacgacccgccgccgcgcccatgacgcgcgccgcgaccggccggcgcaacggcgccgcctagatcggaaaactgaactgcacccacagcttgtcgccctgcggccggttgcgcaccgcgaactcgtgctggtatttcacgaccacgcccgacgccggcccccacatgtaacgcagctgcgggccgatcgcgaccgactgcccgcgaaaaccgtccgacgcgaccttgacgccgtcctgcatatcgtcggtgaactgcttcaggaacgtgccctgcacgccgacctgcacgcgccggtcgatcgaatagccgaccaggtaatcgagcacggccaccgcacccgagtggtaccgcgtcgcatggttcggcgaattcagctccagcagcgtggtcgtcgagatctcccagtcgcggcccggaaaccaggtcgtgctgacgtacggcaggaacgcatacgtgttcaaccccgtgttcgcgatccggttcgccgcatacgcgccgctcggcaccgcgaacgacggcgagaagaacgcgaagaaggtcttcgatgcgttcgcgtagttgatcatcaacggctcgaggatcacgtcaccgagcgacgtgcggtttcccgtaccgcccggcgtcgacagatgcaggtgcacgatcggtacgatcgcgctgctcgacagcgagaacggcccgaacgtcgcgccccaggtgtggaccacgcgcggcgtttccgcgacgacgctcagatggaaccccggcaccgtgctgccgccgtccggcccggcaaaccggttcgataccgagtacagcgcgtagttgaagtactgcgtgttgccgggcggcggaagcagcccgttcagcacggtgttgacgccgaacggatagctgatctgcccgttctccgtggccaacgccggaacctgcatggcgccggcgatcaggaatgccaagggtacccgtcgcaaggtgaatttcatgtcgtctccagaccggattgttatcgtgtcatcgcgtgccgggcatcgcaggcccgggagacgcaatgtaaagcgcacgacagcggcgaaaaagacgaccttcaggagaacagttcttcgttacacggagaaatgcgcggcggcgcggcgacggcccgcgatcagcggccgacttccttccatttgcgcgcgagcccgaggcgttcgaaacgctcgatcaggaactcggtgaagacgcggatcttcgccggctggtgacggcggctctggtacgcgatgttgacggtgagcgccggcagttgccagtcggtgagcaccggcaccagctttcccgcgacgatatcgtcgtggatgatgtagagcggctggatcaggatgccgagcccggcaagcgccgccgcgcggatcacctgcccttcgttcgcatcgagcacgctcctgatcgtgaccgactgcttcttcgcgccgcggcggaaatgcagcacgtacgggtcgttcgcgaggttgtagaccagcaaccggtggtcgcacagcgcatcgggcgtcgccggcgcgccgtgcttcgccagatacccgggcgacgcggccagcacgcgccgtgtctcggcgagcttgcgcacggtgatgcccgaatccgcttcatgctcgcgcgtgcggatcgccacgtcgatgcccgcctcgatgaaatcggggtagcggttcgccgcgatgatctgcacgttcaggttcgggtagcgtcggtgaaactccggcaacgccggcgcgatatagatcgacgcgaacgatacggaagcggtcacgcgcagcgtgccggccggattgacgctcgtttcgttgaccgccgcatcggcctccgacagctccgtcaggatcgcgacgcagcgccggtggtattcgtgccccgcgtcggtcagccacaggcggcgcgtggtccgctcgacgagccgcgccccagccgctcctccagcgcattcaggcagcggctcgccgccgcactcgacatgccgagccgctcggcggccttcgacaggctccccagctcggcgacctgcacgaaaaattcgatctgcgtccacttgtccatgcgttggattcttccacttggcggagaacaaaactcctccaaaccatctttttacgatccgggaggaattaatgttacgtcaacgcgccatccaacgacatcaggagacaaccccatgcgcaatctcaacgaagacaccatcacgcaggccgtgatcgcatcgctctccggctgtcgcgacgagcggctgcgcacggtcatgaccagtctcgtccagcacctgcattcgtttgcgcgggagacccgactcaccgaggccgaatggcaggccgcgatcggcttcctgaccgcggtcgggcacatcaccgacgacaagcgccaggaattcatcctgctttccgacgtgctcgggctgtcgaccctcgtcaccgcgcagaaccatgcgaaaccggccggctgcacggaagcgaccgtattcggcccgttctatgtcgacggcagccccgagttcgcgatgttcgacgacatcgcgaacggcgcatgcggcgagccctgtttcgtatccggccacgtgcgcggcatcgacggcatgccggtcgcgcacgcgtcgctggaagtctggcaagccgacgaggacgggcactacgacgtccagcttccggccgacgacggttcggtcacgcatcgcgcgcgcggccggctgcgcaccggcgccgacggccgttacgcgttccgctcgatcctcgccgaaccgtatccgattccgcacgacggccccgtcggcgccatgctcgacgcgctcggccgccatccgtggcgccccgctcacctgcatttcatgatcgcggcgcgcggttacgaaacgctgatcacgcacgtgtttcgcgacggcgaccgttatctcgactccgacgcggtattcggcgtacggtcgacgctcgtcgccgactgggtgcggcacgcgcccggcatcgcgccggacggttcgcgcatggacacgccgttctacacgctcgattacgacttcgtgctcaatcccgcagggcgcggcgcgtgatccggcacgtcgtgatgtggaacgtcgcaggcgaaaccgacagcgaacgcgcggcggcacgcgccagcgtgaagcgtgcattcgaaagcctgcgcggccggattccaggcatgacgcacctcgaggtcggcgcggatttcagcgcagccgattacgcgtgcgacctgattctcgtcgccgaattcgagtcgcgcgaagcgctcgacggatacgcgacgcatcctgaacacgcacgcgtacgcgactcattggccggcctgcgcatcgcgcgccaccaggtcgactacgcaatggagtggtgacgacatgaatttcatttaccaggcacgccctgcacgcgtgatcttcggcgcaggcagcctcgaccatctcgaacgcgaagtgctggaactgggcgcgcagcgtgcgttcgtgctctgcacgccggagcagcgcgacctcgcgcaacacatcgtcgagcggctcggcgcgcgcgcggccgggttgtacgatcgcgcgacaatgcacgtgccgatcgaaatcgcccgcgatgcgcaggcgttcgcccggtcgtgcggtgcggattgcgcgatcgcgatcggcggcggctcgacgatcggcctcggcaaggcgatcgcgctcgaaagcagcctgcctatcctcgccatcccgacgacgtatgcgggcagcgagatgaccccgatctacggcctgacggaaggcggcatcaagcgcacgggctccgacgcgcgcgtcctgccgaaaacggtgatctacgatcccgcgctcaccgtcacgctgcccgtcgagctgtccgtgacgagcgggctcaatgcgatcgcgcacgcagcggaaggcctctacgcgaacaacgcgaacccggtgatgagcctcgtcgccgaagaagggattcgcgcgctggcgcgcggcctgcccggcgtgcgccgcaacaccgccgatctcggcgcacgcagcgacgcgctttacggcgcatggctgtgcgggatggtgctcggcaatgtcggcatggcgctgcatcacaagctctgtcatacgctcggcggcagcttcaacctgccgcacgcgccgacccatacggtcgtgctgccgcatgcgctcgcgtacaacgcggcgcacgcgccggacgcgatgcagcgcatcgcccgcgcgatcggcacgaacgacgcggcgcgcggcctctacgcactggcgctcgacaacggcgcgcccgtctcgttgaaggcgatcggcatgcaggaagccgacctcgatcgcgcggccgatctcgcggccgccaatccgtactggaaccctcgcccgatcgaacgcgacggcctgcgcgcgctgctgcaggacgcgttcgacggcaacctgcccggctcgaccgcgcgctgaatcgaacacacgacaaaccaacaaataccaccgtcaaggagacaccccacatgaataccgaatcgagcgcgcacggcgacagcaccgtcgaacactgcgacgtcgcgatcgtcggctacggcccgaccggcctcgtcgccgcatcgatgctgggccgcgctggccatcgcgcgatcgtcctcgaacgctggccgacgccctacggcctgccgcgcctcacgcatatcgacggcgaaaccgcgcgcatcgtgcaggccagtgccgacgtcgatcacgcgctgcgcaacgcgaaggccgtcgacacctaccactactgcgacgcgaacggcgacctgctgctcgaactgaactggaccggccgcgcatgcggctatcccgcgcacatctcgatctaccagcccgacatcgaggacgcgatcgatgcacgcgccagtgccttcaggaacgtgacgatcctgcgcggctgggaagtcgacgcgctgcggcaggacgacgacggcgtgacgctgaccgcgcatccgtcccgctgcggccaggacgcgcaatggaccgacaggccgcgcgtcattcgcgcgcgctacgtgatcggcgccgacggcgcgaacagcctcgtgcgccgcacgctcggcatcgaacgctccgatttcggctgcaacgaacgctggctcaatctcgattcggaaaacaagcgcgatctcggcgacggctgcgcgcgcacgacgatctactgcgatccggcgcgcgcgtacatgcacatgccgatcggcacgaagcgcacgcgtttcgagctgcgcgtgctgccgaacgaatcgacggccgaatgggaaacggaagaagccggctggaagtggctcaacgaccactacggctacggcccggacgacctgacgctgctgcggcacgtcgtctacacgttcgagacgcgcatggccgaacgctggcgcgacggccgcgtgctgctcgcgggcgatgcggcgcacacgatgatgccgtacatgggacaaggcgcgtgctccggcatgcgcgacggcatcaacctcgcgtggaagctcgacctggtgctgaccgggcgcgcgtccgccgacctgctcgacacctatgaagccgagcgccgcccgcacgtgacggcgatcacgcagatgtcgctgtttctcgggcaggtcgtcaacgaggacgatccgcgcaaggtcgccgagcgcgacgcggcgttccgctccggcaacatgccgccgatgccgccgttcccgaagctcggccacggcatcgtgcacgcgcaagccgacggcacgctgctgccgacgacgggtgcaccggccccgcaaggccgcgcgcgtcgcggcgcggccgagggccgtttcgacgacgtggtcggccagggtttccagctcgtcacgcgcgagcatcctgcccgccatctcgacgacgcgcagcgcgcattcctcgcgcagctcggctgtcacgtggccgtgctggccgacgacgtgtgcgcgccggatgccgtggtcgatctcgacggcgagcagcacgcgttcatgcacgcgcacggcatcgccgcgtatatcaagcggcccgatttcatcgtgttcggttcggtaagcgacctgcgcgatctcggcgcgctcgtcgacgcgctgcgcgccgcactgcactggtccgccgtttcgagcgagcctgccgcggcttcggcaacttcggcggcttcgccagccgtcacccacgcatcgtgaaggagaccgacgcatgacgaccgaactgtcaccgttcgcgctgtcgctgcagcgcgcgatgcccgtcacgcgcctgctcgattgcgggatggactacgcggacgcaaccgcgctgcacgcccgcacatccaacggcgaaccgtgggacgtcgcggccgaagcgctggccgacgcgcagctcgcgcgcgccgcgcaggcggcggatgccggccatcttgtcacggccgccgacgcgcaggcgatggccatcgcgaacctgctgttcgcgcagatggcgttcaaccacgacgtgccgcgcaagcgcgcgctttatgcgcggctcgtcgacgcgtcgcacggcctcgcgcgctggtccgacaagcgcatcgaacgtgtcgaagtgccgttcggcgatgcgcgcctgatcggctggctggtgcggccgccggcggaacgcgtacgcggcaccgtgatcgtgttcggcggccagagcggctggggcttcgcgtactggccgatcgcgcgcgcactcgcggcacgcggcctcgccacgctgctcgccgaggggccgggccagggcgagacgcggctcgagcagcggatcttcgtcgacgtcgacatgagcgccgcctatcggcgcttcgtcgatcacgtcgccgatcatgtgcccgggccgatcggtatctggggaacagcatcggcgggttgtgggcagcgtcgactgccgcgaatgaccgacggatcgcggcctgttgcgtgaacggcgcgctcgcggcgccgacgctgctgccgttccgcacgttcgtcgagcaggccgcggcgatgctcggcaacgacgatcccgatgccgtggcggcgaacttcgcgcggatgcgtttctcgtccgaacgcgaccgtatcgcgtgtccgctgctggtgctgcacggcggcgaagatccgctgatccggatcgacgatcaacagccgtttctcgatgccgcgacgtccggcgatgcgacgctcaaggtctggccggacggcgaacacacgatctacaaccacgcgtccgagcgcaccgcgctcgtctgcgactggttcgccgagcggctcgcgcgagcggcagccgtgtgaacacgcacgcggtgccggccatgccgacggtcgacaccgcgcgtggcatccggcatgacgacgtcgcaccgccgcctgccgcgacgccgtcgatttccacgtgcgtgaagccgtacttcgccatccgctcacgatggccggccgaaccgggacacgcgcgcagttacgcggtcatcgtccgcttcaaccgccaaccttgaacgccggcaactgctgcccgagtcgcgcacccatttccgtaccgagcgcctgcagcgcattgaacggccggaccatcacttcgaattccacgatccgcccttcttcgtcgaagcggatcatgtcgatccccttcagcgccttgtcgccgacgctcgcgctgaattccagcaccacgctcaggccgtcgtcggtgacgaactggcggtaatagacgaaattctcgaggatcgtgatcaccgtgcgcagcgccatcaacagcgcgggcgccggcccgtacggcttgaacgccatcggcgaacggaacaccgcatccgggtgaacgatcgattcgagcgcactgaaatccttgttgtcgatcatcgcgtgccacacgtcgagcgatttcgcgacagcgggatgaacttgcagcggtgagtgtgtcatcagaagtctcctgactcatcggacggaaaagaaacgaatcggcatcaaagcgtcgcggccagcgtcgtgccctggtgaatcgcacgcttcgcatcgagttcggcggcctcgtatgcgccgccgatcagatgcacgcggcatccggcggcctgcagttgctccgccagttcgcgcgacggctcctgccccgcgcagatcaccacgttgtccaccggcagcgtctgttcgacgccgtcgatcgtcacgtgcaatccttcgtcgtcgatgcgacggtacgtcaccgccgacgacatgccgacgccgcgcgccttcagcgccgtgcggtggatccacccggtggtcttgccgagcccgtcgccgatcttcgatgccttgcgctgcagcagatgcacctgccgcgcggccggctcgggttgcgcacggcccagcccgccggcactcgcatacgatcgatcgacgccccattcgttgaagaaccggtccgcgtccgcctgttcgccgccatcgcgatgaaccagatattccgcgacgtcgaaaccgatgccgccggcgccgacgatcgcgacgctgcggcccacggccttgtcgtcgcgcagcacgtcgagataaccgagcgtcttcggatgcccgacgccgtcgatcggcggcgtgcgcggcacaatgcccgtcgcgatcaccacctcgtcgaattcgccctgcagcagcatctcggcgctcgcgcgcgtattgacatgcagtgtgatcccgcgcaactcgatctgccggcggaagtaacgcagcgtttcgttgaactcctccttgccgggcaccttcttcgcgatgttgaactggccgccgatctcggcacccgcttcgtacagcgtcaccgcgtgaccgcgctcggccgccgtgaccgcgaaaccgagtcccgccgggccggcaccgaccaccgcgatgcgcttgcgctgccgtgcggggcggatcacgagctcggtttcgtggcaggcgcgcggattcacgaggcaggacgtaatcctgccgctgaacgtatggtcgaggcacgcctggttgcagccgatgcacgtgttgatttcgtccgcgcgcccttcccgcgccttgcgcacgaattcggcgtcggcgaggaatggccgcgccatcgacaccatgtcgcaatagccgtcggcgagcagctgttcggcgacttccggcgtgttgatccggttggtcgccacgagcgggatgccgaccttgcccatcaattgccgcgtgacccatgcgtacgcggcgcgcggcaccttggtcgcgatggtcggaatgcgcgcctcatgccagccgatgccggtattgaggatcgtcgcaccggccgcctcgatcgcctgcgcgagccggatcacctcgtcgagcgtcgagccgccttcgacgagatcgagcatcgacagccggtagatgacgatgaagttcttgcccacccgctcgcgcacgcgccgcacgatctcgaccgcgaaacggatgcgattctcgtaggcgccgccccacgcgtcgtcgcgatggttcgtgcgcgcggcaatgaactcgttgatcaggtagccctcggaccccatgatctcgacaccgtcgtagcccgcatgctgcgcaagcgccgcgcatcggacgaaatcggcgatcgtctcgtcgacttcgtcgccactcaacgcatgcggcgtgaaccggttgatcggcgctttcagcgcactgggcgcggcgagcgccgggtgatatgcgtagcgcccgaagtggaggatctgcagcgcgatcctgccgccctccgcatgcaccgcgcgcgtcacgacacgatggcgttcggcttccgcttcggtcgtcagcatcgcgccgcccggcgccgggcggccgcgctcgttcggcgcgaaaccacccgtgacgatcagtccggcctcgcctcgcgcgcgctccgcatagaacgccgccattcgctcgaatccgtgcggcgcttcctcaaggccgacgtgcatcgaccccatcaggacgcggttcctgagcgacgtgaagcccagttcgagcggggtcgtcaaatgcggatagcgggatgccatcgagtgtctccatttttatgcaacaagttgcacagatggtagttcaccgcgttcgtttacgcaacaagttgcataaacgtggcccgtggcttgtactgtggccccgatatggcaagatgcggttcattccgctgcctccgccgaaccgacatgtccctgcctcacgcactcctcaccgcgctcgccgaacgtcccggttcggggtccgagctcgccgaccgcttcgatcgctcgatcggctatttctggcaggccacgcaccagcagatctaccgcgaactggggcgcctcgaggaaacgggctggatcgaatcgctgcccgccgaatcggggcgcggccgcaagcgcgcgtaccggatcctgccggccggcaaaggaacttcggcgctggatcgccgaaccggaagatccgacgccgctgcgcgaagcgttgatggtgcgcctgcgcgcggaagcggtgctcgggccggccggcctcgaggacgaaatcaggcggcgcatcgcgcttcaccaggaaaagctcgacctgtatctgcagatcgaggcgcgcgattttcgacgcccgacgattcacgcacgaagcgtctgcagcatctggtgctgcaggccggcattgcgaacgagcggttctgggtcgagttttcgcagcatgcgctcgacacgctgcgcctgccgaaggactgaaccgggttcgcgcggcggccgccggcacggctgcaccggtgttgcaccggcgcacgcggtcgtcgcggcgcgcttcgcgccgcgacgcgccataccgtagtcacgcgtccggcagaatcaccaccttgcccttcacctgccggttcgccatccgcgcgatcgcgtcggtcgcaccagccagcgacacgcgttcggtgatcgcgggccgcaccttgccggccgagaaccattcggccagcaagcgcatgttcgcgacatgctgcgccgggtcgcggcgcaccgcgtcgccccagaacacgccgaggatgtcgcgctccttgagcagcgcgaggttcagcgcaatcttcgggatctcgccggccgcgaacccgacgacgaggaaccggccgcgccacgcggtcgcgcgcagcgccgcctcggtgtatgcaccgcccaccggatcgtagacgacgtcggcgccgcgcccgcccgtcagttcgtccacacggcggcgcaggtcttcggttgcatagtcgatcgtttcgtccgcgccggcttcacggcacagtgcgagcttgtccgcgctcgacgccgccgcgatcacgcgcgcgccgagcgccttcgcgatctcgatcgcggcgagcccgaccccgcccgccgcgcccagcacgagcagcgtctcgcccgcctgcagccgcgcgcgctgctgcaatgcatgcagcgacgtgccgtatgcgagcacgagcgccgcgccctgctcgaacgtcatccccggcggcaacggcgcgatctggtgcgcatcggccacacactgctgcgcgaacccgccgtgccccgtgaacgcgaccaccgaatcgccgggccgccacgcggtaacgccctcgccgaccgcgtcgatcacgccggcaaactcggcgcccggcgaaaacggcagcgccggcttcacctgatacaacccctggacgatcagcgcgtcgggaaaattgagcgacgcggccttcacctggacccggacctggccggccgccggttcgggaatctcgacgtcttcgatgcgcaagctgtcgatcgggccaaatgcggtacacaacagggctttcatgcgcttctctctccttgcgcggcacggccgcgcatcgatgcggtttgcgggatgttcccgcgcgcccggttcaagacgcatgtgcgatggccatccgagccggccttcgcgacatcgtcagtattccggaatgtcggtgcggccacgttcagaaccacgcgtcgcgcatgtcgagcgtcgtcgtgtcgacgctcgacagcagatcgagctgtgcgtccactttcggcaattcccagcggaagaagtagcgggcggccgcgcgcttgccgtcgcggaaatcgccggtttgcccgtgcgcggcgagcgtcacgtcgagccacagccacgcgacgacgagatggccgaacgcttccagatagacactcgcgttcgcgagccgcgcctgctgatcgccgatcgcgccgagctgtcgagtgacgtcgatcagccgcgaccagcgctgcgccagcgcatcggcctgctctcgcaggcccgcgtcgagcgtccgcgcgcgttcgacgctcgcgccgattctcccgtcgagcgcgtgcagcagtgcgccatcgtcctgcgcgaccttgcggcccagcaggtcgagcgcctggattccgtgcgtgccttcgtgtatcgggttgagccgattgtcgcgatagagccgctcgaccgcgtaatcgcgcgtgtagccgtaaccgccgtgcacctggatcgcgaggtcgttcgccgcgagacaccactgcgacggccagcttttcgcgatcggcgtcaggatgtcgagcagccgctcggcctgggcgcgcacggtcgcgtcgtcgtgcgcgcgcgcttcgtcgaccagcttcgcgcagtacaggatcagcgcgagaccgccttcgacataggccttctgcgcgagcagcatgcgccgcacgtccggatgctcgacgatcggcgcctgcggcgcggcggcatccttgcccgccggccccagcggacgcccttgaggccggttccgcgcgtagtcgagcgcgtgcagataacccgtgtagccgagcgccaccgcgcccgcgccgacaccgatgcgcgcctcgttcatcatgtggaacatgtacgcgaggccgtggttcggctggccgaccagataaccgatcgcacccgcccgcccttccggccggtagcgcgtgccttcgccgaagttcagcaggcagttggtggtgccgcggtagcccatcttgtggttcagcccggcaagcaccacatcgttgtgctcgccctgcgcggcgccgtcggtaccgggcaggtacttgggcacgatgaacagcgagatgccgcgcgtgccgggcagcagccggccgtgttcgtcggggatcttcgcgagcacgagatggacgatgttctccgtcaactcgtgttcgccgcccgagatccacatcttgttgccggtcagccggtagcgcgggccgagcggcgagtcgcactcgaaatccgcgcgcgtggcgatgtcggacagcgacgaaccggcttgcggctcggacaggcacatggtgccgaagtagcgcccttccagctccgggcgcgcgaacgcgtcgatctgcgcggggtgccatgcgcgacaagcaggttcgcgttggcgacggtcaggaacggataggcggcggtcgcgatgttcgcggcctggaagaacaggaacgacgcggcttcgaccagcttcggcaagcgcatgccgccgagcgcttcgtcgtggcccgcggcgatcagcccggcgtccgcgaaggcgcgcacggccggttcgacgtcggggatcagcgtcacgcgctcgccgtcgaagtgcggctcctcgcgatcgcctcgtgccgcatgcggcgcgaacaggtcttcggcaatccgctcgctggtatcgagcaccgcgtcgaaggtctcgcgactgtgctccgcgtagcgcggcagcgcgacgagcgcctccgcatcgagccagtcgtacaacaggaacgcgagatcgcgtcgcgacatcaacaagctcatcgtgctgcctcccgggggccggcttcgtcagccgaatgaagggttccgtgattgcgaatgctggcaggaatttagcacggtcgttcgcaaacaacaacgacggatgtgctagtccgcgtaccccggattgcgccgatcgagccggcgcagcagcccgggccagacgagcgcgccggcccccatgccgcgcgtcaccgcggcgatctgctgcttgatgccgtcgagaatcggctgtgcgaccggcaacagcgcggtgccgccggcctgcgcgcgcacctggatcatgcaggccgcttcgaagaagtacatcgcgacgaacgcgtctgccggcgtcgccccgacggtcagcaggccgtggttgcgcagcatcaggttcgtgtgggcgccgaggtcgcgcacgaggcgcgccttttcgccttcgttgagcgcaatgccctcgtagtcgtgatagccgagcgacgccagcacgccgagcgactgctgcgacagcggcaacaacccgcccgcctgcgccgacacggcgacgccgttgatcgaatgcgtatgcatcacgcacagcgcatcgtcgcgggccgcgtgcaccgcgctgtggatggtgaagccggccgggttgatctcgtacggcgattcggacaccttgcgtccttcgagatccaccttcaccagcgacgatgccgtgatctcgtcgaacatcatgccgtacgggttgatcaggaaatgatgctccgggccggggacgcgcgcggaaatatgggtgaacacgagatcgtcccagccgaacagcgcggtgaggcggtaagccgccgccaggttgactcgcgcgtcccattcggtggggaaaccgcctgcttcacgctgacatcggacgaggccatgtcgacactccttgttcaaggatggaagcgtaccgggccgcacgatacggcccggcccgggattgcgtcaccccgcgcggggcttcgcgagctgatcggcaaccggcaggctgcggatgcgcgtgccggtcgccgcgaagatcgcattggtcagcgcgggcgcgacgggcggcaggcccggctcgcccacgccgccgagcggtgtcgcgaaatcgtcgggcgcgacgagatgcacgcggatttcacgcggcgcctcgttcattctcagcacctggaacccgttgaagttgctctgctccggatggccgtccttgaacgtgatctcgccgtgcagcgcgatgccgagccccatcaccaccgctccctcgagctgcgagcgtacgcgctccggattgacctgcggcccgcagtcgatcgcgatgtcgacccgcggcaccgtgatcttgccgtcggcatcgacctgcacctcgcacaccgccgccgatacgacacgaagctgcgatgcgcggcgatcccgagcccgtgccccttcggcagcttgcgcccccagcccgcctcgcgcgcgaccgtctcgaccacgcgtcgcagccgcccggtgtcgaccggatacagcgccggatcctcgccgtagttcacgttcttcaccgtgatgtgcggctcgaaacgccgcgcgggcccgatcagttcgagcaggaaatccttcgggtcgcggccggccgcgtgcgccagctccgacacgaaactctggattccgaacgcatgcgggatgttgtagaccgagcggaaccagccgatccgcgtgtgcgcctgcgcggccgggttctcgatccgcacgttcgggatcgcgaacggcaggtccgcgatcccctgcgcgagctcgcccggctgctcgtgcacgatgccggccctgaaggtcgactggatcgacggcgcaaccgtgcgatgctgccacgcgaccactttccccgacgcatcgatcccgccgtcgaacgcttcgagcgacacggcatggaagtagtcgtgcgcgaggtcgtcctcgcgcgtgaacgtcagcttgacgggcgcgccgaccgccttcgacagcagcgccgcctccaccacgtagtcgggcttcgacttgcggccgaaaccgccgccgagcagcgtcacgttgaccgtcacgcgctcgcccggcaacccgagcgccttcgcgacctcgtcgcgcgtggtctgcggcgcctgcgtgcaggtccacacttcgcatcggccgtccgccacgcgcgcgacggccgcgggcggctccatcgtcgcgtgcgcgagatgcgggatgtagtaggtcgcacgcacgcgtttcgcggcgccggccagcgccgccgccgcgtcgccgtcgttgcggatcacgtcgcccggttgcgaggcagccgcttcgagcgtcttccgatacgcggccgagtcgtagttcgcattgggcccgtgcttccagtcgatcttcagttgcgcgcgtgcctggatcgccgtccacgtgtcgcgcgcgacgacggccacgccgccgagcggctggaagccggacggcagcggcgtcggcgcgagcggcacgaccttgacgacgcccggcagcttctccgccgccgacgcgtcgaacgacgccaccgtgtccccgtaggccggcgggcgcgcgacgaccgcgtacagcatgccgtcgagccgcgtgtcgatcccgtagtgcgcacggcccgcgacgatgtcgcgtccgtcgatcaatgccgtttggcccttgccgatatagcggaattcggctggcgctttcagcggcacggttgccggatcgggtgccggcaacgcggccgctttcgccgccagttcgccgaagccgagcttgcgtccgctcttcgtgtcgacgacctcatgcacggttgccttgacctgccgcgcatcgacgccccacgccgcggcggcagcctgttcgagcatcgtgcgcgccgccgcgcccgcgcgacgcaacgcggcgaagctctggcgcaggctgcgcgagccgtctgtattctggttgccgtagcgcggctcgtcgccgacggcctgtgcgaccttcacgcgcgcccagtccgcgcccagttcgtccgccaccacgagcgcgacgctcgtgcgcacccctgccccatctcggagcggatgcaggtcacggtgaccgtgccatcgggtgcgatcgcgacgaacaggtgcggatcgtctcgcaacccgtgcggcattcccgcgccgccgtatcgcggatctgcactgacgggcggctggaccggcgcggccgcacgcacgagcgacggcacgccgaacgcgagcagcaacccgccggacgcgaagccgagcagcagcgcgcgacggctttcgttatggacggagagttcgggcgcgctcatgcggcacctccgcggcgcacggccaggcggatcgccgcgcgtatgcgcgtgtaggtgccgcagcggcagatgttgccggacatcgcatcgtcgatgtcggcgtcggtcggatggggattcgtcttcagcaacgacgcggcctgcatgatctgcccggactggcagtagccgcactgcgcgacgttcagttcctgccacgcctgctgcagcggatgggtcagatcggtcgacaagccctcgatcgtcgtcacgcgcttgccggaagcggccgcgaccggggtgatgcacgaccggatcgcgacgccgtcgacgtgcacggtgcacgcgccgcacagtgccatcccgcagccgaacttggtgccggtgtggccgagaacatcgcgcagataccagagcaacggcatgtcgggattgccgtcgaagtgttgctcgctaccgttgacggtcagcgtgatcatcgttcacctcctggttgcgatgcccgcttcgggcaggcatcgggtggggattcgaacggcgcggcgcacattccgaacaaccaggcagggcgccgtgtcgtaggccgcgttgcctgcaggcacggcccggcagatgctgcaaacgatgctgcggcccggttgcctgcgcaacatggcaacgaattcccggccgctcgctcgtccgcatggatcgccgatccgcattatcgaaccatttcggatttgccgtcggatcgggggattcgggcgtttcaggtaatcggagcgggaaatttgcccggagatggcgtgccgcgaccggtcacgcttgccggaaaggtgggcgggtgattcaggtttcgatgtttcgatgcacggccgcaggtggttcactctcgttcttgcacggcgactggccacgttcgccgggcgctgcggtgccgcggtagcaaagccggacgaccagacccgccctgtgcaatcagcgggccgagaaaccggaaatgatcgagcgcgcaaacgcaaacgtccggccggcctcccggccggaccggatcatcccgcgattgcaacgagcggttcagacgctagcgcgccgcgatgctcaccgcgacctcaacgcctgcaaccccagcgtgagcgcgttgaacggcatttccgccgcccccatcgaaaagctcgtcgccttcgtgggtacgcccgagttccgcatcagcgcgtgaacgatccgctcgctcgcatgaccgtcgccgtacggattgctcgcgcgcgccatctccccgtaagcgctctcgctgtcgaacagccgcgacgcttcccacacgatccgctcctgatcggtaccgacgagccgcgcggtaccggcctggatcgcctcgggccgctccgttgtctcgcgcgtgacgagcaccggcttgcccaacgcgggcccttcttcctgaatgccgcccgaatcggtgatgatgaaatgcgcacgcgacatcaggaatacgaacgacaggtattcctgcggctcgatcaggtagatgttcggcaggtttccgagccgggcgcgcgccggctcccgcacgttcggattcatgtgcagcggatagacgaactgggcgtcgggatagcgcttcgcgagcgcgcacagcgcatcgcagaaattctggaacggctcgccgaaactttcgcggcgatggcccgtgatcagcaccatgcgccgcgacggctcgagaaacggaaactgtcccgcgaccttctccgtcagcgccgtcgtgcagtccagcatgcgcttgacctcgtgcagcgcatcgatcacggtattgccggtcagcacgaccgccgcgcccggcacgccctcgctgagcaggttgtcgcgtgcctgcccggtcggcgcgaaatgccacgacgataccgcgtcggtcacgcggcggttcaactcctccggccacggcgaccagatgtcgccgctgcgcaagccggcctccacatgcccgaccggcaaatagcggtagaacgccgccagactgaccgcgagcgtggtcgtcgtatcgccgtgcaccagcacgacgtccgggcgcaactcgtcgaagacgacgccgattgcctgcagaatgccggtcgtcacgtcggtcagcgtctggctttgccgcatcacgttgagatcgtagtcgggcttgatgtcgaacagcgtcagcacctgatcgagcatttcgcggtgctgcgcggtcacgcataccctggcgtcgacacccgcctgtgcttttaatgcacgcaccagcggtgccatcttgatggcctccggccgagtcccgaacacaagcaaaatctttttcatcgttatcctcgttgacccatatcgcgctgaatgaccctgctcgcggcgcgaagcatgtaatcagacggcaccttccgtactcgcacgcgatcgacacgctgcagtgtcgcggagcgagcgcgccgccctgtccacgtggtctgcgccacgcgaatcgtcgtactaccggcgtctcgttgcacttgatcagtcacgtcatgagtcgttcctcgcttggccaggcgtcacgtccgttcgtcacgtcccctccactacagcaatattcaaaccagtcgtactgcggccgtgtccggttcacaccgcatgcaccgtgcatacgcggtgcacgacgaaatgtttcacaactgctacgcgtgtcgcatcgccggtcaagcgcgatacaggcaaaaatccgggcagtttcatggccccttcaacggcgtcgtccgatgaatcgcggacgcgtgtcgcgcattcgtttcgcatcggatctcgcggatctgtcgaagcgcgttgcgtttactcgatccgccacttttgtctgtgcagcgggcggcgcaatcggccgctcggccgcgatcccgcacgagggatttacctgacgtgcaacctccttcacgtcgcacgaatcgatgcatgcgaaatgttgcgaatgtgtaacgctgatccgaaacgggcggatacatcgacgcgcggccaatgcagcgcatgcgcctgcatgaatcgcatcggcaccccggccgatgcgcacacaacgaacgacaccgcgcgcatcaccgcgcaaagtcacgctgccggcgcggcacacgttcgacagacgattcgctggacccatcgaacgtgcgggctgcaatcccggtcgcgcgcgggcaatcggcctgcacgcgggctgattcttcgatgaatcaaaatccgccgccgccgtccgcgccacgcccccggcctccgcccctgctccttgctgcgcgcggcgtcgcggccgatggctcacgccttgcttaatgacagtcaggtgtacctcgaagcacgcgccggacagcggacgaacggggacgcccaagcaacgaagccgggaggaaacgcgacgcgtccgccgggagcgaaaaacaagcgctcctgcgcaccgcgcgtgccgacgtgtcctgttgcaatacgcgatccgcgggccaggttcaggctccgatgcagggaactgcctcgtggacgcatatcccggtacgagcctcgggttcacccgcatcaccgtgaaccgagccgcaacgtcgacacgctcgccaggcgcgacgcggccaacgccgcgcccggcgacgattgcacaggaccccgcgcaggagcccaagacatgaaacggcccgcgctttcccgaccgcacgctcgcgcgtcgcggccaccatcgcgctgtgccgcctgtggcacgtcgcctgctgtctcgccgcgtgcggcttcgcactgcacgcgagcgccgccgagctccggctcgaagggctgtaccagcgcaccgacggtgcgatcaccgtgcgcctgaacggcgtcggcatcgatccgtatttcgcggcaaagcgctgctcgccgcgtccgacgcgcaactcgacgcccgtcaggccgcactcgcgtggatcgcatggttgctgccgcgccagcgcccggatggcggtttcgatcgctactgcgtgaaggacggccgctaccgctcatgtgccgaagcggaaaccgacgacgcgatgacggcgacctggatcgaattgctcgcccgcttcgcgccgcccggcggcttgcccgccgcgtgggaactcagcctgaaccgcgccgccatgcatctggagacgctgctcgacaagccctccggcgtgtatcagatctcgtcttcactgcacgtcgcgctgctgatggacaacgtcgaggtacacagcgcgttccaggcactcgcggcgtactacgtccggcgcgccgactacacgcatgcgggcccgtggagcctgcgcgccgaccagcttgcctccgcgatcctgaaggtgttctggcgcggcacggcatccggttttcgcgccagcacgcagcaggtcagcgatgcgagtttttacccggcgaagatcgcgcagatcctcccgctcctgtccggtattcaggttcccgaacaatccggcgaggtgatctatgcacggtggatccggaagtacggcaggagctggccgcaacttgccaacaccgactacccgtggagcctgatcgcgctggtcgcggtcaagatgaacgattggagcacggttgcctgctggcaagcgcgatcggggccataccggcacggcgcgcactggaacgtattggaagagtcgctttatctggcattcgaaagccggatggccgatcccgtcatccccgctcgatgcgggctcacgacggcggcggcaacggcaaccgcatcgcgctgacgcaacggcgcgtgcggtccatgatgactaaacgggaaggaggcgtgtcatgtgtggcatcgtcggcgcagtcgcgcaacgggacatcgtcccgattctgattgaaggtttgcgtcgcctcgaatatcgcggctacgattcatgcggcgtggcaacggtcgtcgacggccaggcccgccgcgagcgcagcgtgtcgcgcgtcgccgatctcgacgcgcacgtgcgcaccgccggcctgaccggcagcaccggcatcgcgcacacgcgctgggcgacgcacggcgcgccggccacctgcaacgcgcatccgatcttctcgcgcgacgaaatcgcgctcgtgcacaacggcatcatcgagaaccacgaaacgttgcgcaagcaactttccgacgcgcactacgaattcgacggccagaccgacaccgaggtcgtcgcacacctgatccacagcaagtatcgcggcgacctgctcgccgccgtgcgcgcggcaacgtcgcaacttcacggtgcgtacgcgattgcggtattcagcaagcacgagccgcagcggctgatcggcgcacgggtcggctcgccgctcgtcgtcggcgtgacggatggcgaatgctttcttgcgtccgatgcgctcgcgctcgccggcatcaccgaccgcttcatctttctcgaggaaggcgacatcgtcgagttgacgccgggcggcgtgcgcgtactcgatcgcggtggcgcgccggtcgagcgcgcggtacagaccatttcgtccgcgcaggccgcggtcgagctcgggccgtaccggcatttcatgcagaaggagattttcgagcagccgcaggccgtggccgcgaccatcccggatgccgggctgttcgatccggccgtattcggccccgacgccgcgcgcgcgttcgagcagatcgacaacgtgctgattctcgcgtgcggcacgagccactattccggcctgaccgcgcgccgctggctcgaaacgatcgcgcgcgtgcccgcccaggtcgagatcgcgagtgaataccgttacagcgacgcgctcgcaacgccgaatacgctggtggtgagcgtgtcgcaatccggcgagaccgccgacacgctcgccgcgctgaagtatgcgcaggcgctcggccatatcgatacgctggcgatctgcaacgtgccgaccagcgcgatgatgcggcaggcgggactgcgcttcctgacgcgggccggcccggaaatcggcgtcgcgtcgaccaaggcattcacgacgcagctcgtcgcgctgttcattctcgccgttacgctcgggcggctgcgcggctatgtcgacgatgcgcagctcgcgcgctacacgatgcaattgcggcggctgcccggcgcgctcgaggaggtgcttgggctcgagccgcagatcgagcgctgggcggcggaattctcgcagcacgagaatgcgctgttcctcgggcgcgggctgcactacccgatcgcgctcgaaggtgcgttgaagctgaaggagatttcgtacatccacgcggaggcgtatcccgcgggtgagctcaagcacgggccgctcgcgctcgtgacgcacacgatgcccgtcgcgacgatcgcgccgaacgatgcgctgctcgagaagctgaagtcgaacatgcaggaagtgcgggcgcgcggcgggcagctttacgtgttcgccgacgccgatacgcggatcgacaacagcgaaggcgtgtcggtgctgcggatgccggattattacgggttgttgtcgccaatcctgcacgtcgtgccgctgcagctgctcgcgtatcacgcggcgtgtttgcgcggcgcggatatcgacaagccgaggaatctggcgaaatcggttacggtggagtgatgggggaaccgggggcctgagaagggctcgaaaggagctgactggcccgccctacacgactcgaacgtgtgacctacggcttagaagtccagcaatctataaattgacaggaacggaagcgcagtcagatcaaagatctcgctgcgacggccaacctaccacgggctgcgctttgtgcctattttgaccgacctttgacatttaggtcaaggttcggtcaagcattgactgactacgagttaggccaatgactggacgacttagcacctgtcatcaacaagtcaatctcacaatccaaaaattaatactagctatacagcaattcaactcatttatcgccaccacacttcaagactgccacggaggacgatgcgtagagattatcgtttcatccccagaaatcactgacagcgccagaattgggaattttttacaaatacatccactacccgctccactattttcgccgcacgacattgagattcaatacaagcaatccaaatatctggaaaatacctagatagcatacttaactgataagccacaatataaagatctacgatttcatgccgcccaattgattccgcatatgcaatcacatcgtgattcattgtttcgcgagtgtcgggccacttcaatccagaatattcgccagacatcgttttgaatttaactattccactgtcaccaccctccacgccataaaattcaaaattatcgtaaaatctcgacggacaggaaaagccatgaagcaattcatccaccctagaagatgggcgacaagaatgtatagcccattgatatgtcatattccccatttcatctatatagacttccgccgacgatcgagacctgacaacatccatcccaaatcgatccaaatcatcacccaaatccggaagatatttcaaaagatcaatcattctgaaatttgatccactaatagcgtcaaattcatcaacactataagtaccaattccttccctagaaatttgggtgtgcccctgaccaagccgcttaatcaatccagccactgcgcctttttctggcaaaactccataccagtttgcaaactgtccaaacggcatcacctttgcatagctttgctcaagcaacgagattgccgaagcagccgccgacgcattgcaacccgtgttaaagtcgagtccatgatgacaattcttattatccaccctcagataatccagagacttcctcccatcccctaaaatcaacatcatcaccgacgcaagcgccactgcaccgtaatagcaatgatttgggctagtaaatattgaggaagctcgagctgcatcaaaatactccttcgcctgcaaaatacaaactcgcacctgcgtagcctgcttcttatagttatcacgcattctattcgtcacaggagcgccatggcggcgagcgatttcattcatggcgatctcaacgtttgaaaattcaagcaatcgccgccacgtctcataataaatattatccgttacaatccacctcattccacccccgcattctcattaataattttcaatttggagcacaccgcactccaaaaccgcatcaacaatacgaaattccatattattcaacatcgcgatcaacttgtttttggcaccgcctccatctacttcgcgtcataaagcggcatcatactgcgaacaacctgtgtgtttggcatattaaccattcatcatagtcggttggccgcaatatcaggactggtcgcttatcgtcgtttggcttgcgcatacgcctcattagggtgcatccgtcagcgttaacggtcagcatgcacattccgatcagcgaccggtcgtcgcgtcctcatatcgccgccaactgccagcgacgcagtacggttgccagccaagccgatccgatgccaagcgttccggcctgtctcgcaacaagcttcataaatccagtttaccgggatcaaacaccgctgtccgcccctccacgccttgctgtagaggcgcgaactcccgacggtttcggttcgagcaggaccgtgacagacttgcggatatccttaagggctttcggttcttgatcctttgaacaagctctgcaggcacacatcgtagattcccttcggggttggttcgaattaggagtttggcgacttctacatcgttttccgccgaccgagcgaccgacaagcgttctacctgacacaggcatgtatatgcatatagcatcacgccacatcatgaaaccactttaggaatacccgtgggaattcgtcccgtacccgattacgcgaagcaatacgcgcaacgacatcgcggaagtcgcggcgcttgtcgtgcgatgacttgatacaaccttccgcctagatgcttgttcgatggtaggtagtgctagcatcgcatggcgaagctcgcaccccaacagatgcacagcaccgatgttactgcgccaaccgagccgcgggagggggaataatgaaaagggaatgcacgctccttctgtgtctggcgctcgcatcctgcgccaccgtccacgaaagctatgcgcccgacggtcgccaagcttatacccttaactgcagtggcctggctcgaggatgggataaatgcttcgatgcggcaggcaatctttgtaaagcagtcggctatgacgtgctcgaccggagcgacgaaagtgcagcgactgtcggagcgggtggcggcggtttgttcggcgcgaaaacgaatgagcggtcgatggtgattgcctgcaagaagcccgtgggctgagtaagccatcaggccggtcgacctctccgacgttagagaagagtcatgttggccgctggagctctccgacctatcctggtctaacgatgctaggatgttgtcgcgaaagtagtgcttccagagaaacgtgactgcaggttgttacaacccacgttggcgcgcggaacggctgaagcaaagcttgcctctgtgcgcccggagtgatggcacgcatgaacctcatccgcaccgcggtctaccaaggctacggatccgtcgtgaaaaacggggagtcgggaaactcttccaaagcccgccggtattttccgcgcgggctttttcgatgcaattgccggaacaactagcgtcctgccacgtataggagaagacggagaaccaaccgcgattgaccaaattcggttacaccatggttacatggacggcgaattgatggttgatgcagcgagagaacggacgtaagtgcgtgattctactggcccgccctacacgactcgaacgtgtgacctacggcttagaaggccgttgctctatccagctgagctaagggcggtcggggagaaaagacacggcctgcacgagccgcatctgacgcaagacttcgagcaccggcaaaaccggcaaaacccacaaaccagactcgaagccccgaaacaaaacgggcccggcatgaagccgagcccgaaattatacccgatcatcgcgtcacatcatgcgagaccggccaacgcagcctcagaccggctgcggatgcagcatgaaccagccgaggcagaacacgccggcgatcacgcaatacacgccgaacgaagccagccggccacgcccttcgaaatagcgcatcaggaaccgcacgctcaggtacgcggcgatcgccgtcagcacgccgccgagcagcgcatcggcgagctggtcgcgcgcatggaacagcttcggcagttcgagcacgcccgccgcgaagatgatcggcgtaccgagcaggaacgagaattccgcggccttctccgccgtcaggcctgctgcattgccggcgatcatcgtcagcccgctgcgcgagaagcccggaatcagcgcgccgatctgtgcgagaccgacgaaaacgcctgcttgaacgtcatcttttcgggcgcctgatgcgcgcggctacgctggatgcgatcgccgagccacagcagcacgccgttcacgatcagcgcgatcgcgacgatccgcaggtcgtggaacacgcgttcgatgcgcttcgaggagcagcccgacgatgccggtcgggatcgtaccgatgatgagcgcccacatcaggtgcccgtcgtcgttcttgcggccgccgagctgcgcgaagaagccgccgatcagcgcgatccagcgcgcgcggaagtaccatagcagcgccagcgcggtgccgaggtgcagcgcaacgaggaacggcagcagttgcggtgcgtgcttgtcgatgtgcatgccgaacagcgccggcacgagcagcgtatggccaaggctgctgacgggaaagagttcggtgacgccctgcaggacgctcaggaataccagaaaccagagactcacgcgtcggtccttttaatgaagattgagcgggaagagaagcggacgacgcgatgcgcgtccgaaaaacgcgccccgattatgccgagcccggattactgcgccaaggcatttggcgggatattgcggcaatgcacacaaacgcttgcaacttgtaagcgcccgaaagcaaaaagcccgccatttgcatggcgggcctttcgatttcggcaggaattgccgtcagcggccgagctgatagaaaaataataccgtgctgcccgtgaacatgccgaacagtgcgagtcccattgccattgccagatccatggccctccacgaagtgtcatgacccggcaacctcaccggtttagaggcattatcccgaccgttgacggtcttaaaaactcgcgatttcccgagaagggttttcccgagccgccgcggcccgataatggagcgcgccgttcccgttcacccgctcaacccgattcgccatgccgaccttccagcaacacgacattcacgaacttcacgccggcccgtcgctcgtccgggtcgctccgcccggcggccgcctgctgtcatgggatgtcgacggcgaaccggtcatcttctggccggaaacggccgactggagcaacctcgcgcgcgtgcgcggcggcaacccgctgctgttcccgttcctcggccgtcaccgcgtcgacggcgagctcggccgctggcgcgacgctgccggcgtggtacgcgacctgccgatgcacggcttcgcgcgcgacctgccgttcgccgcgcaaccgtcggccgacggcgccgcgttgtcgatgacgctcgacgcgaccgacgcactgcgcgcgagctacccgttcgatttccggttcgaaaccacctaccggctggccgactcgcacacgctcgaagtcgcgctgacgacgaccaatcgcggcgacacgccgctccctactacgccggtcaccatttctatttcgcgctgccgcacggcgaacgcgcggaaaccacgctcgaactgccgcccacgcatcgctgcgcgcagcagccggacggttcgatcagcccgcccgagccgggcgaagcgcgctatcgcctcgacaaccaagagattctcgaccgcttccactgcctcgacggcgtgccggcgacgccggtgcgcatcgtgatgccgggccggcgccgcacgatcgagatcgcgctagacgtgccgggctcgatcccgtggtacgcggtcacgacctggaccgaaaagccggattccgacttctattgcgtcgaaccgtggctcggcctgccggacgcgatccacaacggcctcgggctgcgcatgctcgcgccgggcgcgaccgaaacggccacgctgcggattcgcgtcctcccgctcgccggctgaaacgtgggccgaaacgccggccacgcgggctgagacgctggccgaaccggcgtccgacggcccccggcaacggcacaaactgcggtgcgcgggtcgaacccgttaaaatcggacgttttgtgttgcctgccgcgtcacgagcggcagggtcttgcgaggttcaatgttcggaacaacaacgaagcgactcttcgcagccgcctgcgccgccctgctcgtcgcgtgcggctccgcgcccgtcggccccgggttctatcgcgtcgaacgcggcgatacgctctacaagatcgcgcgcgacaaccgcacgtcggtatcgaacatcgtgcgctggaaccagatgacgaaccccgatgcgatcgaagtcggccaggtgctgcgcgtcgcgccgccgcccggaacgaccaccgcatcgacgccgtcgaccaccggcaccggcagtgccggccgggcccgccccgcgccttccgcaccggttgaatcggccgtcaagccggccacgagcatcgcgctgatctggccggcggccggcaacgtggtccgcacgttcgacggctcgaaatcgaaggggatcgacatcgcgaactcgccgggtacaccggcggtcgcggccgcgccgggtgtggtggtctacgcgggtaacgggctgcgcggctacggcaacctgatcatcctcaagcacaacgccgactacctgaccgcctacgcgcacaaccgtgcgctgctggtgaaggaaggccagtcggtcacgcaggggcaatcgatcgccgagatgggcaacagcgacagcgatcgcgtcgcgctgcatttcgaattgcgctacggcggccggtcgatcgacccgtcacgctacctgccggcgcgctgagcgcccgacggacgacacgcgacgccggcacgcatcgcgtgccgtcgcggtgaaaatcgggaaaggtgatgtcagcgcttgcgcaaacgtccggtgaaacggccggacaacggatcgacgcgacaagcgaacgctaccagcacgccgattccgatcaggctgaaccccgcagctatcagaagcaaatccatggtcacacactgatttttaagtgatcttatgcgtcattgcggaatcgtgcactgagccgcagcaattggacgagtgcgaggattccctaccctcaggcgtcattgtggattcccctgcgtgaaaccctgatgtaagccgttcgcctgacaccacgccgcccccaggagacactgcgatgctgcccgccaccgaccgctacgacgacctgctctcccgcttcgcgtgggacgttccggcccgctacaacatcggcgtggacgtctgcgacaaatgggcggatggcagcggacgcctcgcgctgatccacgaaacggcgcaaggcgacgtgtcccgcatcacgttcgacgacctgaggaatgcctctaaccgactcgcgaacagcttcgtgcgcgccggcctgcggcgcggcgaccgcatcggcatctttctcgcgcagggccccgaaacggccatcgcgcacctcgccgcgtacaagctcggcgccatcgcggtgccgctcttcacgttgttcggcgtcgatgcgctcgaataccggctcgcgaacagtgaggcggccgcgctcgttaccgatgcggccggctacgcgaaaatcgcatcgctgcgcgcgcagttgccggcactgcacaccatctattgcatcggcgacgatgcgcccgacgctcccggtctgctgcgctacgacgcggcgctcgccgccgagacgcccgacttcgtgccggccgatacggccgccgacgatccggcgctcatcatctatacgtccggcacgacgggcaagccgaaaggcgcgctgcacgcgcatcgcgtgctacttggccacctgccgggcgtcgagatatcgcagcagtgcttcccgcgcgacgcgcgcctgttctggacacccgccgactgggcatggatcggcggcctgctcgacgtgctgcttccgtcgtggcatcacggcgtgcccgtgctcgcccgccgcttcgagaaattcgacggcgacgccgcgttcgcgctgatggcccggcacggcgtcacccacgcgttcctgccgcccaccgcgctgaagctgatgcgcaccgtcccggcgccgcgcgaacgctacgcgctgtcgctgaaatcggtcgcgagcggcggggagacgctcggcaccgaactgacggcctggggacgcgacgcgctcggcgtgacgatcaacgagttctacgggcaaaccgagtgcaacatggtgctgtcgtcgtgcgcggcgctgttcgatgcgcagcccggcgcgatcggcaaggcggtgcccggccatgcggtcgcgatcgtcgacgcggacggcacgccgctgccgcccggcgtcgaagggcgcatcgcggtgcgccgccccgatccggtgatgttcctcgagtactggcgcaacgccgacgcgacccgcgacaagttcgcgggcgactacctgctcaccggcgatacaggcatgatcgacgccgacggtttcgtccgcttcgtcggccgcgacgacgacgtgatcacgagcgccggctaccggatcggcccgggcccgatcgaggactgcctgctcacgcatccggcggtgcggatggcggctgtcgtcggcgtgcccgacgcgacgcgtaccgagatcgtcaaggcgttcgtcgtgctgaatcccggtcacgccggcgacgatgcgctcgttcaggcactgcaggcgcacgtgcgcacgcgcctcgccgcccacgagtatccgcgcgcgatcgcgttcgtcgacagcctgccgatgaccgcgaccggcaagatcgtgcgccgcgcgctgcgcgacgcgtaagcgggccgccacccgcgccgcccgcccgcccggccggatggtttatagtggcgccaccacgcagtctttccaagaaaacgatgtcctctgatcaccacgccgccgcgggcgcgttgcacagcccgctctacgccaaactcctcggcgaaaccgccaagatcgactggtgcgatctcgaacgcttcttcgcacagggcaagctgctgtccgttgcgcgcgacctcgatctcgtcagcgtcgcggaagcggttgccgacgacgacgccgaacaggtcacgcgctggctgtccgcgggtctcgtcgcgcgcatgccggccgaaaccgccgccgattacgcggcgcgcaacccggagctgtgggcagtcgtcgtctcgccgtgggtctgcgtgcaggaacgcgcctgacgcgtccgccatgtccgaatccgcgttaccgcacggggccggcacaggctcggccaccgtcacgcaccggcgcgtcctcgcgctcgcgtttccgatcgtcctggcgaacctgacccagccgatcctcggcgtcgtcgacacggccgtcgccggccacctcgacggcgcgcagtatctcggcggcgtcgcgctcggcgggctgttcttcaatttcgtgttctggggattcggtttcctgcgaatggggacgaccggtctcgtcgcgcaggcgcacggtgccggcgacaccaccgggatccgcctgaacgtgctgcgcgcgttgatcgtcgcgttcgcgctcggcgccgcggtgctggcgctgcaggtgccgctgctgtcgtttgcgctgtcgtcgctcggcggcagcgatgccgtccgcgcgacggcactgtcctacagccacgcgcggatctggagcgcaccgttcgcgctcgcgaactacgtcgtgctcggctacctgctcggggtgcagcgcgtgcggctcgcgctcgtcgcgcaggtgttcatcaatgcggtcaacatcggcgccgtcctgctctacgtgtatggcttcggctggggcattgccggcatcggcgccgcgacggccacggcagacgcatgcggcttcgcgctcggtgcatggatgctgtggcggctacggccgcgcggccttgcgccgatcgcggtacgtgcactcgccgaccgcgtcgcactcaagcggctgatcgcgctcaatcgcgacatcttcctgcgcacgctgtgcctgctcggcgcattcggctggttcgcgcacctcggtgcgaaacagggcgatgcgacgctcgcggcaaacgcgctgctgctgaatttccagacgttcatggcgtacggcctcgacggcttcgcgcatgcggccgaggcactcgtcggcgcggcggccggcgcacgcgaccgcggtgccttccggcaggccgtgcgcgtcaccctgctctggtcggcgctcggcgcgctgctgttcgcgctggtgtactgggccgccggcggctggatcgtcgcgcgcctgaccgatcaggccgagatccgcgaggttgcgctgcgctacctgccgtgggccgcgatttcaccgatcgtgtcggtctggggcttcctgctcgacggcgtcttcatcggtgcgacgcagacacaatcgctgatgcgcgcaatggtcgcgtcgctctcgatcttcgttgtcgccgcactcgccgccgtcggcaccttcggcaatcacggcctctggttcgcgctgctgctgttcatggccgcgcgcggcgcgacgctggcgcgctacctgccggggctgttgcggcgcatcggcaccgatacacccgcggcccgcgcctgatggcgcgccgaaccggccctaagcgggtccgagcggccgtaaacatccgttactgcgccggtttgggcggcggtgcatcgagcatcgtcggcggcgtcatgtcggtcggcacgccgtgatagtcggccggatcttccggcggatggccgcgacgggcctgatgaggatcgctggtacaggcagcgagaaagatgcggccagcacggccagcatgaaacgggtcatcgggtaaggctcggaaatcggcgcgcccatcgcacgccgggaccgcgccgagtctagcggaaatcctgcttcgagtcgcgccgcgcatgtcctactatgtacgcatggcgctgtgccgtggaaaggaggctgccatgtcgtctgaggaaattgccggcctgatcggcctgttcatcggcctgatggtgttcgtcgccctgtcgttcttcgagtcgcgcgaatacaagcgcagccatggcggcgaagggatcatccatcactggatggccgaacaccacctgctcgactggcggcgcaagcactaagcgcgccgctgctgtccggccctccccgggccgttcccgaacgtgccgtcccacggcacggcgatgatcgcgtatctccgaaattaacggggcccgattcacacgcgtcgatcagatggacgaacgccgtcgcgcggctcatgccgcacgacggcgttcgcatgcacgcgcccgaactagcaggcgggcgcgacgcggttcagacggttcagcccaggaagtggcgggcgtagcgcgcgttgatgtcggacagccggaacagcgtcaggaaatccgcgcagttgaagtcgggatcccaggccggcgcaccgcagatcttcgcgccgagacgcaggtaacccttgatcagcggcggcggcgccacgacggtgcccgtctgcaattcgtcgaccggcagggccgtatgcgggaatgcacgatactcgggcgccgtcagcgaacctgccgacagcgactggtacaggttcgccgcatagtgaccgccgtcggccatcgacacgctcgcgcagccgagcatcgtctcgtagccgttctgcatcatgtacgtgccgagaccgccccacagcgccatgatgacggcgccgctgcggtagtcgctgtgcacgcacgagcggccgacctcgaccatcttgccgcgcaggtgcgtgaggcgcgacaggtcgaattcgccttcggcgtacaggcggccgacacgcgccgcctggtgcggcggcagcacgcgatacgtgccgacgaccttcagggtgtcgagatcgcgaaccagcaggtggtcgcagtacgcatcgaacggatcgacgtcgagaccggaggggccgctgacctgcgcgcccatctcttcggcgaacacgctgtaacgcaggcgctgggcttcgcgcaattcgtcttccgtacgcgcccacgcggcgcgcaggcgatactccgatgtgacggtttcagcagcgcgcggcaggaggcgccgcgacgtgtcgaggggcagcgaggcaaaagggagcgtaggcgtcggcagttctcgcattaggctttcctgatcgtaaggaataggacgacatgcccgccaatgtagtaatcggccgtgaccgttatgtggcacgaccgtgtcctttcaatgacgtgtcgccgaattgactttagcagaaagcttgcgaaaccgtatgacgaaacccttcaaagcgcttcaggcgggcctcacaccaggtcgggcgtcaataccgcccgcagcacggcctggcggctgccgtcgcgcgtgcggctcgcgagccacacgattccgcccttcttgacgctccagctgtcgtcgccgccggcgatcagttgcgcggcgacgctgccgagcgtcggctggtggccgacgatcacgaccgtcggcgcgatgccgtccggccagccggccgccgccagcacgtcgtcgacgctgccgcccggcgcgagcgcctcgaccgtccggtactggtcggtcagcgcctcgacggtctgcacggtgcgggccgccgggctcgcgaggatcacggtgttcgtctcgagccggccacgcaaccacttggccatcgcctgcgcgtccttgcggccgcggacggtcaactgccgcgcgagatcgctcgtcgcgtagtcttcggcttcggcgtggcgccacaggatcaggttcatcatgatgttctccttgcttcggcgagcggccccgcgcccatgcgtgcgggccggccgattaccgtgcgaattgtcgcaaattgcggctcgttcgccgccgcggcatttacccgcatatagggattgaccggatcagccattcaaagatagaatctttggctcgtcggagcgtagcgcagcctggtagcgcatctgatttgggatcagagggtcgaaggttcgaatcctttcgctccgaccaccggaatcaagggttacaacacgaagtgttgtaacccctttccatttctggcccgtgaaagatcccgggcaaccgccgcatttcgcgccacgtagtcactcgatccgcacgagatcacgcggcgcgaccggcaatcgatcggcaggcgcgctttccgatggccgccctttcgatccggaatatcgataaaccagatacttcccgtccgtctcgccgccttcgttggggatgatcacccacatctccccacgccccgaatacagccaccgcggaagcgccttctccgcgaaatagatccgctcttcgacatgcgtgaccggattcagccggattgcgacgcccttcaggtaaggcgatccgtagttcagtacgaagacgagggtcttgccgacgcacctcgacaacgcaatcctgcccacgaaatcggtctccggcatgtcaaggaacgcgcgcccggtcttgcgcccccgccgcacgaacagcgcatcgccgtccaacccatgcgagcgggcgtcgagcgcaatgcggctcccgtccgccaacgggcaggaaagcacctgacgcaggacaccggcctcatcgattcccggcgtcgcgccgaacgtcgctgtcgccatcgataaaagaccgacgacgagcactttcattcgaccgttaccagtcagttgcgtcgctaatcgactcattgagatgcagcatcgcgggttatccacttcggtacgctcgcacgaatcaccttttcccagggacaaaccggcgcctcaacggggccaactcgaacccgtagcggtaccattatcggcgccccaatgccaaaccggagtttcgtcgaccatgccgacatccctgtcgtccctgcaactgcccgaaggcctcggcaccatcgggaatctggctgtcgaattcgtcgaggatgaacggaaaacatacgagatgtggatgctcgaaacggaccttcctttcgacgaagccgtgtcgcggttgtcggccttcgtcaagcgccatttcggcggcgacgagcgagcttcgtccgccgaccgcttcggcttccgcagctgggcggcctcctggtcccgcgagagacaggagatctcggcccagctcaccggcaccgacgacggcagctcgggttacctccgcaatgcgtacgacgcgtgaatgaacacacttgccgcccccgacaccatccggacctcgcatgacagcctcctcgactgatcgcccggcaaaaccggcgatgaatatcgcgaccgtcatcgccatgatcatcggcgccgccgtactcgctttctgcatcgtgcaggcctaccggacgacggtcttcctttcgcatgcctctcgagcgcccggcgtagtcgtcaagtcgagcggacacccgaccatacgcttcgaaacggcccagggccagcgcatcgagttcgtgcagaacggcggcatggacggtccgcccggaactgtcgtgcaggtcgcgtacgaccctgccgcgcccgcggaaacggcccgggccgccacgttcctcgcgatatggggcgatgtgctgtgggagtgccggcaggcctcggctttctggtcctgccgctgttcggcgcacggttcgtgctcaccgggcggtacgggaacgcgataagccgttgagcggcgacgcacggattcatgcgatgcccgggcattcgcggcaagtccggacgctttcatcgtcggtcacgcttgcgaaggtcacgaatcgaacgaggtggccggcctcgctgccgcaacccggatacgacacttccgggaacacgcgataatgcgcgtggacaacctgcatccgcgcatgacaaacaacattctcaagaccgccctgtgcgcatcgctgctcgcgcttgcaaccgccggcaccgcatcggccaaggcactcgacgacgcactcgactgccactcgaccgggcacaagttcgtcgcgccgctgctcgcagccggcgatatccagtcggagccgatgcacgtcgaatcgaactcggtcaatgcattccgcacgagccactcgctgaccgcatacggcttcggcgtctacgtcgtgctcggctaccaggcgaacgacccgatcttccgcaccggcgacggcacgccgatcggcgactgggcctatggcgtcgtggtgcgcggcacgaaaagcgcggtggaggaagccgtgcgcaaggccggcagcgacgcgaccgtcaggcaggcgtttccgttcctgaccgcgatcgtctgctcgtcggactgagcggccgtcaggacgatcatgcggcaatcctgagggcggcaagccagcctgccgcccgtcccggccccgctatcggcctttacgcgcccgtatacaccacgcgatacgggattccgaccttctcccattccgccgcctcctggctgaggctgtagtcggtcagcgggttctgctcgacccacgcgctcggcaggcgcacttcatacccgcccttcttcatctgcgaaacggaaatgtcgggcagccccgcgtcggttcggcgtcggcacagcagcgccgcgaggcgcaggcagaacagcagcggccactcgacttcgcgggcctgcgacagcttgccgagcttgcccgcatgaccgagcaccagcgcggcgagccgcgcctggtcggtgcgcgaaaaacccggcatgtccgcgttgctcgcgatataggccgaatgcttgtgatacgcgctgtgcgagatcgacaggccgatctcgtgcaacgcggccgcccagccgaggaacatccgcccttcctcgcgcgcttcgtcgtcggcttcctcgagttcgtcgtagaaacgacccgccagcgcgccgatccgctcggcctgcgcacgatcgacaccgtagcggcgcgtaaagccctcgacggtcaccgcgcgcatgtcctcgtgctgcgtccggccgagcaggtcgtacagcaccccgaggcgcagcgcgccgtcggtcgtatcgacgtagtcgaccccgagttcctcgaacaccgcgagcatgatcgcgaggccgcccgcgagcaccggcacgcggtcgggcttcagcgcgatcagcttcagccggttgacgttctccgacttgatcagcgcacgcttcaggcgctcgaggccgccgcgcgaaatgccgtgcgtgatgcccggatcgttgaagccgttcgcctcgacgagttccgcgagcgcacgcgcggtgccggacgaaccgatcgcctggtcccagccggccttcttgtactcgctcgaaatgatctggatctcgcgcttggccgcgagttcggcctgccgcatcgtgtattcgtcgacgttgccggcggggaagaaggcgcggctgtggctcacgcagccgatgtagaggctctccatcacgatcggcgtgtagtgcgagccgatgatgaattcggtggagccgccgccgatgtcgacgacgagccgcttgccggcgctcgccggcaccgagtgcgcggcgcccgcgtagatcaggcgcgcttcttcgcggcctgcaatcacttcgatcggaaaaccaagcgccgcttccgcctcgccgagaaactcgcccgcgttcttcgcgacgcgcagcgtgttggtggccaccgcgcgcacatgatcgggatggaaatcgcgcaggcgctcgccgaaccgcttgagcgcctcccagccacgctcctgcgacgcgcgatcgagcatcttgtcgctcgacaggcccgcggccagccggacgggctcgcgcagcgcatcgacgggatagatctggctgcccgccggcgtttcctcgacgcgtccgacgatcagccggaagctgttcgagccgagatccacggcagccagcaagtgggggttgtaaccatcagaggggctccgtgcgcgttcgcccgcggcggccggtgcgacagccttgggcgatcaatcaaaggcgacattttaagcgtggaacgcttgccgttgccacgcttcacgggcatgcatactgctcgtttgcatatcgtcgaaacatttatgggacgaaacgattacagcgtagaatttcccgatataaatacatcattgtcatcagcacgtcatcgtaccgtgagagtttccgagcgtcctttcgaatcatcgcccgaatccccctactctgccgatgtccgtccgttatccgcttctcaatcgtgaactcggcatcctcggtttcaacgagcgcgtgctggcccaggcagccgatccgcaagtcccgttgctcgagcgcctgcgcttcatctgcatcaccagcagcaacctcgacgaattcttcgaagtccggatggccggccttcaggagcagatccgcgacaaccccggcgccctgacgcccgacggcatgtcgttacaacacgcttacgatctcgtggtcgaacgcgcgcagcggctcgttcatcgacagtacacgatgctgcacgaaaccgtgctgcccgcgctcgagcaggaaggcatctacttccatgcgagcgacacgtggaacgacgagcagctcgaatgggcgcggcactacttcctcgacgagctgctgcccgtgctgacgccgatcggcctcgatcccgcccacccgttcccgcgggtgctgaacaagagcctgaacttcgtcgtcgagctcgaaggccgcgacgcattcggccgtcaagccgtgatgggcatcgtgcaggcgccgcgcgcgctgccgcgcgtcgtacgcatgccgcacgcgctgtcgggtttcgagcacggcttcgtgctgctgagctcgttcatgcagcgcttcgtcggcgaactcttcccgcaactcgtcgtgaagagctgcaaccagttccgtatcacgcgcaacagcgaactgttcgtcgacgaagacgagatcacgaacctgcgcgtcgcgctgcagggcgaactgcccgcgcgccacctcggcaacgcggtgcgcctcgaggtgtcggccgacacgccgccgcacatcgtgcgacgcctgctcgacgaaagcgagctcggcgacaaggactgctatcgcgtggccggatcggtgaacctcgtgcggctgatgcagattcccgatctcgtcgaccgacccgacctgaagttcacgccgttcaccgcgtcgactcccgccgcgatcacgaatgcgccgacgatgttcgacgcgatcgacaacggcgacatcctgctgcaccacccgtacgagagcttccagccggtgctcgaactgctgcagcaggccgcgaaggacccgagcgtcgtcgcgatcaagcagacgatctaccgcaccggcaccgattcgccgctgatggacgcgctgatggaagccgcgcgcaacggcaaggaagtgaccgtcgtcgtcgaactgctcgcgcgcttcgacgaggaaaccaacatcaactgggcgtcgcagctcgaggccgtcggcgcgcatgtcgtgtacggcgtggtcggccacaagtgccacgcgaagatgatgctgatcgtgcggcgcgtcgtgcaggacggcaaggcgtcgctgcgccgctacgtgcacctcggcaccggcaactaccacccgcgcacggcacgcctctacaccgacttcgggctgatgacggccgaccagaagatctgcgaggacgtccatcacgtgttccagcaactgaccggcatcggcggcgaactcacgctgcacgagctgtggcagtcgccgttcacgctgcatccgcgcatcatcgactcgatccgcgcggagatcgacaatgcgcgtgccggcaagcgcgcgcgtcgtcgcgaagatgaacgcgttgctggaaccgacggtgatcgccgcgctgtacgaagcgtcgcaggccggcgtcaaggtcgacctgatcgtgcgcggcgtctgcgcgttgaagcccggcgtgccggggctgtcggaaaacatcaccgtgcgctcgatcgtcggccgcttcctcgagcaccaccggatctactatttccacgcgaacggtgccgaggatgtctatctgtcgagcgccgactggatggaccgcaacctgttccgccgcgtcgaagtcgcgttcccgatccgcgatcgcaagctcaagcggcgcgtgctggccgaagggctgtcggtgtgcctcggcgacaaccagtcggcatggcagatgcacagcgacggccactaccgccggcgccgcgccggcaagacgatccgcaacgcgcaactcgggctgctcgcgaagttctgctcgtgaatcgacaacgcggcgcgagttgcgcgccgcgcaccagcgttgccaacgaaaagcgcagcccgcgggctgcgcttttcgttgcggatccggcatgccgccgctcgcaaaacgagcgacagacgccgttacgcgatcatgcctcgtacgtggccggccggatcgcgatgacgcgcgaacccgggaaccgcgcagtgaacgtgctgccgcgcccttcctcgctctgcacgtacaggtgtgcgtcgtgccgctgcagcacgtgcttgacgatcgcgagcccgagccccgtgccgcccgtgtcgcgcgaacggctgcggtcgacgcgatagaagcgctcggtgagccgcggcaggtcggcggccggaatcccgaagccgctgtccgtgacggaaaatacgccttgcgcgccttcgcgccgccacgtcacgacgatcttcccgccgtccggtgtatagcggatcgcgttcgtgacgagattcgcgaatgcgctgaacagttccgtctgcgcgccggtgacgccgagcgtctcgtcgatcgagaacgcgatgtcgtgatgcccgttcgacagcgtctgcgcgtcctccttcaggtgatcgaacacggcgcgcatgtcgatcgcgcgatcgaccggcggcttgctttcgccctccagcttcgcgagcaccagcaggtcggtcacgatgtgccgcatccgcgatgcctgctgctccatcatctcgagatagcgcgcgcggtcttcctcgttcagcggcagctcgcgcatcgtctcgagaaagcccgacagcacggtgagcggtgtcttcagttcgtgcgacacgttcgcgacgaagtcgcgccgcatcgcgtcggtccgctcgagctcggtgatgtcctgcgtgagcagcagcttgcggttctcgccgtacggaaacacctgcacttccagcacgttctgccgcgagtcgcccatgccccgcatcacgagcgtctcgtcgtaatgctgcgcgttcaggtagcggacgaaatcgggatggcgtaccaggttggtgatgtgctggcgcaggtcgcgcttcgcatccaggccgaaatgaacctcggcgatcgcgttgcaccactcgatctggtcgtgatcgtcgagcatcgcgacgccgttcggcgacgcctggatcgcctggatgaagcgcgaatgctgctgctcgacctgccgcacctgcgcatgccactgcttcgcgagcttgtgcagacgatagtagatctcgccccagatgcccggcgcgctcggcacttcaccgtagaccggcgcatcgagcagccgccacagacgctgcgtgtgaaaggtactgaaaaagccctgcgcgaccagcatcacgacgacgaacacgaggcccgcggtcgggccggcgaacacgccgaccaatacgccgatcagcacgagcagcacgagcgacaccagaaagcgcgcccagatgatgttcatgattcagcgcccgaaagaatgaacggcatgccgtggcacacggcaggcccgaatacgttacgcgtgcttggcgagccggtagccgctgccgcgcacggtctcgatcatcgcatcgcaaccggccggtttcaaggccgcgcgcaatcgtttgatgtgcacgtcgacggtccgctcctcgacgaacacgtggtcgccccacacctggtcgagcagttgcgtgcgactgtgcacgcgctccggatgcgtcatgaagaaatgcagcaggcggaactcggtcgggccgagatcgagcttgatctcgctgccttccgcatgcgcggcgacccgatgcgtggccgggtcgaggcgcagcccgttgatcgacacgacgtcctcggtcagctgcggcgcacgacggcgcagcacggccttgatccgcgccatcagttccttcggcgagaacggcttcgtcacgtagtcgtccgcgccgatttcgaggccgagcaccttgtcctgctcgtcgccgcgggcggtgagcatgatgatcgggatgtgcttggtccgttcgttgttgcgcaggtcgcgcgcgaacgcgataccggatttgcccggcagcatccagtcgagcagcacgagatcgggcagcacgtcgctgatcaggttctgcgcctgttcggcgttgtacgcacgaatcgggcagtgaccggcgtgctggagattcaccgagatcagttcggaaatcgcgggctcatcttcaacgacgagaatgttgctgggcatcggcacctctttttcccctgtacggagtcgattaactgttggcttcgcgatcgagcgtgtcgcgcggctggtgccgcacgtccgtgcccttcacgatgtagatgatgaattcggcgatgttcttcgcgtggtcgccgatccgctcgatcgccttcgcgatgaacaggtattcgaggccgaccgagatcgtgcgcggatcttcctgcatgtacgacacgagcttgcgcacgaacgcacggaattccaggtcgatctccttgtcgtccttgacgatctgtgcggcggccaccgtatcgagacgcgcgaacgcgtcgagcgcgcggcgcaggatcgtcacggccatctcgcccgacaccttgatctcggcgatgttgaccgcacgcgcggccggctcgtcgaccaggcggcgcacgcgcttcgcgatcttctcggcctcgtcgcctgcgcgctcgaggttcgtaatcgttttcgaaatcgacatcaaaagacgcaggtcacgcgcggcaggctgcctccgcgcgatgatgttgccgcactcctggtcgatgtcgacttccatcgcgttcagcgtttcctcggccgcgatcaccttctcggccgtatcgcgatcgaactcgttcagcgcgtgcatcgcgccgacgatctgcgactcgacgagcccgcccatttccagcactttcgacgacacggcattgaggtccgcgtcgaactggctcgacagatgtttatccgacatggctgttgttctccgtcatcaaccgaaacggccggtgatgtagtcttccgtttccttgcgcaccggcttgatgaagatcttttcggtctcgccgaattcgatcagctcgcccaggtacatgtaggccgtgaaatccgagcagcgcgccgcctgctgcatgttgtgcgtgacgatcacgaccgtgtagtcgctcttcagctccgcgatcagctcttcgatgcggccggtcgagatcgggtcgagcgccgagcacggttcgtcgagcagcagcacttccggacggatcgcgatgccgcgcgcgatgcacagacgctgctgctggccgcccgagaggccgtagccgctctggctcagcttgtccttcacttcgttccacagcgcggccttcgtgagcgcccactcgacgcggtcgtccatttccgagcgcgtgagcttttcgaacatcttcacgccgaacgcgatgttgtcgtagatcgacatcgggaacggggtcggcttctggaacaccatgccgatacgtgcgcgcagcagcgagatgtcgcgcttcgtcgtcagcaggttctcgccgtccatcaggatttcgccttcggcgcgctgctccggatagagcgcgaacatcttgttgaacgtgcgcagcagcgtcgacttgccgcagcccgacgggccgatgaacgccgtcaccttcccttcgggaatgctcaggttgatgttcttcagcgcatgaaacttgttgtagaagaagttgaggttgttgacctcgatcttcgcgttcagcggctcgagcggacggccgtgcgccgcttcgtgcgtgccggccggcgcagcggtgcgctcgacaggattcaggtggctttctgccatattcatcggattgctccgccgttactttttcgagaagatcgtgcgcgccaggatgttgagtccgagcacaccgagcgtaatcaggaacacacccgcccatgcgagcgcctgccattccgcgaacgggctcatcgcgaacttgtagatcgtgacgggcaggttcgccatcggctggctcatgtcccacgagaagaactggttcgacagcgcggtgaacagcagcggcgccgtttcgccggcgatccgcgcgaccgcgagcagcacgcccgtcacgatcccgccgaccgatgcgcgcagcgtgatcttcagcaccatgcgccacttcggcgtaccgagcgcgaaggccgcttcgcgcagcgcgttcggcacgagcttcagcatgttctccgtcgtgcggatcacgatcggaatctgcagcagggcaagcgcgatcacgccggcccagcccgagaagcgccccgacttcgcgacgacgatcgcatacacgaacaggccgatgacgatcgacggcgccgacagcaggatgtcgttgatgaagcggatcgtgctggccagcaggttcttctggccgtattcggcgagatagacgcccgcgaggatgccgatcggcgtgccgaccagcgtgccgaaaccgcacagcagcaggctgccgacgatcgcgttggcgagaccgccgccttccgtgttcggtgccggcgtcgattccgtgaacagttgcagcgacaggccgctgacgccgagatgcaccgtcgtgtagagaatccacacgagccacaacagcccgaaggccatcgcgccgagcgacgcggccagcgcgatcgcgttgacggccttgcgcttgcgctgcaggcggttgcgcatcgcgtcgagcacggcgccgtccggccccgggaaattcatgatgggctcgctcatttcttgccctctcccttctcgagacgaagcagcagcagtttggagatggacagcacgatgaacgtgatcaggaacaggatcaggcccagctccatcagcgcggacgtatgcaggcccggttgcgcttccgcgaattcgttggccagcgccgacgtgatgctgttgcccggcgcgaacagcgacacgctgtcgagcaggttcgtgttgccgatcacgaaggtcacggccatcgtctcgccgagtgcacggccgaggccgagcatcacgccgccgatcacgccggtcttcgtatagggcagcacgaccttccacatcacttcccaggtcgtgcagccgatcccgtatgccgactccttcagcagcaccggcgtgacttcgaacacgtcacgcatcaccgatgcgatgtacggaatgatcatgatcgcgaggatcacgccggctgcaaggatgccgataccgatcggcgggccggcagtcagcgggccgagcacccagatgtccttgaacaggcggccgatcggcttctggaagtattccgcgaagatcggcgcgaacacgagcaggccccacatgccgtacacgatcgacggaatcgcggcgagcagctcgatggcgatgccgagcgggcggcgcagccacacgggcgacagctcggtgaggaacagcgcgatgccgaagctgaccggcacggcgatgacgagcgcgatgatcgacgtcacgatcgtgccgtagatcggcacgagcgcgccatagaggtccgagttgggatcccactcggattgccacaggaagccgaggccgaacttctggatggtcggcatcgacgcgatgatcagggaaacgatgatcccgccgagcagcagcagggtcacgatggcggcaagccgtgcaagaccgccgaatacgacatccccgaggcggctcggcgcgcgttgctgcgcaacgtcggcggaccgtgaggacgtataggaaatatcagacatgggtgcctgcttttgattgccgggcgccgtaacgcccggctttaccgcacacactgcccgaccggcacggccgggcagcgaaccgctgcaatgcttactctgcggcgaccgacttgcccgacgcgtccgtcaccttgaccttccactgcttgcggatttccgcttcgactgccggcggcagcgagatgtagtcgaggctgtcagcagccttctcgccgttcttgaacgcccagctgaagaacttcagcgtttccgcgccctgctccggcttttcctgcttcgcgtgcagcagcacgaacgtcgcgccgacgaccggccaggcttccttgcccggctggttcgtcaggatctggtagaacgacttcgaccagttcgcgcctgcggcagcggccttgaacgtttcggtcttcggctcgaccaccgtgcccgtcgagttcttcagggccgtgtagatcatgttgttcttcttcgcgtacgcccactcgacgtagccgatcgcgcccggcaggcgctgcacgaaagccgcgacgccgtcgttgcccttgccgcccgtgcccgtcggccagttgaccgtcgtgccttcgccgatcttcgacttccactcgtcgttgaccttcgacaggtagttcgtccagatgaagctcgtgcccgagccgtcagcgcggcggaccacggcgatgtccgtgtccggcagcttgaccttcgggttcagcgcggcgatcgccgggtcgttccacttcttgatcttgccgaggtagatgtcgccgagcaccgggcccgacagcgtcagttcgccggccttcacgcccggcacgttgacgaccggcaccacgccgccgaccaccgtcggaaactggaacaggccttccttcgcgagctcgtcatccttcagcggagcgtccgagccggcaaaatcgaccgtcttcgcgataatctgcttcaggccgcccgacgaaccgataccttggtagttgaccttcgcgccgccggtctgctggtagtcagcagcccatttcgtatagatcggcatcgcgaacgtgctgcctgcgcccgtgatgtcggcagcgtgggcggcgacggcgaaagcgcgccagccaggccggcaatcgcggtttgcatcaatttcatgagacctccagtgtgtgagcggatgactacggcaccgcgaaggttaggggctcctcatgacggtaatgtgacaatcgatgaaactggcgtgacagtaacatgactggttgaaagggagtaacagggtcggcgcgcgtggcacacagacggcgccggaggggcgatggcggcaggaattgccggcccggaagggacaggatgacgccccgtttctcactgtgtgactggatcgcagcgccgcgtcggtggtacgaaaagcctccgccggcggctggcccgatctcggggtcggacgagttttcgtccggggaatgcagcagtcgatatgcgttacttataggtatcgcaaacctttgcgtctgatgaaatcgcggcgccccgaaggcgccgcatgccggttcaacggaacgccggcgcgcgggcgtctgaccgccctcgcaccgggcccgcgcgtcaggccgtcgccgcgcgcaccgcgtcggcgatcgtctccgcatggcggaccgcgtcggccgcttgctgcgcttcgaccatcacgcgcaacacgggctcggtgcccgatgcgcggatcagcacgcggccgctgccggcgagcgcggcttcggctgcgtcgatcgctgcgcgaatcgacgtgctgcccttccagtcggcacctggcttcatccgcacgttgatcagcttctgcgggaacagcgtgacgccgtcgagcatctgcgcgagggtctggccgctgcgcttcagcgcagccagcacgagcagcgccgacacgatgccgtcgccggtcgagtggcgatcgagcgacaggatgtggcccgagccttccgcgccgagttgccagccgtgctcgcgcaactgctcgagcacgtagcgatccccgaccgccgcccgcacgaacttcacgcccgcgcgctgcagcgcgacttcgacggcgagattcgtcatcagcgtgccgaccgcgccctccaccttgccgtcggtcgcgatccggtccttcacgagcacgtagagcagctcgtcgccgttgtacaggcgaccggtcgcgtcgacgacctgcaggcggtccgcatcgccgtcgagtgcaatgccgagatcggcgtggttcgcgcgcaccgcgcgcaccagcgcgtccggcgcggtcgcgccgacgccgtcgttgatgttgaagccgttcggcgcgacgccgatcgggatcacgtccgcgccgagttcgtggaacacgtgcggcgcgatctggtacgcggcaccgtgcgcgcagtcgatcacgagcttcagcccgcgcaggtcgaacgcggccgggaacgtgctcttgcagaattcgatgtagcggccggccgcatcgtcgaggcggcgcgccttgccgagaccgtcggacgatgcgcattcgagcggcttgtcgagccacgcttcgatcgcggcttcggtgtcgtccggcagcttgttgccgtcagcggagaaaaacttgatcccgttgtcgcgatacggattgtgcgacgcgctgatcacgacgcccgccgacaggcgcagcgcgcgcgtcaggtaggcgacccctggcgtcggcatcgggccggccagcatcacgtcgacacccgccgccgagaaccctgcctcgagcgcggcttcgagcatgtagcccgacacgcgcgtgtccttgccgatcagcacggtcggccgcgagccggccgcgccatcggccgagctggccagtaccttgccggccgcgtagccgagacgcaacacgaaatccggcgtgatgggcgcctcgcccaccgtgccgcgaatgccgtccgtgccgaaatatcgacgtcccatagcgaatcttcctccttcgtcttctgacttatcgttgccgcgcggcttcgcgcacggcattccagaccttcaacgcatcaaccgtcgccgcgacatcgtgcacgcgcacgatcgccgctccgcgctcgaccgcgcacaatgcggccgccacgctcgccgcgacgcgctccatcggcggcttgccgccgatcaccgcaccgagcatcgacttgcgcgacatgcctgcgagtatcggatacgcgcacccgtcgggccgcgcgggcgccgtttccggcagtgcggccaggagtgcatagttgtcgtcgacgaccgccttgccgaacccgaaaccgggatcgacgcagatccgctccggcgcaatccccgcgtcgcgcagtgcctgcgcgcgcgcggcgagaaaatcgcgcacgtcggtcacgacgtcgccgtaatcgggttcgccgacctgcatcgtttgcggctcaccgagcatgtgcattgcacacagcccgcaattgccctcgcgcaccgcgtcgatcgcgcccggctggcggaaccccagatgtcgttgatcaggtcggcgcctgcggccagcgccgcgcgcatcacggccggcttgtaggtatcgatcgacagcggcacattcaacggacgcagcgcttcgacgagcgggatcacgcgcgcgagttcctcgtcgagcggcaccggggcgcgccggggcgcgtcgattcgccgccgatatcgagaagatcggcgccttcggcaatcatccgctcggcctggcgcagcgcatcgtcgcgcgcgaggaagcggccgccgtcggagaacgaatcgggcgtggcgttgagaatgcccatcacgagcgggcgctcgaacgtcagttcgaagcggccgcaccggagtggcgcgggaattttggggaaacagcggaatcggacacgggcaactggcgtgaatgaatgcaaaacgggccggtgtgaagacacaccagcccgtgaacggtgctaaagagcggagattatgccgccggcgaagcaggcgccggcgcgttgccggccttcacctcggcgctgctgccgccacccgacgaatcgccgccgacagccggcgagctcttcggggagcgcggcggacggccttccatgatgtcgttgatctgatcggcatcgatcgtctcccactccatcagcgcggcggtcatcgcttcgaccttgtcacggttctcttcgagcaggcggcgcgcaaggccgtactgttcgtcgagcacgcggcggatttccgaatcgaccttctgctgcgtcgcttccgagatcgtgcgcgtgaagccacggccgaacggcgatgcatcgttttcgtcgtcgacgtagaccatcggcccgagcgcatcggtcatgccgaaacgggcgaccatcgcgcgcgccgtctgggttgccttgttgaagtcgtccgacgcaccggtgctgacgaggttcatgaacaactcttccgccacccggccaccgaacaggatcgcgaggcggtccatcaggtagtccttcgagtacgtttcgttgtcatgctccggcaactgccacgtgacacccagcgcgcgaccgcgcggaatgatcgtgaccttgtgcacggggtcggccttcggcagcagcttcgcgatcaccgcgtggcccgactcgtgataagcggtcgcacgcttcgcttcctcgcggatcaccgccgacttgcgctccggacccatgaagatcttgtccttcgcgtcttcgaaatcctgcatctcgacgatgcgcttgccgcggcgtgcggcgaacagcgcagcctcgttcacgaggttcgcgagatcggcgcccgagaagcccggcgtgccgcgcgcgatgactgccgcatcgacgtcgttcgcgatcggtaccttgcgcaggtgcacgcgcatgatctgctcgcggccgcggatgtcgggcagaccgacgtagacctggcggtcgaaacggcccggacgcagcagcgccttgtcgagcacgtcggaacggttggttgcggcgatcacgatcacgcccgagttcgcctcgaagccgtccatctcgacgagcatctggttcagcgtctgttcgcgctcgtcgttgccgccgcccatgccggcgccgcgatgacggccgaccgcgtcgatttcgtcgatgaacacgatgcacggtgcatgcttcttcgcctgttcgaacatgtcgcgcacacgggccgcgccgacgccgacgaacatttcgacgaagtccgaacccgagatgctgaagaacggcactttcgcttcacccgcgatcgcgcgggccagcagcgtcttgccggtacccggagggccgacgagcagcacgccgcgcggaatgcggccgcccagtttctggaatttctgcggatcgcgcaggaagtcgacgagctcggacacttcttccttcgcttcgtcgcaacccgcgacgtcggagaagttcaccgcgttgttgttctcgtcgatcagccgcgcgcggatttgccgaacgagaacgcgccgcctttgccgcctccctgcatctgccgcatcatgtagaaccagaacacgatgatcaggatcgtcggcccgaggtagtacagcgcggacatcagcgcgttcggctcgtcgtcggccttgccgctgacctgcacgccgtacttcatcagatcgccaaccatccagatgtcgccgggcgacacgatctggtatttctggccatcagccggagtgacggtgaggttgcgccctgaacgatgacgttcttgaccttgccgttcttggcgtcgtccatgaactgcgaataggacacgccttcctggacgcggggcttgtcgaactgcttgaacaccgtaaacagcaccagtgcgatcaccagccacaccgctgccttcgaaaacatattgttgttcaaagcaccactccttcactcgtagacgagcgcctacattttccttgcggcgccctcggtcattctaatccagtccgaccaccctcgccataagcattgacaaccgccgcgatagcgcttcgcttgtctggcaagggccggagcccgtttgcggcaccccgccgcgcatcagcgcggacgtttcagatgccgacccaaaatgaacgtttcggacgatttgtcgcgggacgccttcggcttgcgcggcgcgacggtcttaaactgctgtttgaatttctcgacgatctggctgtagccgctgccgtgaaaacacttcacgagcaacgcaccatccggcttcagatggttctgcgcgaattcgagcgccagatcgcagagatgctcgatacgcgccgcgtccgccgaggccacgccggagaggttgggggccatgtcggaaataacaaggtccaccgcgcggccttcgagcaattcctcgagctggtgaaggacttcatcctcgcggaagtcgccctggaggaagtggacgtcggcgatcggctccatcggcaggatgtcgagcgcgacgatcgtgccgtcgatgccgccttcgcgctccgcatcgcgcttcttgccctgcgcgagcttgttgcgggcatactggctccagctgcccggcgtcgcgccgagatcgacgatcacctggcccggacggatcagcttgtcctgctcgtcgatttccttcagcttgtacgcggcgcgcgcgcgatagccctcccgctgcgccattttgacgtacgggtcgttgatgtggtcgtgcagccagtgctggttgaagcggtttttgccattcgaaagagagattgctgccaattgcttcgtgaagccgcgcttttagcggataatacgcgtcttcttcgcgcggctgcggccccttttcgggcccaagccgcgattttacgtggtttcggcgcacggctgacgcggtaactacccgcgatcgcttttcagtcagcgcgcccttatttagatttcgacatttccatgcccgccctttcgctttctcccgccgagcgctccgcgctgcgctcccaggcccatgcgctcaagcccgtcgtgctgatcggcgccgaagggctcaccgacgccgtgctgaaggaaatcaaggtgcacctcgacgcgcaccaactgatcaagatccgcgtattcggcgacgagcgcgacgcgcgcatcgcgatctacgacgagatctgcgatcgcctgagcgcggcgccgatccagcacatcggcaagctgctggtgatctggaagcccgaagccgccgttgcggccccggcccgcggccgtcgagccggcacgctgccgagcgcggccgaagccgcggacgacaagaaaggccgtgccccgcgcaccgtcaaggtcgtcaaggtgtcgccgaacgcgagccccgtgcgccgtccgcggccggtcaaggtcacggtgcgcggcaacgaacgcgtgacggcgggcggtaccgtgaagcgtgcgaaaaagcgccaagccagcacgaagcgtccgttccaggacaagtaagcatcggggcggcacggctgcgccgtaccgccactctgcccgcgggcccggcatcgaccgggtctgcgcggcacacgcgtcaggcgtcgcgcgccggcagacgccagatcagcatcagccccagtacgctctcgacgaggtagaacacgctcgagacgccgtgcagcatcccgaagcggctcgcatacggcgaattcgcgatatcggtgcccgcgtccatcgcggcgacccgcagcgcgttcatgaacggctgcagcgcaaaatacccgaccagcacacatacaaccatcgcggcgacgacccagcgcacgcggcgatattcgctgctgccgcgtcgaacctgctggttcgacagcgcgagcagcagcacgccgcatacgacaccgaggatcgcctcgatacggaacagctgggcggcgaccgaaccggccgtcatccgctccagcgtcttgaacagcacgggcgcgaccgcatacccgatcgtcagcaggctgccgacccacacggccgacagcagacggaacacgcgatgcggcatcgtgtcgccccgcttcagatgtagctgaccgagatgatttcgtattcgcgcacgccgctcggcgcctgcacggccgcgacgtcgccttcggacttgccgatcagtgcacgcgcgatcggcgagctgaccgagatcaggccgtgatcgatatcggcttcgtcgtcaccgacgatctggtacttgacggtgtcgcccgactcgagatcctcgagttcgacggtcgatgcgaaaaccacgcggccttcggcgtcgagcacggtcggatcgatgacctgcgcggccgacagcttcgattcgatttccgcgatacgaccctcgatgaagccctgcttttccttcgcggcatcgtattcggcgttttcggacaggtcgccctgtgcgcgggcctccgcgatcgcgttgatcacggccggccgctcgacggacttgaggcgctgcaattcatcgcgcagttgctctgcgccacgctttgtcaacggaatggtgctcataaacggctcaatcgctaaaaacggctataaatcaccgcgattaagcgcgtttccgatgcactggaaacaccgcctaatcgcggcacgtgttgcttctacaggtaactgactgcttagtttaggcgagcgtgaagaccttgtaaatcatagacttccagatccttcaggtagcgcaagccttcgactgccgcgcgcgcgccgacatcgtcgtgtagtacgtgaccttgtgcgcctgcgcgctcatgcggatcgaacgcgaatcggcgatcgcctggcgcgtttcgtcgaccgtcgtgaacacgagtgcgatctcgccgttcttgatcatgtcgacgatgtgcggacggccgtccttcaccttgttcacgaccttcaccggcacgccggccgcttcgatcgcggcagccgtgcccttcgtcgcgacgatcgggtagccgaggtcgtgcagcatgcgcgcgacttcaaccgccttcggtttatccgcatccatcacggtcagcagcaccgtgcccgactccggcaggcgcgaaccggccgcgagctgcgacttgaacagcgcttcgccgaacgtctggccgacgcccatcacttcgccggtggaacgcatttcaggcccgaggaccggatcgacggtcgggaacttgacgaacgggaacaccgcttccttcacgctgaagtacggcggctcgacttccttcgtcacgccctgctgcgcgagcttctggccgaccatcgcgcgcgccgcgatcttcgcgagcggcaggctggtcgccttcgacacgtacggcaccgtgcgcgatgcgcgcgggttcacttcgagcacgtagatgatgtcctgcttcgaaccgtcagcctgcggcacctgctggatcgcgaactgaacgttcatcagaccgaccacgttcagcgccttcgccatcgcgcccgtctggcgcttcagctcggccacggtctccttcgacagcgagtacggcggcagcgagcatgccgagtcgcccgagtggacgcccgcctgctcgatgtgctccatcacgccgccgatgaacacggcttcgccgtcgcagatgcagtcgacgtcgcactcgatcgcgtcgttcaggaagcggtcgagcagcaccggcgaatcgttcgacaccttcacggcctcgcgcatgtagcgctcgaggtcgcgcggctcgtggacgatttccatcgcgcggccgcccagcacgtacgacgggcgcacgaccagcggatagccgatttcggccgccagcgcgagcgcttcgtcttcggcgcgcgcggtgcggttcggcggctggcgcaggccgaggtcctgcagcagcttctggaagcgttcgcggtcttcggccgcgtcgatcatgtccggcgacgtgccgacgatcggcacgccgtgcgcctcgaggtcgagcgcgagcttcagcggcgtctggccgccgtactggacgatcacgccgaccggcttttccttgtcgacgatctcgagcacgtcttcgagcgtcagcggctcgaagtacaggcggtcggacgtgtcgtagtcggtcgacaccgtttccgggttgcagttgaccatgatcgtttcgtagccgtcctcgcgcatcgcgagcgccgcgtgcacgcagcagtagtcgaactcgatgccctggccgatccggttcgggccgccgcccagcaccatgatcttcttgttggtggtcggctgcgcctcgcactcttcctcataggtcgagtacatgtacgcggttttcgtcgcgaactcggccgcgcacgtgtcgacgcgcttgtagaccgggcgcacgttgagttcgatgcggcgcttgcggacgtcttccggcgtcgcgccgagcagcttcgcgagacggcggtcggagaagccgctctgcttcaggtagcgcagctcgtcgaacgtcagcgacgcgagcgtgcggcccgcgagcgccttttccttcaggatgatctgctcgatctgctcgaggaaccacgggtcgatcgcggtttccgcgaagatttcctcggccgtcatgccgatgcggaatgcatcgccgacgtaccagatgcgatccgggcccggctcgtggatctcgatcgcgatctcgtcgcggtcggtcgacttctcgtcgagaccgtcgacaccgacttcgaggccgcgcagcgccttctggaacgactcctggaacgtacggccgatcgccatcacctcgccgaccgacttcatctgcgtggtcaggcgcgaatcggcttcacggaacttctcgaacgcgaaacgcgggatcttcgtgacgacgtagtcgatggtcggctcgaacgacgccggcgtctggccgccggtgatttcgttcttcagctcgtcgagcgtgtagccgacggccagcttcgccgcgaccttcgcgatcgggaagcccgttgccttcgatgcgagcgccgacgaacgcgacacgcgcgggttcatttcgatgacgaccatgcggccgtccttcgggttgatcgagaactgcacgttcgagccgcccgtgtcgacgccgatctcgcgcagcaccgcgagcgatgcgttacgcaggatctggtattccttgtcggtgagcgtctgcgccggcgcgaccgtgatcgagtcgccggtgtgcacgcccatcgggtcgaggttctcgatcgagcagacgatgatgcagttgtcggcgcggtcgcgcacgacttccatctcgtattccttccagccgagcagcgactcttcgatcagcagctcgcgcgtgggcgacaggtcgagaccgcgcttgcagatctcctcgaactcttcgcggttgtacgcgataccgccgcccgagccgccgagcgtgaacgacggacggatcacgaccgggtagccgctgccgccggtgccggccatgatctcggcgtgcacctgggtcgcttcttccatcgagtgcgcgatgcccgacttcgcggaaccgagaccgatcttggtcatcgcttccttgaacttctggcggtcttccgccttgtcgatcgcttccggcgacgcgccgatcagctcgacgccgaacttctcgagcacgccgtggtggtgcaggtcgagcgcgcagttcagcgcggtctggccgcccatcgtaggcagaatcgcgtccgggcgctccttctcgatgatgcgcgcgacgacttcccacgtgatcggctcgatgtaggttacgtcggccgtattcgggtcggtcatgatcgtcgccgggttgctgttgacgagaacgaccttgtagccctcctcacgcaacgccttgcaagcctgcgcgcccgaatagtcgaactcgcacgcctggccgatgatgatcgggccggcgccgatgatgaggatgctcttgatgtctgtgcgttttggcatggcttgtgaattcaataagtaatcgttgtcgtgggtcggccggctgcgctcagctcatcgtggcgagcgcgagcttcaccgagaaaccgatgaacaggccgcccacgctgctcgccgcgcctgctgcaagcttgcggcggcggcggaagtgctcggcgagccgcgcacccgcgaagatcagcgtgctcaggtacaggaagctcgcgcattgcgcgatcgccccgagcacgacgaacgacagcgcgggatgcgggaatgccgggtcgacgaactggatgaagaacgagatgaagaacaggatcgccttcggattcagcaggctcacgatcagcgccttgcggaacggacgctcgccgtcgaccgcgggcggtacatcggccggcgcatcggtgcgcgcgcgcagcttctgccacgcgctgcgcagcatgccggtgccgatgtagagcagatacgcggcgccgccgtacttgacgacggagaacagcagcgggttcgccttcagcagcgacgcgacgccggcggcggacagcaccatcagcaccgtgtcgccgacgaacacgccgcacgccgcgcgatagccggccttcacgccgcgctgcgccgcgagcgacagcacgtacatcgagttcggccccggcagcaggatgatgaagatcacgccgaacacgtaggtccagatatccgtgatgccgagtgcgtggccgaacatgatgcgaatctcccgtccttcggttgcgtcggttgcgttaagcgttgcgctgcttcgccgcgtccatcagcgcggtgaagcggtcgaacagatagccgatgtcgtgcgggccgggcgacgcttccgggtggccctggaagcagaatgccggcttgtcggtcagctcgaagccctgcagcgtgccgtcgaacagcgacacgtgcgtcacgcgcgcgttggccggcagcgaatccgcatcgaccgcgaagccgtggttctgcgacgtgatcaccacgcggccgtcgccgagatccttcaccgggtggttcgcgccgtggtggcccgtcttcatcttcagcgtcttcgcgccgaccgcgagacccatgatctggtgacccaggcagatgccgaaggtcggcacgccgcgctcgatgaattgcttcgtggccgcgatcgcgtagtcgcacggttccggatcgccggggccgttcgacaggaagatgccgtccggattcagcgcgagcgcatcttccgcgctcgcctcggccggcagcaccgtcacgtggcagccgcgttcagcgagcatgcgcaggatgttgtacttgacgccgaaatcgtaggcgacgacacggtacttcggcgcttcctgcatgccgtagccgccttcgaggcgccattcggtctgcttccactcgaacggcttcgtggtcgacacgaccttcgcgagatccatgcccgcgagacccgggaacgagcgcgcgagttcgatcgctttcgcttcgtcgtccgagcccgtcaggatgcagccgttctgcgcgcccttgtcgcgcaggatgcgggtcagcttgcgggtgtcgatgccggcgatcgcgacgacgccttcgtcgcgcaggtagtcgccgagcgtgcggtccatgcggaagttcgatgcgagcgtgggcagatcacggatgatcaggccggcggcatggactttcgtggcttcgacgtcttcggcgttcacgccgacgttgccgatatgcggataggtgagcgtgacgatctggcgcgagtagctcgggtcggtcaggatttcctgatagccggtgatcgcggtattgaacacgacttcgccgatcgtatggccttcggccccgatcgaataaccacgaaagaccgtgccgtcggcgagtgcaagcaaggcgggagtaaaagacggcaacacgggaggctccttgggaacaccctgctgccgacctgtttaccctgccgcgcgagcgccgcgctgcgtgggcgcgcgtggtcgcttgctggacgcggcctgcgttgtcgagacgcgaacccggcgcgtggcgcacgaggcttcgcggcatcgcccggcaggcggcgtgcggcggatgaacgggatgtatgaggtaggcgctagggtgcgaggttgatcagcacaaactttcaaattatagcctgaaaatggccttatcttcaatcgatacggccgtccgatcgtgcgtgcgcgacgcgcggcggcgcgaagcagcgcgctgcggccccgttttacgcggccgccctgccccgagcgtaccgccggatcagtgcacttggccagcgccacgcgcgggccatacgtaccagaccgcgctcgcgagctgcagcgcgagcaacacaccccatgccgtgaagtgcgcggcggccggataacggccgtcgaccgcgggccagtgcgacagcaccgcgccgacaccgatctggaacgcaaagatcagcaggaagatcacgagcgtgagcgtcgtgttcgcgcggccgatcaggtgcgcgggaaaatgcccggccatcaccgcgtaggtcaggatgccaacgccgccgaacatcccgtatgcggcccacagaacggccggcggcaacggcacgcgcgccacgatcgcggcctgcgtcgcgacgaacaacgccatgccgatgccgcagaacgcgtacacggacacgccgcgccgctcgagcacgcgcgccgcggcgccgaagccgacgcagccggccatcatcgcgaagccgagcaccgacacgaggcacgccgcatgcggcgcatcgaacccgcgacgtcgcgcaggtacggcccgacccacagcgactgcatcgcgtagaaccccctgcgtgacgacagagaacgacgagatcttccagaacgcacgactgctcaggatatgccacgtgcccttgaactggctgacgagcccaccctggtgacgcacctgcttcgcctccggcgcgcccaggccgatcgacgccgcgacggccaccgtcagcaccgcgaggccgaaacagatcgcgcgccagctcgtccagccgagcagccaggtcagcggcgagccgaccatcacgccgccgaggccgcccacggccatcacgaggccgttcacgagcggcagccggccgaccgggaaatgctgcgcgagcgccttgaacgccgcgccgagacacaccgacacgccgacgccgatcaacagccggccgaccatcatcgtgccgaggctgtgcgcggcaccgaacacggctgcgccggcggccgcgaacagcagcatgccggccgtcacgcggcgcgggccgaagtgatcgagcatcacgccggccgggatctgcgcgcccgcgaagccgaggaaatagagactggtgagcaggccgagatcggcggccgacaacccgagctcgtgcgtgacgaacggcgcgaagcccagattgacgccgcgaaacacatacgacacgaaatacccgaccgaaaacagcgcgagcaccctcacctgcaccgacgacatcgcctctccttgttatatgaaggcattcaacgcggcaccccgcgccgcgcacaaacaaaaacgccgtcacctcggtgacggcgtttcgtcgcatttcgtcggatgataacgcaatcgcacgaaccgggccggccgcgcgatgcgctcgcgactgcgttatttcttcttgcccttgtgcgttgtggccttggccggcgccgctttcgtcgctttcgtcgatttggccgccggcttcgccgcgccgcgcttcgcgccgtgcgacttgccgcccaccgccaggctcgcgcgctcgatgtgcgcaccggcggccgacgtcgcgatccgttccggaccgggctccgccggcaccgaacggccgaccggcacgtgcagcacgagcgcctggcccggcatcacgagatcgcggtgcgtgcggttccacgccttgagctggccgaccgacacgccgtagcggccggcaatcgccgccatcgactgcttgcggcgcacgcggatcagcatcttgcgcgtgtcgggcacatcgggttccatcgcgagcgcgccgttttcggcgacgtcggcgctgatgtcctcgtcgtcgtcatcgccgcgcggcacgacgatcgtcgagcccggcttcaggcgcatgccggccggaatcttgttgatcgacatcagcgtatcggcgtccacgccgatcttctcggcgatcgcggccggccgtgcgcgttcgctgaccgtgtaggtggtccacgacgaaagctggccgttgtaggctttcaggttcttctcgaacgccgacgcgttgtcgaacggcagcaggatctgcggctcggtcgcgccgaggatcaccggcttcgagaacgacgggttcagcgagcggaattcgtcgagcgacaggttcgcgagcttcgcggcgaccgccacgtcgatgtcgcgcgacgtcgtgaccgtcacgaaatacgggtggttcgggatgtccggcagcgtcaggccgtactgctgcgggctcgcgatgatgttcttcaccgcctgcagcttcggcacgtagttgcgcgtctcgttcggcatccgcaggttctggtagtcggtcggcaggccggccgcctggttgcgcgcgatcgcacgctgcacgttgccctcgccccagttgtacgcggccagcgcgagataccagtcgccgaacatgtcatgcaggcgcgacaggtagtcgagcgcggcgctcgtcgacgcgagcacgtcgcggcgctcgtcctgccacatgttgcgcttcaggttgtaggtacggcccgtgccgggcatgaactgccacatgccggccgccttcgcgaccgacagcgcctgcgggttgtacgcggactcgatgaacggcaacagcgcgagctcggtcggcatgtgacgcgcctcgagctcctcgacgatgtgatacaggtacttctgcgagcgctcggtcatgcgctgcacgtagtcgggccgctgcgtgtaccaggtcgtctgcatgtcgacgaggtcgctctgcaggtcgggcatctggaaaccgcggcggatgcgccccagagatcggagtctgcactggtcaggtcgccgacggattgcttgtcgacgtcgacagtttctttggcggtggctgatttacggaggtagttggacgtcgcctgcgaatcggcggcgttgttggcgacaggggcctggctcgcacaagcggcgagcagcagaaccaccatcgcactcaatataagtcgcatgaaaatctcggcttccgacggctggaaattgcaggcgatactacggaagtgcgtgcttcacgtcaataaaaacaccgaaaactcagcgaaatcctacatttggagcaatttttacagacaccgcttgagctttggagtcctccggaaatcgtcatcggaaccggtttttccattcgcgcatcagcgtgaacgccgtcagacgatccggcaccgtttcatgcaactcggcctcgagcgtggcatgaatcgccgcgctgtccgcccgcatgaacgggttaacggcacgctcgtgagcaatcgtagtgggcagcgtcggcacaccccgcgcgcgcagcgcctgcgcttcgtcgcgccacgcagcgagcgccgcattgccgggctcgcatgcgagcgcgaagcgaatattggacagcgtgtattcgtgggcacaatgcacgcgcgtgtcgcccggcagcgcggcgagcgcgtcgagcgacgcgagcatctgcgcgggcgtgccctcgaacaggcggccgcagccgcacgagaacagcgtatcgccgcaaaacacgtgcggcgccgcgttgcgcggcccagccgcctggaaataggcgatgtggccgcgcgtgtgaccgggcacgtcgagcacgtcgaatgcgacggacggtgcgtcgagcgtcacgcgatcgccgcccgccagcggccgcgtgaccacgccgatcgcctcggccgcggggccgtaaaccgcgagcggagcatcgtccggttggctatcgcgcagtgccgcgacaccgccgacgtggtcggcatgatggtgcgtgagtaaaatagcggtcaaccgccagcctcgttcggcaagaacccggcgcaccggcgcggcttcacccggatcgacggcgatcgcatcgcggccgtccgagacgagccagatatagttgtcatcgaatgccggaaccggcacgtattccagctcgttcatgggcgcgcaatcatcgttatgtctgaccgtcaaattatagactggcccgcctggaccgactcgcctcccggccgctacgtgctgggctgggagcaggcgcagctcgaccggatcgtgtccgacgtcttcgggttccacgcgctgcagctcggcctgccgcagctcgacgcgctgcgcgagaaccgcatgccgtatcgcggcctcgtgctcgatccggcgagcggcgcgagcgcgccctatcagtatccgtgggcccgcgaagcccattcgcccgagcatgcacccgccgatcgcagcacgacctggtgcgacctgctcgacctgccgttcgagtcgcagagcgtcgacctgatcgtgatgccgcacacgctcgaattcacgtccgatccgcaccgcctgctgcgcgaggccgagcgcgtgctgatgccggaaggccagctcgtgatcaccggcttcaattcgctcagcctgtggggcatgcggcaatcgttcgggcgcatggcgaaccgtccgttcgtgccggccacgcgcgaccagatcgcgttcatccggctcaaggactggatcaagctgctcggcttcgacctcgaacgcggccgcttcggctgctaccggccgccgctcgtcaccgacaagtggctggcccgctacggcttcatggaagccgccggcgaccgctggtggccgatcttcggcgccgtctacatggtgacggccgtcaagcgcgtgcgcggcatgcgcctcgtcggccagatccggatgaagaaacccgtgctcgcaccgggcctgacgccggcggcctccccgaccacccatcaagaacattcatgacaatcgatacgatcgacatctataccgacggcgcctgcaagggcaaccccggccccggcggctggggcgcattgatgcgctacggcgacaaggaaaaggagctgttcggcggcgagccgaacacgaccaacaaccgcatggagctgatgggcgtgatcgccgcgctcgaagcgctgaagcggccgtgccaggtgatcgtgcacaccgactcgcaatacgtgcagaaaggcatcagcgagtggatccacggctggaagaaaaaggctgggtcaccgcggcgaagacgcccgtgaagaacgccgacctgtggaagcggctcgacgcgctcgtcgcgcagcacgaggtcgagtggcgctgggtcaagggccacgcgggccatcccgaaaacgagcgcgcggatgcgctcgcgaatcgcggcgtcgaatcgctcacggcctgaacgcgggccgccccctgtttcctacgttttcccgacatgcgccagatcattctcgataccgaaaccaccggcctgaacgcccgcacgggcgaccgcctcatcgaaatcggctgcgtcgagctgctgaaccggcggctcaccggcaacaacctgcacttctacgtgaaccccgagcgcgacagcgatcccggcgcgctggcggtgcacggcctcacgaccgaattcctcagcgacaagccgaaattcgcggaagtcgccgaccagatccgcgacttcgtgaaggacgccgagctgatcatccacaatgcgccgttcgaccttggctttctcgacgcggaattcgcgcggctcggcctgccgccgttcaccgaacattgcggcggcgtgatcgacacgctcgtgcaggccaagcagatgttcccgggaagcgcaactcgctcgacgcgctgtgcgaccgcttcggcatcagcaacgcgcaccgtacgctgcacggcgcactgctcgactcggaactgctcgccgaggtctatctcgcgatgacgcgcggccaggacagcctcgtgatcgacatgctcgacgacgcgggtgccgacggcggcgcggcaaacggccagcgcgtgtcgctcgccgcgctcgacctggtcgtggtggccgcgagcgacgacgagctcgccgcgcaccaggcgcagctcgacgagctcgacaagtcggtcaagggcacctgcgtatggcgcaagtccgccgacgcaggcgccgccgaaacggcctgatacacacggcacacggcgtgcgccgcggccgcgctcacgcgcgcggctgcagcgcgatgaccgccattccgccgagcgcgagcgccgcgccggccacgtcccagcgggtcagcgcgacgccgtcgaccacccgcagccagaccagcgccaccgcgatgtacacgccgccgtacgcggcataggtgcgccccgccgcactcgggtgcaacgtcagcagccacgcgaacaacgcgagcgacagcgcggccggcagcagcagccacaccggccgcccctccttcagcacgagccacggcaggtaacagccgacgatttcggccagcgcggtggcggcgaacagcgccgcgatcctcatcagttcggtcatccggttcctcgtgaattcgcccccgccaccgcgaggcggcacggccccgccgcgcgccgccgatcatacccgagccgcccccgccgaacgccccgccagacgggcgcttcccggcaatttgcacgatcatccgtcatcgtgctatcatgtcgcctgtttcaacattcaatctctgtctattcgatttcgagagaagtccgtccgcgcgttgcaggccggcccttcgaccgaaattgcacccacaggaaagcccgcccgacaggcccgcttttctcgtttcgttgcccctccggggcgcttgccggaacgccggacatcgtccgcaccggcatctgccgcttgcatcacgcggcccattcttcatgagcgcactgtcgcgacggcccatcgggcccgcgtcgaagcagccccttacggccctttaccgccgcttgtgcagtaagtgcttaatggtctgccccgacacgccgcacacgacaccgcgctcgccggcaaaccgtgtcggacggcccgcccgttcggcgcagtcaaaggagtgcatgaccttgaccgcaacacacgtcagcccgaccgctgcctcttcctccgcttcgtcgtccggcgaagccccgctcgtcgcggacgacatcaccgtcgtcgaccagagcctgctcaagcgcgccgtcagcgcgatggccatcggcaatgcgatggaatggttcgacttcggcgtctacagctacatcgccgtcacgctcggcaaggtgttcttcccgtccagcagcccgtccgcgcagctgctcgccaccttcggcacattcgcggccgccttcctcgtgcgcccgctcggcggcatggtgttcggcccgctcggcgaccgcatcggccgccagcgcgtcctcgccgccacgatgatcatgatggccgtcggcaccttcgcgatcggcctcattcccagctacgcgtcgatcggcatcatggcgcccgtgctgctgctcgtcgcccgcctcgtgcagggcttctcgaccggcggcgaatacggcggcgcggccaccttcatcgccgagttctcgaccgacaagcgccgcggcttcatgggcagcttcctcgaattcggcacgctgatcggctatgtgatgggtgccggtgtcgtcgcgctgctcaccgcgtcgctgtcgcaggaggcgctgctgtcgtggggctggcgtgtgccgttcctgatcgccggcccgctcggcctgatcggcctgtacatccggatgaagctcgaggaaacgccggcgttcaagcgccaggccgaggagcgcgaagcgcaggacaaggccgtgccgaaggcgcgcttccgcgaaacgctgatgcgcaactggcgtgcgctgctgctgtgcgtcggcctcgtgctgatcttcaacgtcaccgactacatggtgctgtcgtacctgccgagcttcatgtcgtcgacgctgcatttcgacgaatcgcacagcctcgtgctcgtgctgatcgtgatggtgctgatgatgccgctgacgctcgccgccggccgcctgtccgaccggatcggccgcaagcccgtgatgctcgccggctgcgtcggcctgctcgcgctgtcgatcccgtcgatgatgctgatccatgccggcaccacggcatcggtgttcggcggcctgctgatcctcggcgtgctgctgtcgtgctttaccggcgtgatgccgtcggcgctgccggcactgttcccgaccgagatccgctacggcgcgctcgccatcggcttcaacgtgtcggtgtcgctgttcggcggcacgacgccgctggtcaccgcgtggctcgtcgacgtcacgcacaacctgatgatgcccgcgtactacatgatgggcgccgccgtgatcggcatcgtgtcggtcgtcgcgctcgccgaaaccgcacgccagccgctcaagggctcgccgccggccgtcgcgacgcgccgcgaagcccaccagctcgtgcgccagatgcgcgaggacgacgattcgggcatgtaccctgccgtgtcgaccgcacgcgcctgagcgtcgcccatgaaaaccccggccgaagccggggtccgatcgaatccgatccgcccgaccggcttgcgccggccgggctttttcatccctcaccgcgtacgcgctcatgcgtgcgcttcgcagttgcggcagaacagcagtgcgcgcgatcgcgacacggccgcctgtgcaccacgcgtcgcgacgatcagcccgacctgaccgagattgaaatcgcgctcgaccatcaactgcgtcagcgcggcaagcggcaacacgacggacgggtggtacaggctcgattcgatcagggttcgcatcatcagctccatcaggcaaggcgtcattcgatggagtggattctagggatcggcgcccgccggataaaccgcgcgaatgcgaagtcacttgtcagccgcggagaacaatccgccgacgcttgcctggcaaggcccggcgggctgcccgcagcagccggatggcccgccggcgggcctacacaagcggcgtttcgacgaaggccggcagcgcttccgcccgcgcggaatgcgcggcgagcgccggataacgggccggatcgatccgcgcgagcaccgggtagtcggccgccatgaactgcgtgaagcgccatgcgaccgccaccgtcacgtcggactgcagcaggcgcgcaccgccgaaccagccgttcgcggcggcgacgagcggctccagtgcaccgtatgcgccctcgatctggctcagcacgcgctcgagccacggcgcgtgctgcttgtcggccggacgcagcgcctgctcgtagacgacctgcacgctcttctcggcagctgccagcgcgaaaccgaccggcacgagcgtgttcaggcgcgcggccgcatcctcgggcagcagccgccgcgcgggcgcgacccgatgatcgagataatcgacgatcagcgacgaatccatcagcgtcgcaccgtcgtcggtcacgagcgtcggtgccttgacgaccggattgatcgccctgaactgctcgacatgacggaacaccgagagcgactcgtgttcgaacgggaggtcgagcagcttcgccgaaatggcgacacggcgcacgaacggggaatccagcatgccgatcagcttcatcgcaaacgctccgcttgagggaatgggatcgacgactgtagcagcgccgcagggcttcgcctagcgcgcccgtgcgcttgatgcgcctcagccggccgcacgcggggctcacgttgtccggccgcagtgaccataatgcaagttcacgccccttccgccccaaggttcgccatgtggtacgccctcgtcgagcagcagcgggaatggatgcgcgcctggcgcgcggcgacgcggcatgcgttcgacgcgtggcccgcggccacgctgccgcacgccgcatcgtcgtgctacgacgacctgttcgagccgctgctcgggccgccgggcgagccccgcacttcgacatcgggtggccggccgtcggcgagcgcatcgtcgcgcgcacgccgttctgcgacctgcggcgcttcacgcgcgtcgacgcgcggcgcacggtactgctctgcgcgccgctcgccgggcatgcggccgtgatgatgcgggaaaccgtcgagacgctgctcgcggacggcgacgtctgcgtgaccgactggcgcaatgcgcgcgacgtgccgctcgcggcgggccgcttcgggctcgacgaatatgtcgcgacgctcgacggcttcgtcgacgggctcgcgcacgacgaccggccgctgcatgtcgtcgccgtgtgccaggcaaccgtgccggtgctcggcgcgctcgcgctgcgcgccgctcgcggtctcgcgccgcccgcgagcgtcacgctgatcggcggcccgctcgacgcgcgccggaatccgagtgcgctcggcaccgccgccgcgacccattcgctgggctggtgccgccgccacctgatcgacgtcgtgccgccgggtttcgcggggcatggccgccacgtgtttcccacctatctgcagcagggcgagatcgcgctcgtgtacccgcagcgcttcctgtcgctgatcgaagcgtacgcgctggccgcgtcgcgcttcgacatgaccgggctcgccggcgcacggcgtgcgctgctcgaatacacggcgctgctcgacatgcccgccgagtatttcctcgacacggtcgacatcgtgttccagcgcatgagcctcgcggtcggtacctgggacgtgggtgggcggcgcgtcgagccggccgcgctgcgcggcgtcgcgctgctgaccgtcgaaggcgcatgcgacgcggtcacgggcgccggccagacgcatgcggcgctcgacatgtgctgcggcctcgccgacgacgagcgctaccgcatcgacatcggcgactgcgatcactacgggttgtttaccggggtgtgctggcgcgggaggtccatccgatgctgcagcgcctgttcgcgtgggccgaaacccgtcgcccccgcccgcgccgcatcaggcgcacctgatgccgcgtcagggccgggccgcgtcgagcaatgcgcgtacctcgtcgtcgctcgtctgctcgaagcgcgcgtagaactggctgatcccgaagaacggcagcggctgccacaccgtgacgaacgcatcggccagatcgtcgaacgcgtgccgcgcacccgccggcgcgaccggcacagccgcgacgatgcgcgccgggtgacgctcgcgcaacgtctgcagcgcgacgcgcatcgatgcgccggtcgcgacgccgtcgtcgacgacgatcgcaatgcggccctcgaccggcagcggcggcgcggcaccgcgatacagcgcctcgcggcgatgcagttcgaccgtctcgcgcgcgatcacatcggcgagctgcgcgtcggacacgcccatcgagcggagcaccgaacgctgcagatgaatcgcaccgcccgtcgcgatcgcgcccatcgcgagctcgggatcggacggcacgccgagcttgcgtacgaccagcacgtcgagcggcgcgtgcagcgcgcaggcgaccggatacgcgacgggcacaccgccgcgcggcaaggcgagcacgacgacattgccgcggcccgcataatcgcgcaacgcgccggccagctggcagccggcatcggtacgatcggcaaaacactcgaacacgttcggctccctgccgttgcgccggaggcgcgaaacccgcgtcggcgcctgtcaacgagcatggttcatcggcagcgccgatgcaagcagggtcacaccggcgcgcggggcaccgaaggaaagggtcagaggccgccggcctgccggtacagccgccagaacgactgcgcataggattgcgcgagctcgggcgcgcgctggaacacgttcaccgtttccgcatgcgcagccgcccttcggagagcgtcgtcagcgcgacgctgtcgtccacgatcacgaagcgcggcgcgggatcgccgtgccgcgactcgatcgccacgtcgatacccgacgctttcagatagcccgcgccgctgtaccggcccgcgtgcggcgaacgcacgagcacgacacgcacctcgatcccgcgcgagcgggccgcgcgcagcgcgctcgcgaccgccggcggcacgtgcgtatagccggccagcaacacgcgacgctgcgcctgctcgatcaggtcgacggtcgcgtcggccgccgcattgtcatacgaaagtatgtgccgaccgatgcggcgtcggacggaatctggctggcgtgggcgctcgccgcgcagcagagcgcggcgagaaggaaggcggctggtctcatggcgggcgccattttagcgacgccaattcgtgtggcaagcgccggctgcaaggctgctgcgccggcgcaacacacagtgcgaaaggcgactccggcgagggtcttccgggccgtcgatcagcccgccgcgacgcgcgcgagccagctcgcgacgccgtcgacggaacggaaatccgcgaggctgcgcgccggcagcgcgggatatgcgctaccggccatctcggccagcgcgcggccggggccgagctcgaggaacgcggtcgcaccggcctccacgcacgcggcaagacaggccgcccactcgaccggctccgcgatctgccgggccagcttgtcgagtcccgcgtcgacgtcgagcaccgacgcgccgtcgatacccgaaaagagccgcgtgccgggcagcggccgccgcacgtgagcggcggcgagcgacgcgcgaaacaccggcacggccgcggcgagccggcgcgtgtgcgacgcgatccgcacgcagacgggcgcgacgcgcagcgcaccgtcgcgcgatgcgtcgtcggccaccgcatccacatcgggctggcgccccgcgaccacgaacgcgtcgcccgggttcgcgatcgcgatcgccgcgtcgcggccgtcgcacaatcgcgcaagccgagcgcgcgtcaggccgcgcacgaacaccatccgctcgtcgccgccgctcgcggcatccatggcacgcgcacgcgcatcggccaggtcgagcgcggcgtccggctcgatcatccccgcgacgctccacgacgcgacttcgccgacgctgtagccggcgacgcagcgccggcgcggccacaccgcgtcgagcagcgcggccgccgcgagcgcctggagcgtgcagaggatctgcgcggcacggttttcacgcagcgcgtccggcccggcctgccgcacccacgcgcgcggatcgtcgcctagcagccggccggcgtgggcgaacagcgcgtcggcctgcggcgcggtgccggtcaggtcgaacatgtcggcgcgctgcgcgccctgtcccgaacagaggatggccagcgtcatcgcgcgcctccgtcggcttcgagcgcatcgacgaagacgctcatcgcgagcaggtcggccgcgccgcccgggctcagccggcgcgcgacgaacgcacggtgcgcggcggccgcgcgtaaccgccagtcgcgcgcgcgcacgccgccgcgtgcgacgaacgcgcgtgcggccgcctgcgcgaattcgagaccgtcctgcccgccccggtgcagcaggttcgtatcgtcgagcgcggcgatcagcgcgaagcacgcgtcgacgcgcgccgcttccgggtcgccgggcaggtcgcgccgcgcgcggcgcagcgcgggcagcccgaccgcatagacggtcgtgaaaccgtcggccgcctcgcggcgcgcgccgccgacgccgtagcggcggctcgcgcgttcgccgtggctgtcgggcaggcgcggaccgccgaggatatcggcgccccagcggcgggagacgaacgcgccgagcgtcgtcccgcccggcacggcgcccggcgtcgcacgccggcccgccgccgcacacagcagcccgagcccgaagatcgccccgcgatgcgtgttgacgccgcccgtcgcggcgagcatcgcgtgctcggcacgcaggccgatcttgcgcagcacggccatgtccgcatcgcgcgcgcctgcgtcggccagttccgcgaagtaaggccgcagcacggcggcgctacgcgcgaacgtcgcggcatccatgtcggtgtgactgccggtgtcgacgtgactgacgagccccggcttcggataggtctcgatctcgagcacgaggctgcgctcggccagttcggcgatgcgcccggcttcggacggcgccggtatgcggcaggcggcccatgcactcatcgcgcgcccccggtgaaggcgtcgaccggcatcagttcgacggcgatcgccgtcttgaccgcgacttcaggctgccgcgcatgcagttcgcgccagttgacgcccgcgccgtcgttgcgcagcagttcgccgtcgatgcgcatgggcgcgcgcccgtcgatcgacgcgaggccgtcgagcagcggcgcgaccgatgcagcttccggtagcgggaacacgatgtcgaggtcggacgactcgcccaggtacggctcgcccgtcagcgcctgccatgcgaggctgccgaacacgcggccctgcacgccgcaccgcgcgccgagcgcatcgagctcgcgcaacggcgtgcgccatgcgtcgggcgcggccgcgagcacgtcggacaacgtgggcagcgggccgaccgtcgcgagcgcatcggccgctgcgttcaacgcgatgcgccgcttgcccgcggacggcggcagcggcaggccgagcggcacgcggccggcatcggcctcgtcgggcgacgcgcggcgcacgatcagcggccggccgcgcgcggcccacgcctgcacgagcggatcggcggcgagcgcgggatcgcgcgcgaatgccgcgccccaccccgccgccgtcaacgtgacgagcgtgtggcggcgcagcggcatctcagcgcgcggcacgcgcgagcgcctcgacgcgccgcgcgacatcggcagccaccggtcggccgcgcgcagcgcgccggtcgacgcgctcggccggcttgccgagccattcaccgacctgcgcgtcgagcgcgcgggccggatcgagcacggcgtcgacggcgcccatcttcacgagattgtcgagccccggcgcgaacaccggcgtcgagcgcgccatctccttcagcacgtcgatcggcagcttggtcacgcgcgacatcgacggcaggtccatcacttccggttcggcgcccggcaccgcaagcagcgtgcgcgtcgcgagcgcggtcgcgatgaacgcgccggcggccgtgtggccgtacagcacgccgatcgtccggtgcccggcgagatccgcgtgcatcaggcacttcgcgagatgcgacagcccctcgttcaggccgagcagttcgtcgcgcttgctcatccgctggctgtcgctgtcgacgagcacgaggatcggcgtgtcgccgccgcgcgcgatcgtgtcgagcacgcgggccgcgagcgtcagcgcctcgtcgatgccgaacggcaagcggtcggcgacgccgatcacgtcgacgcgtgtaccggccagttccgcatgccccgtcaacaggccgccggtgcgggtgatcgaatggccctggggaaacaaggcgttcagcacttcatcgagcgtcatgcgtgctctcctgcaattgatccgcgagcgacgcgaacgtgtcgtccggcatgcccggaatcgcttccggcttgtcggccccgagcgtgcgccagacgtcgagcgcatcgtggcatgcgccgaaccgttcgacacgcgcctcgagacgcgcctgctcggcacgcagcatcgccgcatcgaacgtcggagcacgcccgatcagctcgagcgccgccgcgcggaatgcgtccggcgtatcggccacgtagcgatccgcgccgccgatcagccgccggtgcttgccgcccatcgtgcgccagatcagcgcgcggtccttcgaatcgaactcctcgacgccgcgattggtttcgatcacctcggggcccgacacgctgatacggccctgctccgacaccgcaagcgccgagcagcacgcggcgagcaacccgccgccgccgtagcagcccgcgcgcccgccgatcagcccgatcaccggcacgccggccgcacgcgcttcgacgagcgcgcgcatgatctcggcaatcgcgagttcgcccgcgttcgcctcctgcagccgcacgcccccgtatcgaacaggatcagcaccggcttgccgacttcgcgcgcggcgcgcagcagcccggtgagcttcgcgccgtgcacttcgccgaacgccccgcccatgaagcggccttcctgcgcggcgacgaacaccggctgcccgtcgagccggccgtggccgaccaccatcccgtcgtcgaactgctgcggcaggtcgaacagcggcaagtgcgggctcgtcacgcgttcggccggcccgaggaattcgtcgaagctgcccgcgtcgagcagcccgtcgacgcgctgccgcgccgacgcttcgtaccagctcgccccattcgcgacgaacgcgggcgtgtcgtggatcgcgtcgttcatcatgcgtcccctcgatcgcgcgcacggcctgcgcgagccgcagcgacaccatgtcgggccgcgcgccgccgtcgttgatcgacagcttcaggccgcccggcgtgcgccgctcgacgaaatccgtgacgacggcctgccacaccgcaccgaaaccgaccgccgcggtgcggatatcgatctcgcattcgttgcccggcagcacgcgctcgacgagcacctcgagattgccggatgccaccacgccgacgagcgccgcggccagctcgcccttcgcgcgctcgcgcgcggtgaagcgatagttcaactgttccatgccctcttcctcaccagttgcggaaccgggccggcggcgcatagagcccgcccgaccagtgcacgagatccttgatcgagcgcgcggcgagccagcggcgatcggcgtcgagcggatcgatgccgagatcctccggacggcggatcacgccgcgctcgcgcagccgctcaaccatcttccggtcgcggccgcggccgatctccgtataaccggcgacgccgcggatcgcgtgctcgcgttcgtccttgtcgcggcacatcagcaggttcgcaatcccttcctcggtaacgatgtgcgtgacgtcgtcgccgtagaccatgatcggcgcgaggtcgagctgcagcttgtcggcgagcttcagcgcgtcgagtttctcgacgaacatcggcacgttcttgtcgccgaacgtctcgccgatctgcacgacgagcttgcggccgcgcctgagtgccgccggcgtatcggggtcggcttccgcgccggccttcagccacggctcgctcgggtgacgccggccgcgggcgtcgctgcccatgttcggcgcgccgccgaaaccggcgatgcgctcggcggtgaccgtcgacgaatggccggacaggtcgatctgcagcgtcgagccgatgaacatgtcgcacgcgtagaggccggccgtctggcagaacgcgcggttcgagcgcagcgacccgtcggagcccgtgaaccatacgtcggaacgcgcgcggatgtagtcgtccatcccgacctccgagccgaagcagtggatctgctcgacccagcccgattcgatcgcgggaatcagcgtcgggtgcggattgagcgcccagtgcgagcagaccttgcccttcagcccgagcttctcgccgtaggtcggcagcagcagttcgatcgcggccgtgttgaagccgatcccgtggttcaggcgcttgatgccgtaaggttcgtagatgcccttgatcgcgagcatcgcggtgaggatctgcgtttcggtgatcgcggccgggtcgcgcgtgaacagcggctcgacgtagaacggccggcccgcctcgacgacgaagtgcacgcggtcgccgggaatgtcgacgcgcggcaccttgtcgacgatgcggtcgacctgcgcgatcacgatgccgtccttgaacgcggtggcctcgacgacggtcggcgtgtcctcggtgttcgggccggtgtacaggttgccgtcggcgtcggcgctgaccgcggcgatcagcgcgacctgcggcgtgaggtcgatgaagtagcgcgcgaacagctcgagataggtgtgcaccgcgccgagcgcgatcttgccgccgaacagcagcttcgcgatgcgctgcgactgcgggcccgaatacgcgaagtcgaggcgcttcgcgatgccgcgctcgaacacgtcgagatgctcgggcagcacgacgcccgactgcaccatgtgcaggtcgtgaatcttcgcgctgtcgacgtcggcgagcgccgtcgcgagcaggtcggcctgcttctggttgtcgccttcgaggcacacgcggtcgccgggccgcagcaccgcttcgagcaacgcgacggcgtcgcgcgcatcgacccgcttgccctgcgcgaaacgcgcaccggccgcgaggcgtgcatcgcgcgcctgccgcgcgtgattccatcccgtcatgaacagttctcccgcttcgatggttcagcggcattctaagcctggcgccgccgccgattgatgatgttgacgaatgcgactcagaggacgccgcgatggatgcggcccgcacgcttgggccgcatcgcagcgcgctacgcgccgaccagcgcgcgcgtcgtgaagaacagcaccgacggcccgagcaggcagccgacgcccgtatggaacgtcgcgaccaatgcgccgtacgggacgagccggcggtcggtcgcggcgagccccgcgctcacgccgctgacggtgccggccaggccgccgaagatcatcgcggagcgcggcgtcttcaggcccatgaagttggccgcgaccggcgtgccgaccatcacgatgatcgccttcacgagccccgtcgcgatgctgagcgcgatcacgtcggaactcgcgccgatcgccgcgcccgtcacggggccgacgatgtaggtgacggcgcccgcgccgatggtcgtcatgctgaccgcatcggtgtagccgaacgcgcgcgcgatgcatgcaccgacgatgaacggcagcacggtgccgagcagcagcgacacgacgccgacgagcccggccttgcgtgcctcggtcggctgcacttcgaacgcggtcgcgacgatcgcgaaatcgcgcagcatcgcgccgcccatcaggccgacgcccgcgaacagcttgacgtcggccagccctttctcgccgccggtgaatgcgccgccgacgtaggcgagcacgaggccgatcacgatcgcgatcgcggagccgtgcacgcggccgaacgtgagcttgcgcgacgcgatcgacgacagccacatgatcaggccgaccagcgcgaacgacgcgacgagcccgttgtgggcgacgactttttcgagcatctgcagcatggcggcctccttcactgttcttcgaattgcggcacggccgcgaaggccgtgtcgtcgcgcccggtgcgcacgagtaccgcgatgcagcatgcgcagatcgcgaccgcgccgacggcggccagcagcgcgacggggccgcccttgagcgcggcgacgacgttctggttcgcggccatcgcgacgacgacggggatgtacatcgcgccccagaacccgacgccggcctcggtttccttcggcagccagccgcgccggtgcagccacaggcgcaggcagatcagcagcagcatcgcgatgccgacgccgccgacattggtcttcacgccgatcgcgctgccgagcaggtcgccgaggaacaggccggccaggtggcagaacgccagcagcgcggttccgtagatgatcatgagtcgtctccagtctcttcgtgacgggcgccggacgcatgcaggaaccggccccgcacgccgatcccgtgcgcggactcgtctcctgcggcggtgcgccgcggcccggcggcccgtcatgcgggcgcgttctcgggcggtcgatgggatgatgcggtttcgggccggatgccggatgccgtagactgaccgatgcagccgccggcacgacgcgggctacgcatccggtgcgcgccgtgacgggcacgcaccgaggcgtgatccgatactagcgccgcaatatccggccatttatgaagttgtcgaaaccgattcagtggatttagcaatgcgcccgttaccgcccgagctgctgcgcagcttcgtcgccgtcgcccagtccggcagcttcaccgccgcgtccgagcgcgtgagcctgtcgcagtcgaccgtcagccagcatatccgccgcctcgaggagctgctcgaccggccgctgttcgaacgcgacacgcgcaacgtgcacctgtcgcagcacggcgacgcgctgttccgctacgcggtgcgcatcctcgaactgatggacgaagccgtcacgtcggtgtgcgggccgccgctgtcgggcaaggtgcgactcgcgatgtcggaggatttcgcgtcggcgcacctgacggccgcgctcgcgagcttcgtgcagcgcaatccggaagtcgagctcgcgatctcgaccgggctgtcgggcgatctgttcgacgcgctcgacgaagggcggcacgatctcgtgttcgcgaagcgcatcgcgggcagccggcgcggccgcgtgatccgcagcgagccgctgtactggtgcacgggccccgattcgcggatcaccggccacgaggccgtgctgccgctcgcgatgcatccggagccgagcgtgtcgcgccgccgcgtgctcgaatcgctcgaagccgtcgggcggccgtaccggatcgcggtagtcagcagcagcgtcgcggtgttgcgcgccgccgcgagcgcggggctcggcgtcagcgcgttcgcgggctacgtgatcccggccgggctcgcgcggctcgacgcggggctgcccgaactcggcgaactcgagtacgtgatcgaccggccggcggccgcgtcgcgatcgacgctcgcgctcgaagccacgctgatcacggcggcgtcggagttgtaagctcaccgggcgcgacgcacgcatgcgcggccggctgcgcccgcaactgacagttctgcccggaacgcgtcatcgtccgcgcagcacccgctcacgacaatgggccccatcggaacgcacggcagccgccgcgcgcatccggtgtcccgtccccttgatcggagcacgccatgattgtcttgcgattcgccgtcgcgaccgccgccgccgccctgctgtccccgcctttgcccagaccgatgccgccgcgcccgaacagggcctgacacgcgcggaagtcgtcgcccagctcaagcaggcctatctcgacggtgaactgccgacgaacgacggcaactacccgccgagcgccgcgacgcgcgcgcgcaaccgcgaactcgtgcaggccgcgagcccgtcgtggcttgcccagacgccgcgggcaccgcaaaccgccgcgcagcagtagcggagcgcggcccgaccgatcgcggcccgaccgaaacgctccgcccaggcgcgatcacggcaggaagctgcggcgccgcgcgtcgatcagctcgacgagcaggcggtcgcgttcggccgccagttcctgcatcgagcgctcgccctggatcgcgcgcaattcgtcgttcagcttgcgatcgacgtccgggttgaacgacggcgtgccgaggtcgtcccaccagctcgtgatcggccccgacaggtgttcgaggaagtgcgcgattccgcccgcgccgccgccgaggtgataggtcaggcactgccccatcagcccccagcgcaggccgggccccatgcgacggccttgtccgcatcggcaacgctcacgacgccttcgccgacgaggtgatacacctcgcggaacagcgccgccgcgagccggttcgcgacgtggccggtcatctccttgttgaggacgatcgtctgcttgccgagcgcatcgtagaacgccttcacgcgcgcgatcacgtcctggccggtggcctcgccgccgaccagctcgacgagcggaatcaggtgcggcggattgaacggatgcgcaatcaggcaacgttccggatgcttttcgcacgcggtctggatgtccgacattttcaggcccgacgaactcgacgcgatcggcacgtgcgcgggcagcacgtcgtccatctgccggtacagcgcacgcttcaggtcgagccgctccgggccgttctcctgcacgaagtcgacgccgtcgagcgcacgcacgagatcggcatcgaacgacagccgcgcggaaagctcggcggcccgctcgccgagaaacgcggccagtgcgtcgcgcagccgcgcgtcggcttgcggcgccggatcggtcgcgacgacgtcgaagccctgcgtcagatagaaagcggcccagctggcgccgatcacgccggcgccgacgatcgcgatgcgtcgaatgtccatggttgtcccgtgtcgttggtctgcgatagatcgcggcgattgtcgcatcgaaccgcacgggcctgcattgatgcagattgtggatcccctcttgaaatgcgctgcggcggccactaattacgcgtcgtcgggcagtgcaccacagcacgcactgcccccgtttcgacccagtggagcccccgcgtcgcgcccgcctcaggcgtcgcgccgtcgcgtctcccgcgttccctgttcaggaggactcacatgagcggtatccatttcggcagcgacctgttcgacgaattcgcccgcgtgcagcggcaggtggcgagcctgctcggcgatcgtccgtccggcattcgcgcggtgcggcccggcgcctttccgcactcaacgtcggcgccaccgacggcgcgatcgagatcgtcgcgttcgcgcccggcatggctgcggccgacttcgacgtgtcgatcgacaaggacctgctgacgatcagcggcgagcgcaagccggcgccaggcggtgaaagcgacgacctgcgcacctatgcgcaggagcgctttcacggtgcgttccgccgcgtcgtcgagctgccgcgtgacgcggatcccgaccaggtcagcgcccgctatgaaaacggctgcctgctgattcgcgtcggccggcgcgaggcatcgaagccgcgcgcgatcaccgttcaataattctcaggataccgacatgactgcgaacccgaccctggccgaacgccaaacgagcaccgtccaccccgctgccgccgaagcggtgcgccggcccgcgatcacgccggccgtcgacatcgtcgagaatcacctcggcgtcacgctgcgggccgacctgcctggcgtgccgcgcgagaacctcgacgtgaaggtgcacgacaacacgctgacgatcgaggccgacacgcacctcgatacgccggccgacctccgcgtgcggcatgccgaaatccgcgcgacgcgctatgcgcgcagcttcgtgctgagccccgacctcgacacgtcgaggatcgacgcgaacctgcgcgacggcgtgctgacgctgacgattccgcgccgcgaggaaacgcgtccgcgccgcatcgacgtgacggccggcaacgcgtaagcatcggtgcgcgccgtcgtcctgcacgcgtgaaaaagccccgccgggtacgtgcccggcggggcttttcaatgacatggcgacatcggcggagtcagtcgaagtcgaacaggtcgaacaccgatttccggcgacgctggccgtcatgcttgtaacgatcgccgtgcgagcggccatcgtgcctgtcccggtcgtcgtgcgcgcggccgtcgcgccccacccgccgtcatggccgcgcggcgcttgcgcatcgtgccgcacgggcgtctcgtcgcgacgcaccggcgcgtcgccggtctcgcgcgcgatcagcttgtcgagttcgccgcgatcgagccatacgccgcggcaggtcggacagtagtcgatttcgatcgactggcgctcggccatcagcaggtcgggcgtcttgcagacagggcatttcatcgcgcttctcctttccgtgcgaatttcgtctggatgccatatgagacgcgcgagccggttgccgcctgagcggcagccggcgtcgcgcgcggccgctcagcggccttccgtccgtgccgcgcgcttcgccttcgcgcgccgcgccagcatgttcatgccctcgacgaacgccgagaacgccatcgccgcgtagatgtaacccttcggcacatgcgagccgaaaccttcggcgatcagcgtcatgccgatcaccaccaggaacgacagcgcgagcatcacgatggtcgggttgcggtcgatgaagcgtgcgagcggctgcgcggcgaacagcatcacggagacggcgacgatcaccgcgacgaacatgatcggcacgtgttcggtcatgccgatcgcggtcacgatgctgtcgatcgagaacacgatgtcgagcatcacgatctggccgatcgcggcccacatcgtcaggcctgccgcgccgccggcaccgcccgcgccgtcaccgtcgtgcgacacgtggtgatggatctcggtggtcgccttccacacgaggaacaggccgcccgacagcaggatcatgtcgcgccacgagaacgcgtggtcgaacagcgtgaacaccggttcggtgaggcttgcgatccacgcgacgctgccgagcagcgcgaggcgcatcaccagcgcgagcgcgatgccgaggcgctgcgtgcgggcgcgctgcgcttcgggcagcttgttgctgaggatcgagatgaagatcaggttgtcgatgccgagcacgacttccatcacgacgagcgtcagaagcgccgcccagacggcagggtcggcggcaagcgtcagcaggtagtccatgaaatgggccgattcgaaagtggaaagccccgatgatatgccgcccagaacttcgtaaaaatcagagagaatctgatttttggttcggtttttccgaaattacgttccgatgctcaatttccgacatctgtactacttctgggtcgtcgtgaaggaaggcggctttgcgcgcgcggccgggcggctcgacatggccgtgcagaccatcagcgcgcaggtgcgcgagctcgagaaagcgctcgggcaccagttgctgcgcccggccgggcgcagcgtcgcgatgaccgacgccggccaggccgcgtttgcgcgcgcggaggcgatcttcgagatgggacggctgatccccgacgaagtgcgcgcggcagccagccagccgaccgtgcggctcgcggtcggcctcgcggacggcatctccaagctcgccgcgcacgcgatcctggcacccgtgctggatacccccacgctgcggctgctgtgccacgagggcgagcatgacgcgctgctcgcggagctcgcgctgcatcatctcgatctcgtgctggccggccagggcgcgccgtccggttcgaacctgcgcgtgacgagcgagcggctcgtcgcgtcgccggtcgactggtacggccccgcggcactcgtcacgccggccgcgcgggagcactttccgcagtgcctcgccgagctgcccgtgctgctgccgaccgcgcactcggcgctgcgcgcgcctcgacctgtggctggaaggtgagcggatcgtgccacgcgtggccggggaattcgaggacagcgcgctgatggccgtgttcgcggcgcgcggcctcggcgtgtttccgctgagcgaactcggcgcgaacgatgcgtcgctgctgcgcgggttgcggcggctcgggcgcgcgggcgacgtgaccgaggagatccacgcgatccgctcgcggcgcggcgaacaccatccgctgacgtcgcaattgctggacgcggcgcgcggcgcaccggccgactgaagcgagtgcgacatcaaacgaaactataatggcgccccggccttacgagattgccgcgcgcttcatccaggcaccgccgttgcgcggcctctcgccaagccttctgaaagacgccatgcacaaccgatttcgcctgttttccgtttcgtgcgcgctcgcggccgcgaccgtgctggcggcgtgctcgtcgccgcccaagccgatctaccagcaggaacagttcgacgcgacgagcagcccgtatgcgcatacgttccattcgaaatccgacgcggcctgcgaggccgcgcggcgcgcgctgctgagccagggttatgtggtgtcgtcgtcgcgcaacgatgcggtcgacggcagcaagaatttccagccgaacaacgacatgcacgtcgtgatcgagtttcacgtcgtgtgcgcggacgcgaacgcggacggctcgtcgagcatcgcgtacgtcaacgcggtgcaggatcgttacacgctgaagaagtcgaatacgtcggccagcgtcgggctcagcgtgttcggctcgctgtcgctgccgatcgggtcgagcgacgacgcgctcgtcaagaccgccagcgagacgattcccgccggcgtgttctatgaacgcttcttcaatctcgtcgagcatttcctgaagatcgacccggcccgccgcgaccgcgcgaccgtcaaggccgccgagaaggaacccgtcacaccgctgcccgaacccgcgccgacgccgcagggcgagccgatgaagatgacgaccccggccgtgccgacgccgcccgcggcgccggtgccgctttcgctgccggccgtcacgcccgaatcgggcgcgcacgcggtgccggccgcggcgtcggccgtggtcgcgccggcggcgatgcgtgctgccgcgccggtggccgcgtcgggttcgggttcgggtgcgggtgcggcaccggctccggccgccgcgtcgacgcccgcaccggcaatggcacctgcaacggcgtccggggcggcatccgcaccggcctcaacgcccatgcaggcttccgcgcctgttcccgcttccagtccggcatcgacacccgccgccgcatcggcgcccgccgcttccccacccgccgctgcgacgccgacaccggccgcgcctgcgcacgtgtccgccgcatctgcccccgtaccggcatcggcgccctcgagctcggcacccgcgcctgccgcggccaatcctgtcgcctcgtccgcaccgtccggcgcgagcgcaccggccgccaactgaccggtccccgtatcgccgcgcccggccgtaaccggcgcagcgcgacgatacgcccccttccccgtcgttcctcgcatgaatttccacgctgccggctgcctgtccgttgcgtagccggcattgcgccgacgcttcgcagcgggaatacgcggccatgcacgcattcgccgcgctcgacggccgccccgcctaccgcaacgtcgcgcgcagcgtctgcaactgctcgacggtcgccgtcacgccgccgcagacgatcacggcgatatccgtcgccgacgcgagcacgggcaccggccgctcgagcgcagccagcgcggcaccgcaggcgggctcgacgacgatccggtgctcgtcgacgaagcgcagcgacgcggccaccgcgtcggcgtcggacacgacgaccggatgaatctcgtgccgcgtcgcccattcgaccgccgcgtcgcacggccgcttcgcgccaagcgacgtcgcgatgctcgtgatcgccggcaattcggccgggcgcccctgcgcgagcgagcgcgcatagcagtcggcgccttccgtttcggccgcgaccaccggcacgtcgtgccagccgttgcgcgccagcccttcgagcacaccgcacagcagcccgccgccaccgaccgcgagcacgaccgcgtcgggcttcgggccggcagccgccatctcgtcgatcatcgtcgcgtggccctgccacagcgcgcggtcgtcgaacggatgcacgaatgcatcgtgctcaccgagcgccgactgcgcgaacgcgttcgcctcggcccagctcgggccgtgcacgatcagctccgcgccctcgacacggatcagctcgcgagcgcgggccgatgcgctttccggcacgacgacgcgtaccggcacgccgagttcgcggccgcaataggcgaccgcgatgcccgcgttgccgcccgacgacgacacgaaccgccgcgcgccggccgcgtgccgcgcttcgcagacggcaccgatgccgcgcagcttgaacgagcccgacggctgcagcgcatcgagcttcagccggatggtcctgccgagccggcgggacgcgatttgcgagcggatataggagtcgggatatgaagcggcatggggacggaaccaatgggaacggagcgaacggaagaaacgcacggaagaagcgcacgcgacccgcgagggcgagcggcgatgacggccatcgtacggcaggctctccatgctttccaataccatcgcatggcacttgctatgcttcacaggtatatcaacgaaccggaacgaataccgcatgcgccagatcgaattgcgtcacctgcgctacttcgtcgccgtcgcacaagccggcagcgtgatggcgggcgcccgcgcggccggcatcgtccagcccgcgctgtcgcgacagatccgcgaactcgaggacgcgatcggcacgccgctgctggtccgccgtgcaacgggcgtcacgctcacggcggccggcacgagcttcctgcaggacgcgaccggcctgctcgcgacattgcaggacagccgtgagcgcgcgctgcgcagcgcggccggccagctgggcgaactccggctcggcgcgttgccgaactgcctgccgttgcctgtcgtcgcgaacgtcctcagggcgtttcgcgatgcctgcccggacgtcaagctgtcgatcgcgccgatgctgtcggccgaacaggcgaacgcgctggtgcgcggccagctcgacggcggcatcatggcgtggcgtcgcgacgaggcgccgcacctgtccggcgtccgattgctgagcgaccgcttcgtgctcgcgatgcccgcgccgccgggcggacacttcaccgcgccgcgcacgctggccgacatcgcgaacgagcccttcgtgtggttcgacgcgcagcgctccgccgcgcatcaccggttcctgatggcgcagtgccggcaggctggcttcacgccgcgcatcgcgcaggtcggcagcgacatcccgacgctgatcggcctcgtcgcggccggaatgggctgtgcgttcgtgccggaaagcgcgtcgccgacctgcccgcacacggtccggctcgtcgcgctcgacgaactcgcgagccgcttcgacatcgagttcgtgttcgacggcgccgccgtgccgccgtcgcccgtcgtcgcgcggtttctggcggccgtgcgcgatgcgaccgacgaagcgaactgaccggacgcagttcgaccaaagacgcgcccggcctacgatcgggcggccgaattcgccccgtcgatccaacaccggataccccttcgtcaaaacaccggttcggctggcctgacgtactaatcaccagcatcgcttgcgctaaacatctttcaaaacgccgacggaaggcgccgcagcgccggtgtttttaaattgacacccaaaacagccgtttaacgccggttcgaattgtcatgcgtcgaaatatacttcgcgcgcatcccaccctcgtgccaaagagaggatgcgtttctgccccggtcacggccccctgtggccggggctttttacctgcgcgccttgtctgcaaagggtttccggcggtgacgcgacgctcgcgccggacgatggccgccacctcgccggcccgccggatccgcgccgccggacgggctgcggacggcttccgggccaccgggcgaaaaagggcgaaacgggcatccgtccgcgtcgaaccgcccatggatcgcggtctcccggtcgagcgtcacccgccaatctttacaactcgctttcacaaaagccctccgctcgttcacccgcgccgtctgccggtttcgctgtacgctgcattgttgaaatgaaatcaagataatttcgtccggatacggctttttccgcaaaagtgaagcaggcacacttcgcactgtcctcaatggcctcgtgccgttgtttctcgattacaggagcacatcgcgtgaaccccacgacttcctctccttccgcccgggcggcggcgccgcgctaccgctgctggcactcgccgccggtgcattcggcatcggtacgaccgagttctcgccgatgggcctgctgccggtgatcgccgaaggcgtgcacgtgtcgattccgcaagccggcatgctgatcagtgcttacgcgatcggcgtgatggtcggcgcgccgctgatgacgctgctgctcgcgcgctggtcgcgccgctcggcgctgatcgcgctgatgtcgatcttcacgatcggcaacctgctgtcggcgctcgcgcccggctacacgacgctgctgctcgcccgcctcgtgacgagcctcaaccacggcgccttcttcgggctcggctcggtggtcgcggccagcctcgtgccgcgcgaaaagcaggccagcgcggtcgcaacgatgttcatgggtctcacgatcgcgaacgtcggcggcgtgccggccgcgacctggctcggccagatcatcggctggcgcatgtcgttcgcggcgaccgcgggcctcggcctggttgcgatcgcggggctgttcgccgcgctgccgaagggcgaagccggcaagatgcccgacctgcgcgccgaactctcggtgctgacgcgccccgtcgtgctcggcgcgctcgggacgaccgtgctcggcgccggcgcgatgttcacgctctacacgtatgtcgcaccgacgctcgagcacctgaccggcgccacgcccggcttcgtgactgcgatgctggtgctgatcggcgtcggcttctcgatcggcaacatcgcgggcgggcgtctggccgaccgctcgctcgacggcacgctgatcggtttcctgctgctgctgatcgcaacgatggtcgcgttcccggtgctcgccagcacgcatgccggcgccgccatcacgctgctcgtgtggggcatcgcgacgttcgcggtcgtgccgccgctgcagatgcgcgtgatgcgggcggcccacgaggcaccgggccttgcgtcggccgtcaacatcggcgcgttcaacctcggcaacgcactcggcgcggccgccggcggcgcggcgatctcggcgggcttcgggtatgcggccgtgccgctcgtcggcgggctgatcgccgcggccggcctcgcgctcgtcttcctgcagatcgcgcaacagcgccgcgctccggccgccgcgaattcgtaatcgcgacacgccgtccgccggcgacgaatgccggatccccctcaccgacacacgttcgcggccgctcgatgcggccgcgttcgttttcaaccgtcaatttcacttcattcgttcttccagtccggatatccggaatatccgtaaatcccgtttcgacaagaataaaattctcttgcgaattacggaaaccaatccaatccacttgaatgattcatttttcaccccctcaattccgccagattcattaatcaaccattccgtacaggtgattcatcccgccgattcacgcaaaaatcgcggccgaattcggcatgattcatgaagcgcttgctacatcgcaggaaatatttcattcaattcgcacattgaaatcacaaatagaaattcttaacgagtttatttactcaacacccaatccagatgtaacaaaatgaaacagggccgattttaatattgaaagaattgcgggttcgtatcagcatttgcggtaccgtggcctgcgaagcgcggcataaatccaacgaaaattcgatcgatgagggatctgcgtgaaagtcgccatcgtatccaccacattgtcgctcgcgctgtcagtcggcctttcgacacccgccgcagacgccgccgtctattcgaacggcacgtcgaccgccaccttcaacgtcacgctcacgctgcaaccgaactgcgcgatcacggcgaacccgctggccttcggcacgaacggcgtgctgtccgccgcgatcaaccagcagacgaccttgagcgtcacctgcaccaacacgacgccgtacaacgtcggtctcgacgcgggcctagtcacgggtcgaccgtcgcgagccggctgatggccggcacggcgaccggcaacacgacgacgacggtcggcttccagctctaccaggacgccggacggacgacgatctggggcaacacgcaaggcacggacaccgtggccggcaccggcacggggtccgcacagtccttcaccgtctacggccaggtgcccacgcaagccacgccgaagccggacacttatcagacgaccatcaccgcaaccgcctacttctgaccggcgctgcttcccatgtccgcattacgtcgaacgctcgccgcgctgctgtgcgcggccggcgccgcgcacgccgcgtcgctgcagatttccccgtcacgatcgaattcggcgccgacgacacggccaccggcatcacgctccgcaatccgggcgagcgcccggtgtacgggcaggtgcgcgtgttccgctgggatcaggccaatggccaggatgcgttgacgcccacccaggatctgctcgccagcccgccgctgatcgaagtcggcaagcagtccgagcagctgatccgcgtcgtgcgcgcttcgcgtacgccagccggtaccgaacagacctaccggctgctgatcgacgagttgccgcagcccggcgaggcaccggccaacggcgtgtcgatccggctgcgctattcgattccggtattcgtcgagccggccgccaacggcgcgccgcagctcgactgggcgctcctgcgcagcaacggcggctgggtgctgcgcgtgcacaacggcggcacgcggcgcgcgcaactcgcgtcggtcgaactcgtgaccggcgacgggcgcgcgtacccgctcacgcgcgggctgctcggctacgcgctcgcgggccgaaccggccagtggagcgtgccgctgccggccggcgtcgcgctcggcggcaaggtcacggtacgggcggccgtcaattcgcagccggccagtgcggtcgtcgcggtggagccgccgggctagaccgccggtgcgccgcccggcctctccccttcgccacgcgccggcacgcccccggccaacggacgcggaacgccgcgccgctcgccgcgcgccgtgctcgcggccgtcgtggccggcggcctgctcgcgctcggcccggtgcgcgctgacgaactcccggtactcgtgatgaccgacggcacgcacgacgtgatcctcgaagtcagcgtcaacggcgaaaacacgacgctgctcgcgcacttccgcgaacgcgacggccacctgtcggcgagcggcgccgacctgcgcacgatcggcgtcgcgaccgaccggctcggcctcgccgacgcggcgacggtcgacctcgacgcgattcccggcctgcgctaccgctacgacgcggcacgccagagcgtcgacctgcggatgcccgactcgctgcgccggccgtacgcggtcgacagccgtgcgttgccgcccacgcaggcggccagcgcgtcgcgcggcgtcgcgatcaactacgaggcgtacgcgcagacgatcggcgaccggcagtactcgctctacaccgacgtgcgctacttcgatccgggcggcgtgttcgacaccacgggcgccgcgaccttctacaacggcccgcggcgctacacgcgcttcgacacgtcatggagccgctcggacccggcgcggccgagcacgacgcagatcggcgacacgatctcggggtcgctcgcgtggacgcgctcggtgcgcatcggcggcttccagtggcgcagcaacttcgcgctgcgccccgatctcgtcacgttcccgatcccgtcgctcgcgggctccgccgccgtcccgtcggccgtcgacctctacatcaacaacgtgcgccagtacaccggcaacgtgccgagcggcccgttcctcatccatgacgtgccgggcatcagggggccggccaggcgaccgtcatcacgcgcgacgcgctcggccgcaccgtcgcgacctccgtgccgctctacgtcgatacgcgcatgctgtccgccgggctgtcgagctattcgttcgaagccggcttcctgcgccgcaactacgggctgcggtcgttcgactacgacgcgcggccggccgtcagcggctcgatgcggcgcggcgtcaccgacgcgctgaccgtcgaggggcatgcggaagcgaccggcagcgtgctcaacgccggcgtcggcgcgctgctgcggctcggctacgcgggcgtcgtgagcggcgcggtcgcgggcagcgccggccgctttccgggcacgcaggtgagcgtgggctaccagctgatcgagccgcgcttctcgatcaacgcgcagacgatccgcgcgttcggccgctacggcgacctggcctcgcgcgacggcgcgacggcgccggcggcgaccgaccaggcgacgctcgcgctgccgttcatgcaccgccagaccctgtcgctcagctatatcggcttccggatgccgcaaggcccgagcacgcggatcggcacggtgtcgtacacgctgggcttcggcgatctcgcgtcgctgagcgtgagcgcgtaccgcgacttcgcgcagcagggtgcgaacggcgcgttcgtgtcgctgaacatcgggctcggccgcaacacgtcgatcaacacgaccgtcggccgccagcgcggccagtcgaactacaccgtcgacgcgagccgcccgcccgactacggcggcggctggggttggggcgtgcagacgggcggcacgggcgcggtgccctaccggcaggcgcaactgcggtatctcggccacgcgggcgaagtcatcgcggccgcgcagcacatcgaccgacagaccggcgcgtcgctcgacgtgagcggcgcgctcgtgttcatggacagcagcctgcaggtgtcgcgccgcatcgacgacggcttcgcgctcgtgtcgaccgacggcgtcgcgggcattccggtgctgcacgagaaccgcgtgatcggcacgaccgaccgcgcggggcacctgctcgtgcccgacctgaacgcgtaccagaacaaccagatcgcgatcgactcgatgaagctgcccgccgatgcgcggatcgcccgcacgtcgatgacggtcgtgccgcaggcgcaatcgggtgtcgtcgcgcatttcggcgtgtcgcgctatcgcgcggcgtcggtgatcctgcgcgacgccgagggccgcccgctgccggccggtgcgcgcgtgcatcacgccgaaagcggcgcggatacgatcgtcggctacgacgggctcacgttcatcgacggactgaaggaggacaaccacctcgtgatcgactccggcacgcaacgctgcatcacggaattcgcgttcaccgcgcccggcaacggcacgctgccgaccatcgggcccctcacctgccgggcggcgccatgaagctcgcgctgctgctcgtcatcgcgttcgccgcgtggtgcggcgtgccgcatcacgcgcgggccgagtcctgcacggccacggcgtcgacggtcagtttcggatcggtcagcccgatctccaacgcaccggtcaccgcgaccggcaccgtcagcgtcacctgcacatggtcgaccgtctcgctggtgccgaacgtgctcgtgtgcctgaacctcggcggcacgagcccgcgcagcctcgtcaacggcaccgacgcgatgcagtacgacctctatctcgacggcggacattcggtcgcatggggctcggtgtattccggtacgacgccggcatccgtcacgctcgccaaacccgcgctcggcacgagcgcgtccacgacggtcaccgtgtacggacagatcaccggaaaccagccgaccgtgccgacgaccggcaacagcaccacgacctattcgcagcagttcggcggcaacacgacgtcgatcaacaccgggttctacctgctcgtcgcgccgacctgcgcatcgctgacgacgtcgagcggcaccttcccgttcggcgcgacggcggacgtcatcaacaactgcaacatcaacgcgaccaacgtgaacttcggcaccgcgagcatcctgtcgggcacgctcgcggcaacggggacgatcaccgcgcaatgcaccaacggcgacgcgtggaaaatcgcgctgagcagcggcggcagcggcgacgtgacggcgcgccagatgaagcgcagcggtggtggcggaacgatcgattacgggctgtacggacgccgcgcactcgatcggatggggcgacggcacgggcggcagcgcaacggtcacgggtgtcggcacgggcacgtcgcaggtcgtgaccgtgtacggcgcggtgccggcgcaggccacgcccgcgcccggcagctacagcgacacgatcaccgcgacgatcagtttctaacgttcaacggcatgaacgggcgggcgcaccgctcagaacgtaacggtccacgcgggcggtgcgcccgcgccgatgtcgcgcggcgccgaccgtgcatcgggcagcgccgcgtggctgagcacgaacggcgtgccgtgcatgcaactgacgctcggcacgccggcatcggcagccgcctgcggcgcgccggcgtcgatcgtgcaggtttccggaatgacgagactgactcgcagcggaatcgacggttccgccgcgctcgcgagcgaccccgcgcccagtacggcgagcgcgatcgcaccgcgtgtgatctggccggctgtcatcgtgcggccctccttcgtgcatccatccaggcagatgcgcgaattatcggcatgcgcgcggaaaacctcaatccgcgcgcatgcggccgaaccccgccgcgccggtcagcgcgcgccggcgaacccgccgaagaacgcacgcgcgttggcgtcgaggctttcgaggtgatagccgccttcctgcacgatcaccgtcggcaacccgagtgcgccgatggccccgccgagccgcccgaaaccgccggtcgtgacggcaacctgcgattgcggatcgtccttgtagatatcgaagccgagcgcgagcacgagcgcatcgggctggaaccgcgcgagcgcgcgcagcgcgtcgtcgagccgctcgaagaacgccgactcgggcgcgccgtgcggcatcggcaggttgaggttgaaaccgtcgccggcccccgtgcccgtctcttcctcgtaacccgcgacgaccgggtagaagttggtcgggtcgccatggatcgacacgtacagcacgtcgtcgcggccgtagaagatctcctgcacaccctgtccgtgatgcatgtcggtgtcgaggatcgcgacccggcgatggcggccgagcagcgactgcgcggcgatcgccgcattgttcaggtagcagaagccgccggccgcgtcgcggcgcgcgtgatggccgggcggccggcacagtgcgtacgtgtcgcgtgcgccgtcgttgacgtcggccgcagccgcaagcgcactctgcgcggaccagtacgcggcgcgccacgtgttcgcgccgaccgggcaactgccgtcggcgagatagcgcgcggccttcgcgagcacgccgcgcagcgggttcgggtcccgcacgaacacgttcgacatcacttcgtcgccccagtcgtcgggcatccgtttccagtcgcggtgcgcttcttccagaaagcgcaggtagttcatgtcgtgcacggccgcgatcggcgcagtgccgcggtcggccggctcgcgcacgtcgaagtcgagcgaccggacggccgcgacgagccgcgccgcgcgctcgggcacttcctgcggctcacgcatccggccgcgcgacaggtagctgcgcggatggtgcagcagctgctcgggatggaaataggtgttcatcgtttgccctcgtcggttgttctgtctgtcgatcgatcggttcgcgctgtcacgcatcctgcgtggcggccgccacggcaacgctcgccgcgacgccggcgcgcgcgagcaccgcatgaaggagcacgttcgtgcctcgcgtcacgtcggcgggcagcgcgtcctcggcttcgttgtgcgacaggccgtcgacgcacgggatgaacaccatcgccgtcggaacgcggcgcgcgagcaggatcgcgtcgtgcccggcgccgctgacgatccgctcgttcgtatagccgaacgccgcagccgcctgcgcgaccagctcgacacagtcgtgatcgaacggcgtcgccgggctgcgccagcaggtgtcgatcgcgacctgcacgccgcgcgccgcggcgacacgtgcacaggcatcgcgcagttcgcgctccatcgcgtcgacttgcgcatcgtcgtgatgacggaggtcgaccgtgaacgtcacgtcgccggcaatggtgttgcgcgacgcgttgcggatgccgacctgcccgatcgtcgcgagcccgcgcggtgcatgaccggcgacgatccgttcgagttcgagcgccatctgcgcgctcgcgaaatacgcgtccttgcgatacggcatcggtgtcgtgcccgcatgcgcggccacgcccgtcaccgtcacgtcgagccagcggatcgcctgcccgcccgtgacgatgccgatcgtcgtaccgttggcctccagcaccgggccctgttcgatatgcgcttcgaagtacgcatcgaccgcgccgcccgtcgcgcgcgcgccgcgataaccgcaggcgtccagtgccgcgccgagcgtgatgccgtcggcgtcctgcttcgcgagcgcatcgtcgagcggcaacgcgcccgtgaacacggccgagccgagcatcgccggcgcgaaacgcgcgccctcctcgttggtccacgacacgatttccagcggcttgccggtcgcgatgcctgcgtcgttcagcgtgcgcacgagctcgagcgcggcgagcacgccataaacgccgtcgaaccggccgccttcgggctgcgtgtcgagatgactgccgatcagcaccggcgcggcctgcgcatcgacgccgtcgcgccgcgcgaacaggttgccgaccgcgtcgacgctcaccgtcatcccggcgtcgcggcaccactgcgcgaacaggtcgcgcccgcgacgatcgtcgtcggtgagcgccaggcgccgcacgccgccgcgaggcgtcgcgccgacgcgcgccatgtccgccaggctctgccacaagcgggcaccgtcgatttccagcaggtctttcatgtgcactccggatgaattcgttcgttgaggttcactgcgagccgagcgcttcggcggcggccggccgcgctgcgcggcgtgcgtcgatcgcgacgatggagagcagcgagatgccggccaggcacgtgtagaacaccgcgagcggccaccactggcccgcgaagcgatgcgcgagccacgtgccgacgagcggcgtcagcccgcccgcgatcgcgccgcagatctggtaagccagcgagatcgccgaatagcgcacgtgcgcgggaaacacgtcgctcacgaaacccgcgatcaccgaatagaagccggccatgcagaccaccgcgagcgcgatgccggcaatcagcgacgcggacgtgccgccctgcacgagcatgaacatcggatacggcgacagcatcgcgagcagcgccgcgagtttcaggaagcgcgcgccgccgatgcgctcggcgatccacgcggcgaccggctgcgcgaagaactggatgatcgcgaccgcgaacaggctgtcgaggatcagcgatcgcgagacgccgacgtactgcgtcgtgtacgcgatcatgaacgtgttcgtgaaatagacgcccgcgatgccgatcgtgttcgcgccgatgcagaggaacacgagccccgacgccgagcggaacacttccgcaaccggcagcttcaccgtgcggttggtttccttcacgcgcgcgaattccggcgactcgttcacgccgagccggatcaggatgccgaccacgagcagcaccgaactcgcgagaaacggcaggcgccagccccacgcgaggaagtccgccttgtccatcgacgtgaccgcgcgaaacgcgatcagcgacaggatcagcccggccgggctgccgagttgcgcgaacgacgcgaagaacgtgcggcgcccctgcggcgcatgctcgcccgccatcagcaccgcgccgccccattcgccgccgaccgcgatccctgcaccacgcgcagcgcgacgagcagcaccggcgcgagcaggccgaccgtcgaataatcgggcagcagcccgacgcagacggtcgcgacgcccatcatcatcagcgtcgtcatcagcgccttcttgcggccgatgcgatcgccgaggtgcccgaagatcacgccgccgagcggccgcgcgaagaagccgaccgcgaaggtcgcgaacgacgccatcgtgctgacgaagcggtcatgcgacgggaaatagagttcgccgaacacgagcgcggcggcggtcgcgtagatgtagaagtcgtaccactcgatcatcgtgccgatgaacgcggccgtcgcggcgcgtcccggctggcgggcggaaggaagggactgggtcatgcgggctcctgacgcgcgccgctgcggcgcgacgcgcaatatcgtggacggccgtctgtcgcggccttgcgccgcacgctgcggcgcccctcctttatcggcgaccgcaaatcattagtcaaatttcaagttattattcgccgtataaattcaactaatacccacccgacgcctcgcccggagaaccgatgcgccccgacctcgccccgttcctgaacgaccgtctcgactggaacctgttgcgcacctacctcgtcatcgtgcaggagcgcagcgtgagccgcgcggccgcgcgcctgcacgtgacgcagccggccgtgagccaggcattgcggcggctcgaggacacgctcgaacgcaagctgatcgagcggcgcggcacgcacttcgcgacgacgccggcgggcgaagccgtgtaccggatcgcgagcgacatctacggcggcatctcgcgcctcgaaaccgaaatcgacgacagcacggccgacctgaccggctcgatccggctgctgacggtgagccgcatcgagtcgcccgtctacgacgaatttctcgcggaattccatcgcgcatatccgcgcatcgacctgcagatcgaggtgatgcgctcgtcggacatcctgtcttcgctgctgcagaaaaccgccacggccgggctcggcctgtgccgcacgccgcacgacaagctggagatgcgctgcttcctgcgccagcgctatgcgatctactgcggccgccatcaccggctgttcgggcagacgcaactgcgcatggacgatctgctcgccgagaatttcgtgtcgttcacgagcgaccagatcggcgacagcctgtcgccgctcaccgtgtttcgcgaccagaagggcttcacggggcgcatcgtcgcatcgtcgccgagcctcgaggaagtgcggcggctgatcttcgcgggttacgggatcggctgcctgcccgaacacatcgtgcgcgacgacatcgcccagcagcggctgtggcggctgccgcccgacgaagggctcgtcgacgtcgacgtgttcctgctgtggcatcgcgatcgcaagatgaacgcggccgagcacgcgtttctcgacgcgatggagcgctgcatgcagcgccattcgcttgcggagcggctcgggaagtaacggcgcgagcgcgccggaggaagcgccgggcgcacacggcccggcgcgtcggcaacgtcagaagcgatgcacgatgccgagctgcacgccgcgcgcattcgcgcccggatacgcgagcggcaggccggggttcgccgcaccggcgagcgtgtagccggcctggttgcggttgcgcaggtacgacagcgtattgctggtgcggaacgcgaacacggtcaggttgtccatgccggacgcctgcgtgacaccgccgaacgcatcctgcccgccctggtcgttgaacagcggcgaattctggcggcccgcgcgcaccttgccccactgccccgcgatgccgacccacgcctgccggttgaacaggctgcccgaactcgccagcgagccgtcgttcgggttgaagccgttctccagcgcgaactcgatcttctgcccgccgccgatatcctcgccgcccttcagcccgaaccggctgccccactggccgcccgaaccgatcgccgccgtatagccgttgcccgtgttcacgtactgcgcgaactcgtcgatcacgccatacagcgttacgccgtcctgcgcgagcgccgcgcccgatccggcggcgcacgccgccgccaccgtcacgcgaagaccggcgtgcaccatccgcgcccgggaatcgctgccgcgggctgtcgttttcttagtcatactattcaatagcctgagaatgaaacgacaccgcgcgcggcagccgcgccgcaccggcatcgtcgaaagggaaacgtgtggaagaacccggcgcaggcagcgcccggctcgcgcggcattcaggccggcagccggccggcccgatgcgcgtgacgtgtcgtcagtggtgaacttcgccgcgttcgagcggcaggatcaggcgttcgggaatgctgcggcgcgacgcgcgcgcgccgatgtaatacagcacggccggcacgatcaggccgaggatccacgagatgtcggtgccgccgagcgcatcgacgagcgggcccgtgtagatgtgcgtcgacatgaacggcaactgcacgaggatgccgaccacgtagatcgtgatcgccatcacgttccagcggccgtagcggccgtccggatcggacagcgccggcacgtcgtagcgcgagcgcgtgaagcagtagtagtcgaccaggttgatcgcgctccacggcgtgaagaacgcgagcaggaacaggatgaacgcggtgaattccttcaggaacgaatggcggcccgcgagcgcgatgagcgtcgatacgcagatcatcccgaagatgtagacgaggcggctcttcgacgacacggcgcccttgccgcggaagccgctgacgatcgtcgccatcgacatgaagctgccgtatgcgttgagcgccgtcacagtcaccttgccgaacgcgatgctgaagtacagcagtgcggccacggcgccggtcgagccgaggccgacgatatacgccacctcatggtgcgcgaactggctgccggccagtgcggccgcgaacacgccgaacaccatcgccgcctgcgcgccgatcaccgagcccaggccgaccgcgagaaacgtcgcgaccgacgacgtcgagcgcggcaggtaacgcgagtagtcggcgacgtacggaccgaacgcgatctgccacgacgcggacagcgacatcgagagcaggaagctcgcgagcgagaaatgccggttcgcgagcagcgcgccgatgtcgtggttcgcgaacagctgcgtgaacatgtagacgaacgcggcgatgccgatcacgctcgcgacccggccgacggcatggatcgcgcgatagccgaacacggtcagcacgacgatcacggccgcgaacagcaggatgccggccgcgtcgtcgacgtgcagcagctgcgcgacggcctgcccggccagtaccgagccgctcgcggaaaagccgatgtacatcaggcacacgagcacgatcgggatcatcgcgccatagacgccgaactgcacgcggctcgagatcatctgcggcaacccgagctgcggcccctgcgcgccatgcagcgccatcaccgcgccgccgacgaactggccgagcagcagcgcgaccagcgaccagaacacgtcgccgccgagcacgacggcgagcgcgcccgtgacgatggccgtgatctgcaggttggccgacagccacagggtgaactggctcagcaggccgccgtggcgctcggcgtcgggaatgaagtcgatcgatcggacttcgatcaggccgccggcttttccactgggattcgttgacacgggcaaatctccaaaatactcaggatcacaaatggttcgaacaagacgggaagctgcgagccgccctttcggctctgcgggtgcggggcgccgtggatcgccggcatgcgccacgcacgcacggtttgcgcgctggcgcgcaagcggcacgacgtgtgccgacattgccagcggatgatcttgtatatacaacttgcgagatatcggtgattacccggtatcagccgattttcgaaatcgtccgaacaatcggcacagcttcggccggttttgtcgaaagcagaacgtcggaataatgaaagctcaggtgcgcgcgggcgacgcctgatcgggttcggccgtcatgtcggcggccgggagcacggtcagcatgcgccgggctgcctcgatgtcgcgtacgtgcagccactcgtcgtaatcgtcgcggcgcaggatcacgacgccccgcttctcttcgccgggccgatgcatccgtgcgaacagcggatgggcgtcggcgttgaccgtgagcatcgccatgcccacgcgctcgcggccgtcggcgccttcgtagcgccgccagatgccggcgacgcagcacggttgccagccggcgacgccgatccggtgccacacgttgcgaccggtttcgtaacagggctcgacgatccagcgcaccgggatcaggcagcgctggccgttgcgccacgcggtgccgtagagccgcgacgagccgaccgtttccgcccgcgcgttcaccgtatcgagtttctttctttttcggccgttctcgtcgacccgttcgggctgcatgaatttcggccagaaaccgaacacggccgcgacgacctcgaggccatcgccgtcggcgcgcgcgaccggcgccgcgtagtcgggatacacgtcgggtgcccagggatcgcggcggaacaggtcgccgattccgatcttcagttcgctgatgcccgggtcttcatcgggagcgcggtagtgggtgcacacggctcggtggacggtggaagcgatgtctccatcgtaggtcagcgcaggcgccgcggtcacgcgatcgctttgtatgacgaaacagttttacgaagcgacgaagcgcctggcgcctccgccgcttgccgtcatgcgtgccgggcgatccgcagcgtcaggatttcgtcgcctgcggcgtcgagcgtgcccgtcggcgtccagcccagatgccggtagaagccgtacgagcgcgacgccggatcggtcgagcacccgagaaacagcgacgtgaaaccgttcgcggcgaacgtgtcgatcacctgctgcagcagccgcttgccgatccccgcccctcgtattcgggcaggatcgcgagcacgacgatctcgcccgatccggtgtcgccgaagcagtagccgaccatgcgcccgttcgcgcagcagacccggcccgcgaccaggccgtcccggatgccgtcgccccagctttcgacggtgatgccgaggtcgcgcaactgcgcgtcggtgaatgcgttctcgcgcgtcttgccgcgcagttcgatgcacgcggccgcatcgtcgggaacggcctcgcgccaggtgagttcagtcatcgttcgatttttccgtggtgcgccggcgcgacgcatacaggcagatcagctccagcgcgatcgtcgcgccggccagcgacgtgatttccgcatgatcatacggcggcgacacttcgacaacgtccatgccgaccaggttgatgccctccaggtgacgcaggatctcgaacgcctgatggctcgacagcccacccgagaccggcgtccccgtgcccggcgcgaacgcgggatcgaggcagtcgatgtcgaacgtcaggtacacgggatgatcgccgacccggtcgcgaatgcgcgcggcgatcgcggcgggcgtcgacgcatgcacgtgacgcgcatcctggatgtcgaagcccatcggcgcgtcgttggtcgtccggatgccgacctgggccgaccgtccgggcacgacccatccttcccgcgctgcgtgatagaacatcgtcccgtgatcgatgcgcttgacgtcgcgatcgggccacgtgtcggtgtgcgcatcgaaatgcacgagcgacagcggcccgtgcactttcgcgtgcgccttcagcagcggatacgtgatgaagtgatcgccgccgagcgtcagcatcgcgcagccgcgcgcgaggattccgtcggcatgccgctcgatcgcgcccggcaccgattcgggctgcccgagatcgaacgcgcaatcgccgtagtcgaccgcggccagcacgtcgaacggatcgaacgaccacggccacgggcgctcccacgcgatgcccgtcgacgcgatccgcaacccgcgcgggccgaagcgcgtgccgggccggtgcgatgcggcggaatcgaacggcacgcccgtaatcgcgaggtcgacgccgtcgagctcgcggctgaaacgccggcgcatgaagctcgtcgcgcccgcgaaggtcggctcggcctgcgtgccgtagaggctgtcgcgcgtgaatgcgaaatcgttctggctcatcgtcggcttcctgtctgaaggggacggccgcgcggctggcgacctcgtgcccgattctgccgctccggcatccgacgaaaaatatgaactaacataagccgacttcacgaaacgcgatgtatcgccatgctgacccgattgagagacatggatgtgcagctgctgcggctctttctgacgattgtcgaaagcggcggcttcagcgccgcgcaaggcacgctcggcatggcgccttcgaccatcagcacgcagatggccaagctcgagacgcgtctcgggttccggctgtgcgatcgcggcaagagcggcttccggctgacgccgaagggcgaacgcgtgctgcagtcgacgcggcggctcctgcacgcgatggacgtgttcacgcgcgatacgcagcacgtgtcgggcacgttgctcggcgagctgcgtatcgggctgtccgagcgactggcgccggacgtcgtcgaatcgatcgcggcaggcgtcggccgctttcgagaacgggcgccggacgtgctgatcgagatggtcgcagtaccgcccgacgagctggaacgcaggctgctgaaaagcgaactccagctcgcgatcggctatttttccggccaccaggccggcctgcactacacgccgctgttcgtcgaacaccagtcgctgcactgcggcgcccggcatccgctatttgcgaaaaagaccgtgtcggtcaacgacatcgcgggcgcgagcaacgtcgcgcggctctacaagacgaacacgtcgggtgcggcgctgcgcaacgcgcagccgaccgcgttctccgaaaacgtcgacgcggacgtgatcttcattctgtccggcgcgcacgtcggcttcctgcccgaccatgtcgcggcaccgtgggtcgccgccgggaagatgcgccggctgctcgcgagcaagctgagccatacggtcgaattccagctcgcgacgccgcgcaactgcgacggcagcgaagcgctggaagcgttcacggcggcgctcgccgaacagttcggcgagctcgacggcttcgcgggcccgtgaccggcgcgcgccgccgttgcgcgtcaggcgagccggtccgacgcgatgacctgcacgcccggccgcgcgtcgatcgccgcgtcgagcagcgcgcgggcaatccgcgacgcgggattcacgcgccacttcgccggcaacacggggcgggccgcgttcaacgcgaacaccagcagccgctcgccgagcctgaattcgtcgcggctgccgccgatcagcccgggccgcacatacgtgagcgacgcgaacccgacgccggcgagcgcctgctcgacctcgcccttcacgcggttgtagaagatgctcgatgccgggtccgcaccgagtgcggaattcaggacgtaggccggggtgccgtggcggtgcgcgagccgcgcgaccgcgagcggatagtcgtggtcgacgcgccggaacgccgccttcgagccggcggcccgcatcgtggtgccgagcgtgcagatcacggcatcggcatgccaccagtcggccgcgtcgggcagatgatcgaaatcgacctcgagcgcgcgcatcttcgggtgcggcgacaacgggcggcgcgcgaggacgatcacctgatcgacccgcgcatcggcgagcgcgacttcgaggacgtgacgcccgacgagtccggtcgcgccgacgagcagcaatttcatgtccggttcttccgtgtggagtctgcgttggcggagcgggaacgccccggtttccggcttcccacatgatcgtcggccgactcggcaccgacaagcgcccaacatctcgaaaagttacaggccgtgcttatttcctgtctctgatttgacgcggcacgactcctccatgcttcgccgacgcttcatttccgcgcacattcgaaatttttatcgcatcaaagcgctcgatattgatatttattcgacattgatacgacaaatgacgcggccaatgaaaagagaacgttcatttttcgccgtctttcgaacaagatgccggcgtacgctacgacccggccgtctcgtgtcgcgacacgctccagcgctcgtatgcctgcgagaacgacgacatgtcgccgaatcccggttcctgcgtgatttccttgatcgacagccgcccaggtgacgaagctggagaacacgggccgctatccgatcgagcagcccgggctgccgcagatggtcgatgcgatcgatgcgttctgtcgcgacgtgacggcgcctcacgtcgacctgcgcgcgccgtcatgacgaaggcgcaagcgctagcgcggaagccggcgcctcaaacgaaaagccgccggtgcgcacgctgcgcaccggcggcccctgtcacaccggcccgtcagacatgcaacgcatgcccgagcgcgcgcagcgcggcctcctgcagtgcttcacccagcgtcggatgcgcatggatcgtgccgccgatgtcctccagccgcgcgcccatctccagcgactgcgagaacgccgcggccagctccgacacgccgcgcccgaccgcttgccagccgacgatcaggtggttgtcgcgccgcgcgaccacgcgcacgaagccgtcggtcgcctgcagcgtcatcgcgcgcccgttcgccgcgaacgggaacgacgcgctcacgcaatcgacaccggccgcccgcgcatcgtccggcgaccagccggccgtgacgatctccggatcggtgaagcacacggccgggatcgatgcgggcatgaacttgcggcgcttcccggcgatcagctcggccaccatctcgccctgcgccatcgcgcgatgcgcgagcatcggctcgccggcgacatcgccgatcgcccagacgttgcgcatcgacgtccggcattcgtcgtcgatccacagcgcgcggccgttgcgatcgagcggcaacgactcgagcccgaagccgtcgacgcgcggccggcggccaaccgcaaccagcacgcgatcggccggcagcgtctgctccgcgccgtcggcggcctgcacgcgcaccgcgccgtgctccgcgaggccgagcaccttgtggccgagcagcagccgcacgccgagccgcgcgagcgaatcggcaaccggccgcgcgagttcggcatcgtacgcgggcaacacgcgctccgccgcttcgacgacactcacgtcgacgccgagcttgcgatagacgatcccgagttcgagcccgatgtacccggccccgaccacgaccagccgcttcggcagggtcgtgggcgacagcgcctcggtggacgacacgacatgcccgccgaacggcatcgacggcagcgcgaccggttcggaaccggtcgcgagcagcaggtgctcgcagctgatccgcgtcgtgtggccgccggcgacgacgtcgacggtcttgccgtcgaccacctgtgcgtcgccgtgcaacacgcgcacgccgttcttcttgagcagcgcgccgacgccgcgcgtcagccggtcgacgataccgtccttccatgcgacgcttttcgcgatgtcgatctcgggcgtgcgcacgcgaatcccgagcgcgccctcgcctgcatggccgcgcgcctgttcgaatgcgtcggccacgtggatcagcgccttcgacggaatgcagccgatgttcaggcacgtgccgccgaggcggtcgcgctcgacgagcacggtcgggatgccgagctggccggcgcgaatcgcggcgacgtagccgcccgggccgccgccgatcaccagtagcgtggtgtgttcgttcttcattgcgctcactccacgaacagcagtgccgggcgttcgagcaccgcgcgcaccgcctggatgaattcggccgcgtccgcgccgtcgaccacacgatggtcgaacgacgacgacaggttcatcatcttgcgtgcgacgatcgcgccgtcgcggatcatcggccgctcgacgatccggttcacgccgacgatgccgacctcgggatgattgatgaccggcgtcgacacgatgccgccgagcgcgccgaggctcgaaatcgtgatcgtcgagccgctcagttcgtcgcgctgcgcgcggttcgtgcgcaccgcgtcggcgagccgcgcgatctcggcggaaatcgaccacacgtccttcgcttccgcatgacgcagcaccggcaccgtgaggccgctgtccgtctgcgtcgcgatgcccatgtgcaccgcgccgtagcgcgtgacgacacccgcttcgtcgtcgaaacgcgcgttgatctgcggaaagtcgcgcaacgcgatcaccatcgcgcggatcagcagcggcagcggcgtgagcttgccgcgcgtgtcgccgtagcggcggttcaaatccgtacgcaacgattcgagctcggtgacgtcgatctcctcgacgtagctgaagtgcggaatgcggcgcttcgcttcctgcatcttgcgcgcgatcgcgcgccgcaagccgatgaccggcacctcggtttcatcgttgcgttcgtcgtagccgtgcgcccgcgatccgcgggcgccgcgcgccgtaccgccgccgctgcccgcatacgcatcgagatccgcgtgcaggatccgtccggcttccccgtgccgcgcacataacgcagctcgatgcccatgtcccatgcgcgctggcgcacggccggcgacgcgagcggccgttcacccggcgcgagtgccacgcgcggcggctccacgtgttccttgcgttcggcgtgcttcgcgtgacgcggctccgcaggcgcgtgcttcgtcgccggcctggcgggcgactctgccggcgcgtcggccaccgccgtcgacggcgcggccgcgaccggtgcggtttctacctttgattcccgcaccggtgcgccggccttcaggttgccggcaccttcgacctcgaggcggatcagctcgctgccgaccgccatcatctcgccgatccggccgccgagttcgatcaccttgcccgtcaccggcgacggaatctcgaccgccgccttgtcggtcatcacatcggcgagcggctggtcttccttgatcgtctgcccgacttccacgtgccaggccaccagttcgacctcggcaatcccttcgccgatatccggcatcttgatgacatgaatccccatctcacgcctccatcacgcgtcgcaacgcttcaccgacccgggccgggcccggaaagtacgcccactcctgcgcatgcggatacggcgtgtcccagcccgtcgtgcgctcgaccggcgcctcgaggtggtagaagcaatgttcctggaccagcgacaccagttccgccccgtaaccgcaggtgcgcgtcgcctcgtgcaccacgacgcagcgcccggtcttgcgcaccgacgcgacgaccgtgtcgaggtcgagcggccacgtgcgcaggtcgatcacctccgcatcgatgcccgtctcctcggccgcggcgagcgacacgtgcaccgtcgtgccgtaggtcagcaccgtcacgtcgttgccgggacgcaccacggcggccgtatcgagcggcaccgtgtagtagccctcgggcaccgcgctcgacggatgcttgagccacgacgtgacgggccggtcgtgatggccgtcgaacggcccgttgtacagccgcttcggctcgaggaagatcaccggatcgtcgttctcgatcgacgcgatcagcagccctttcgcgtcgtacggattcgacggcatcaccgtgcgcagcccgcacacctgcgtgaacatcgcctccgggctctggctgtgcgtctggccgccgtagatgccgccgccgcagggcatgcggatcgtcatcggtgcggtgaactggccggcggagcgatagcgcagccgcgcgccttccgacacgatctggtcggaggccgggtagaaataatcggcaaactggatctcgcacaccgggcgcagcccgtatgcgcccatccccaccgccgcgccgacgatcccgctttcggagatcggcgcatcgaacacgcgcgacttcccgtatttgttctgcaatccttcggtacagcggaacacaccgccgaaatagcccacgtcctgcccgaacacgaccacgtcgctgtcgcgcccgagcatcacgtccatcgccgagcgcagcgcctggatcatcgtcatcggctgcgttgccgtgcctgtctcgtgttgcgccatgatcatgctcccagttcctggcgctgacggcgcaggtgcgcgggcagctccttgtagacgtcgtcgaacatcgaggccggcgacggaatccggtcgtcggccagcgtgccgaatttctccgcttccttctgcgcggcgagcacctcggcctcgagctcggccgtcaacgcctcgtgcgcgctgtccgaccagatgcccttgacgatcaggtggcgcttgaagcgttcgacaggatcgccgagcgggaaatgggaccagtcgtcgctcggccggtacttggtcggatcgtccgacgtcgaatgcgcgcccgcacgataggtcacccactcgatcagcgtcgggccgagattgcggcgcgcacgttcggccgcccagctcgacgccgcgtagatcgcgaggaagtcgttgccgtcgacgcgcagcgacgcgatcccgcagccgacgccgcgccccgcgaacgtcgtgccctcgccgcccgcgatcgcctggaacgtcgagatcgcccactggttgttgacgacgttcagcacgaccggcgcgcggtacacgtgcgcgaacgtgagcgcggtgtggaagtcggattcggccgtcgcgccgtcgccgatccacgcggacgcgatcttcgtgtcgcccttgatcgccgacgccatcgcccagccgaccgcctggatgaactgcgtcgcgaggttgccggaaatggagaagaagcccgcgtcgcggtccgagtacatcacgggagctggcggcccttgagcgggtcgccttcgttcgacatcagctggcagatcatgcgctcgagcggcacgtcgcgcgcaatcaggatgctctgctggcggtaggtcgggaagcacatgtcgccgtcgcgcagcgccatcgcatgcgcggtgccgatcgcctcttcgccgaggctcagcatgtagaaggagatcttcttctggcgctgcgcgatcatcatgcgcgcgtcgaaaatgcgggtcttgagcatcgcgcgcaggccggcgatcagccgcgcatcgtcgagatccggtgcccacgggccgaccgccttgccgctgtcgtcgagcacgcgcacgaggctgcgggcgagatcggcggtgtccgccgcggcaacgtcgatcggcgggcggcgaaccgcaccggccggcgatagatgcagataggaaaagtccgtcttgcagcccgggcgcccggtgggctccggcacatgcagacgcaatggctctgacaggctcatcgtgtcgtctccacgctcgattgtgtctcacgctgtttgggaacgcgcgaccggttgccggcctgcgcgtgggctgacgggcggataagcacgtcaaccttcaaaatttatgccctgcggcgacggacgtcgatgcccaagccgctcgatcgcggtgagcagatttgccatgacgggcgtcggcgggccatcggcgcggcaggcgggtaaacccatgatgcgtttgcggcgctgcagtacccggcgcgcagcgccggggcatcggcgccggacggatcggcacacccgagctgcatgacgacacgaagcaaaagaccccgcgaaatcctggagatccgcggggtcttttgtcgtctgttcgggcgtgtcagcgcgccattggcgatcgttgcggcgtgcgacggatcatgcgtcggggcgaaacaggtcgaaccggctgtcgggcttgacgtgcacgtaggccgacgggccgcccgcgcgcagaatgatgccggcgccgaacgtgtcgaagaggccgtccttcagcagatcctgccggatatgaacggcgacgacctcgccgagcaccagcgacgccggcgtttccacgccctggtgatcgcgcaggcgaatcacgtcggtcaccttgcattcgaagttgacgccgctttccgccacgcgcggcacgtcgaccagacgcgacggcacggcggtcaggccgcccagctcgaactcgttcacgtcgtacggcaccgcggcacacgtctggttcattcgctcggcgagctcgcgcgtcgcgaggttccatacgaactcgccggtctcctgcacgttgcgcaggctgtccttcgcggcgacgctcgaaaaaccgatgatcggcggacggtagttgaatgcgttgaagaaactgtagggcgcgaggttgaccgtaccgtcgctgccgcgcgacgagatccagccgatcgggcgcgggcccacgatcgcgttcaagggatcatgtgcaaggccgtggccttgcgacggttcgtaatagtggtgggtcgaatcggtcatgacgggcggtcttgcgggatgcaaactgcgttggattccatcggcgcatcacacgtgccgatgacggtaacggcgttcagtacgacgtgcgcggccagtatcacatggcgtcgcattcgctgcctcgaagggccgctggacgcagacgaaccgcaaggcgaagtcgcgcgggtcgaacgaccggacaaaggcagcgcgacaacggcaacgttccacgctcacgcgcgtccggacgcaccaaaacaaaaacccgcgagcgcatggcttctcgcgggctttcgtaccgtcatcgaatcgcgctgaaagcgatcgtggtgccggggaccggactcgaaccggcaagccagttaaggcggcggattttcgtcacactgcttctttcaaagccggcgtcgcggatgcgatgccgttcgtgcgctggactatgccttcaccgtcgcgcgcgggcctgcctgctgcccatgcgccttaggcgcccccgtctagtctctacaccttcctcgcggatgccgcgaggcttggctcggcgttgcctcgatgcgcgcatcaggggtttcgccgaatttgaagggttctgcaccgaccgtttccggccgggcactcaatctttaagtccgctatgtttaccaatttcatcaccccggcaagagggcggacgcgattctaccattgcttgcgcatgcgttcccttattctgcgccgccgcatggcgacatctcccggcgccgcaccgattcatcccgtgcaatcgacgccgtaacggcgccgcccgcgattttctcccgcgccgcaacatccccgatacaatcgaacccgcgtcgtccggcggcccccatccgtcagatgtttgtgtcgtgctttttgcgaaacaggcatcgcttgcgtcatcgcgaagtcacaaacgttttcgataatttcctgccgaaaacgtttacatcgcgctagttaatgacctcgaccatcaaggacgtcgctgccctcgcgggcttctcgatcgccaccgtctcgcgcgcgatcaacgcaccgcataccgtcagccccgccacgctgcagaccatccgcaccgcgatcgacacgctgcaattccgcccgagcccgctcggccggcaactgcgcggcgagcgcacgcggctcgtcggcgtcgtcgtgccgacgctgtcgaaccccgtgttcgccgactgcctgcaaggcatcgacgagctcgcgaccgcggccggcttcaagctgatcctgatgacgaccgaatacgacgcggcgcgcgagcgtcacgcgatcgagacgctgcgcgagcagcgcgtcgaagggctgatcctcaccgtcgccgacgcggacacgcacccgctgctcgacatgctcgaccacgaaggcccgcattacgtgctgatgcacaacgacacgcagcgccgcccgtcggtatcggtcgacaatcgcagcgccgcctatgacggcgtgcggctgctgaccgcgcgcggtcaccgccgcgtgctgatgctggccggctcgctcgccgcgtcggatcgcgcacgccagcgccatctcggttatgcgcaggcactcgaggaaagcggcgtcgccacgctgccgccggtggaagtcgacttcaacgcgcccgagctgcccgacgcggtgctcgcgcatctcaccgcacacgcgacgcgcccgaccgccctcttctgcagcaacgacctgctcgcgatggtcgtgatgcgcggcctgcgccgcgcgggcttctcgatcccggacgacctgtcggtgctcggcttcgacgggatcgcgatcggcgaattgctcgcgccgccgctcgcgagcatcgcgacgccgaaccgcgacatcggtcgccacgcgtggcaacgcctcgtcgaatgcatcggcggcgcggcaatcgaacgctcgtcgctgatcctgccgcacgtggtgcgcgacggcgcaaccgtcgcaccgccggccaccgaccggcaactgcgcaaggcctgaacgcgcgcaccgccctgaccacctcaccccagcgcctcacactcgcccggagacctaccgtgtcctttcgcctgacctcgctgctgcgcgctcgcagctcccgtcgcctgcgccgcgcttatcgccggcgcgcccgctgcccacgccgacgaaacggcgatctgctacaactgcccgcccgaatgggccgactgggccgcgcagatcgccgcgatcaagcagaagaccggcatccgcgtgccgttcgacaacaagaactcgggccagtcgatcgcgcagctgatcgccgagcagaagagcccggtggccgacgtcgtctacctcggcgtgtcgtcggcgttccaggcgaaggacaagggcgtgatcgcgccgtacaagcccgcgcactggaacgacatccccgcgaacctgaaggacccgcaaggctactggttcgcgatccactcaggcacgctcggcttcttcgtgaacaaggacgcgctcgacggcaagccggtgccgcgctcgtgggccgacctgctgaagccggaatacaagggcatggtcggctatctcgacccgtcgagcgcgttcgtcggttatgcgggcgcggtcgccgtgaaccaggcgctcggcggcagcctcgacaacttcaagccggcgctcgactggttccgcaagctgaaggcaaacgcgccgatcgtgccgaagcagaccgcgtatgcgcgcgtgctgtcgggcgagatcccgatcctgctcgactacgacttcgatgcgtatcgcgcgaagtacaaggacggcgcgaacgtcgagttcgtgattccgaaggaaggcacgatcgcggtgccgtacgtgatgagtctcgtgaagggcgcaccgcacgacgcgaacggcaggaaggtgctcgacttcgtgttgtccgacgaaggccagaagctgtgggccaacgcgtacctgcgcccggtgcgcgcacaggcgctcggcgccgacgtcgcgtcgaagttcctgccggcgagtgaatacgcccgcgcgaaatcggtcgacttcggcaagatggcggccggccagcaggcattcggccagcagtacctgcaagtgatgcagtaagcgccaggacgcaaccgatgctcgacctgactttcccgctgcgctggcgcgtcgcgctcgtcgcgccggcgctcgcggtgttcgccgcgttctggctgctgccgatggcggcgctcgtccgggtgtccgccgacggcgcattcttcccgcactacgcggccctgctcggcaatgcacgctacatgaaaagcctcggcgagaccgtcgcgctctccgcgggtgtcacgctcgcgacgctcgcgctgtcgaccgtctcgggcctcctgctcgcgcgccgcgaattcgcgggcaagcgcgtgctgctcgcgctgctcacgttcccgctcgcgttcccgggcgtcgtggtcggcttcatggtgatcatgctcgccggccggcaggggctgatcggcatgctgtccgcgaagctcacgggcgacaagtgggtgttcgcgtactcggtcgccgggctgttcgtcggctacctgtatttctcgattccacgcgtgatcgtcaccgtgatcgcggccgcgtcgaagctcgacgcgtcgctcgaggaggccgcgcgttcgctcggcgcgtcgccttggcgcatcttcgtcgacatcgtgctgccggcgctcgcgccgggcctgatcgcggcgggcgcgatctgcttcgcgaccgcgatgggcgcgttcggtaccgcattcacgctcgccaccgacctgaacgtgctgccgatgacgatctacaccgagttcacgctgaacgcgaacatcgcgacggcggccggcctgtcgatcgtgctcggcatcgtcacctgggccgtgctcgcgctcgcgcgccgcttcaccggccacaccgccgccgccgcggcctgaggattcccgcatgcaatcgctttccggctcttccgcaccgtcgccttcgccggcaccggctcccgcgcaggcgaacggcatcgcccgccgcgcaccgcgcgtcaccggcgcacgcatgatcgccgcgctgcaatggggcgtcacgctgctgctgtgcgcgttcctgatcgtgcccgtcgtgatgtcggtgctcgcgggcctcaccgtcaactactttcgcggcctgtcgagcggcctcacgctgcgctggctggaacaagtgtggcagcagtatcacggctcggtcgcgctgtcgctctacgtcgcgttcgcgacgcttgcgatcgtgctcgtcgtcggcgtgccggccggctatgcgctcgcgcgcagcaagcaccgcgtcgcgcgcgcgatcgaggaggcgctggtgctgcccgtcgcgctgcccggcctcgcgtcggcgctcgcgctgctggtcgtctacggcggcttcaccgcgttccggatgagcctgtggttcatcgtcgccggccacgtcgtgttcacgctgccgttcatggtgcgcgcggtggcagccgtcgcggccggtgccgacctgcgcacgctcgaggaaggtgcggccagcctcggcgcgtcgttcgtcacgcgcttcgtcacgatcgtgctgccgaacctgcgccccggcatcgtcgcgggcgcgctcgcggtgctcacgctgtcgatcggcgaattcaacctcacgtggatgctgcacacgcccgacaccaagacgctgccggtcggcctcgccgatacctatgcgtcgctgcgcctcgaagtcggcagcgcgtacacgatcctgttcctgctgatgacgctgccgctgctcgtcgcgatgcagtggctcggcgtcgatccatccggcacgcgcgcgctcaagaagcgcccgcgctgaatttctcgcagacatgaaactcgattccactcccatcaccctgacccgctgcgcgaagaccttccgcggcacgcgcgtgctcgaaccgctcgacctctcgatcggcgcgggcgaaacgctcgtgctgctcgggccgtcgggctgcggcaagacgaccacgctgcgtctgatcgcgggcctcgacacgccggacgccggcggcacgatcgcattcggccatgacgacgtcaccgcgttgccgatcgagcgccggcaggtcggcatggtgttccagaactacgcgctgtttccgaacctgacggtgcgcggcaacgtcggctacgggctgaagatccgcaagaccgaaccgcgcgcgctgcgcgcgcgcgtcgacgagctgctcgcgatgatgcggctcgacacgcatgcggacaagcccgtcgaccagctgtcgggcggccagcgccagcgcgtcgcgctggcccgcgcgctggcggtgcggccgcgcgtgctgctgctcgacgagccgctgaccgcgctcgacgcgaagctgcgcgacgtgctgcgtcgcgagatgaatgcgctgctgcgcgagctcggcgtgacgacggtctacgtgacgcacgaccaggccgaagcgatggagctcggcgaccggatcgtcgtgatgggcgcgggccgcatcgagcagatcggcacgccgcgcgacatctactaccacccggcgaaccgcacggtcgcgcagttcatcggcacgctgaaccggctcgccgggcagtggcgcgacggcacgctggtgaccacgggcggcgcggtcgccacgccgcacgcggccgacgaatggttcttccgccccgaggatgcgcaactcgccgaccccgcgcatgcgccgctgcgcggcgcggtcagcgcgtgcgcgttcctcggcgaacgcacgcggctcacgatcgcgcacgccgcccccgatgcactcgtgatcgacgtgccgggccgcatcgcgctcgcacgcggcacggcggtcggcctcgcgatcgcaccggaaggcctgatcgcgctcggtgcgtaatcggtcgttcgggcatcattcatgcagcccccaccgcggcgcgcgacgccgccgcgacaacaaccagacgattccgaggaacgacgatgctgcttgctcaaatcagcgatctccacatcaagcgtccgggccagctcgcgtaccggcgcgtcgacacggcggccgcgctcgcgcgctgcatcgacaaactgaacgcgctcgtgccgcgccccgatgccgtgctcgtcaccggcgacctcaccgacttcggccacgatgaagagtacggcaacctgcgcgggctgctcgcggcgctcgagattccgtactacctgatgatcggcaatcacgacgaccgcgccgggctgcgccgcgcgtttgccgatcgcgccgagctgcaggatggcgaattcgtgcagtacgcgctcgacgtcggcgcggtgcgcgtgctcgcgctcgattcgcaggtgcccggcgcaagccacggcgacctgtgcgacgcacggctcgcgtggctcgccgcgcagctcgacgccgcgcgcgaccggcccgtgatcgtcgcgctgcatcacccgccgttcgcggcgggaatcggccacatggacaagctgcgcctcgcgcccgccgccgccgcgaagctcgacgcgttgctgcgcgctcatccgaacgtcgagcgcgtgctgtgcggccacgtgcatcgcacgatgttcacgcgcttcggcggcacgctcgcgtccgcggtgccgtcgcccgcgcatcaggtcgccttcgacctgcgaaccgacgcgccgtccgcattccggctcgagccgccggcgttcgcggtccaccgccatgcgcccgatacggggatgacgtcgcatcacgtgtatgtcgatgaaggcgccgggccttatccgttctacgagccgacgggcgagctggtcgattgacggggtgaagcgcgcgcgatgacgggcggcggacggccggtttgccggtttgccggtttgccggtttgccggtttgccgatttgccgatttgccgatttgccgatttgccgatttgccgatttgccgatttgccgatttgccgatttgccgactctatcgactctatcgactctatcgactctgccgactctgccggctttgccggtccgccgcgcgcccggcaagattcacgccgctccggtatgatcggcagccttgaccggcaccccgcgcgcctgcgcacccgacgcgtgcgccgccccactccgtccgcgcagccatgtccaccgcccccaccgatcatccgaccgacgccgcctcgccccactattcgcgcagcctgctgttgctgctcgcgacgatcgcgggcgtatccgtcgcgaacatctattacaaccagccgctgctcgacagcttccgctccgcgtttcccgacggcgcttcgtggatcggcgcggtgccgaccgcgacgcagctcggctatgcggccggcatgttcctgctcgcgccgctcggcgaccgcttcgaccgccgccggctgatcctgatgcagatcgccggcctgtcggtcgcgctgatcgtcgcggccgccgcgccgtcgctggccgtgctcgccgtcgcgagcctcgcgatcggcgtactcgcgacgatcgcgcagcaggccgtgccgttcgccgccgagatcgcgccgccggccgaacgcgggcacgcggtcggcaccgtgatgagcggcctgctgctcggcatcctgctcgcgcgcacggccgccggcttcgtcgccgaatatttcggctggcgcgcggtgttcgccgcgtcggtcgcggcgctcgtcgcgctcgccgccgtgatcgtgctgcggctgccgcgcagctcaccgacgtcgacgctgtcgtacggcaagctgctcggctcgatgtggcatctggcagtcgagctgcgcgggctgcgcgaggcgtctttgacgggcgccgcgctgttcgcggcattcagcgcgttctggcccgtgctcacgctgctgctcgccggcgcgccgttccatctcggcccgcaggcagccggcctgttcgggatcgtcggggcggcgggcgccctcgcggcaccctacgcgggccgcttcgcggacaagcgcggcccgcgcgcgatcatctcgctcgcgatcgcgctgctcgcgctgtcgttcgtgatcttcgcgctgtcaggctcgagcctagtcgggctcgtgatcggcgtgatcgtgctggacgtcggcgtacaggccgcgcagatctcgaaccagtcgcgcatctatgcgctgaagcccgaggcgcgcagccgcgtgaacacggtgtacatggtgtgctatttcatcggcggcgcgctcggctcgtcggccggtgtagccgcatggcacgcgttcggctggatcggcttgtgcgcgaccgggctggcgttcaccgcgctggcgggctggttccaccatcgcggcggccggcgcgactgaacgcgaccggccacggcagcgtcacgcgtcggtgcggggcgctgccggctcggcggcgggcggcggcgcgaacgccggcgccggatccacgaccccggcggggtccatcacggcagccggggtcggcacggccagcggaacggcggaaggcgccaggatcggtgccggatccggcaccgcgatctgctcgggtgcggacgaagcctccgccgccggcgtggctgccgcggccgccgaaccggcggctgccgcgcgcgccgcgggccggcgcgccggatcgaacacgaacgacaacccgacgctgccgaggatcgcgacggtcgcgaccacggtcgccatcgtcaccggctcgcccagcagcagcgcaccgagcgcgaccgcgacgatcgggttcacgtacatgcagctgctcgcgatgatcgggctcgtgtggcggatcaggtagccgtacgcaacgtacgcggccatcgtgcagaacaccatcaggtacaggaacgcgaacaccggccccaccatcacgtgctcgatgcgctcgccgatcagccaggcaacgagcgtcgagatcatgccgcccaggccgatctgcagcgacgtggacaggaacaggtctgacggaagcttgagccgcgtcgcgagatgcgcgccgccggcccagaacagtgcgccggccagcacgcagatcgtgccgagcgccgaattctgcgcggccgcgccgcccgaattcagcacgacgatgccgaccatcccgagcgcgacggccgcccactcgcctttcgtgaccggccgcccggcgaccgccgcgatcacggtcgcgaacagcggcaccgtggccaccatcaccgcggccgagccgctgctgaccgaactgatcccgagcgcgatcgtgccggacgacagcgcgacgagcatcgtgccgacgatccccgcattgcggatttcgagcggcgtcggccattcgggcttgcgccgcagcgcgaagatgaacaggccgatcccgccgagcaggttgcgcagccccgacagcagcagcggcgggaacgactgcagcgcgaaatgcaggccgctgtaggtcgaaccccagacgaaatagatgaacacgagcgccagcgcgacgcggccgccgcggctttgcggcaggcggatccggaacgagaagcgggcgaggaaatcgaggagacggtcgagcggcgtcatcgcgcagcctgcccgcacgtcgcgccgcgtgctccgctgaaagacgccggcgatgccggcaaacggcgggaccgggaaggcagagcgaacgtgcggaacgacatggcagtgcgaacggcgacgaaagagaaccggcaggcggcggcagagggacaaaaaaatgcgcgcaaccgtttcggctgcgcacgctcggcattatggcatcaaggattcgaaagcatcatcggacctgtctgaaaggatcgcgaatgatgtttccgcgcgacatttacggccggcgggcgggtgaaatcgggggccggatacaccgcgcgcttgcgctgccggtgccggctcgcctccaccgccagcggcgatccaacgcgcccgaaccaggcatcggccgaacggccagtcctgcacgccggccactgcttccccttatcgtgacggtcgactcacgcgccgcgcgccctgcgcgaccttccttcaaaacccgcaccatccatacaaaattttgtataattcgaccattcttccgccgaagccggttgttttcgtcggcagcgccctcgccgatcttcgcggctttccgctgcccgcgcgacgcgaagccggccaccagatcgaccaggtgcaacgcggcctggcgccggacgactggaagccgatgcgcaccgtcggcgtcggcgtgcgggaaattcgcctgcgcgatgcgagcggtgcattccggatcatttacgtcgcgaccttcgccgacgccgtctacgtgcttcactgcctccggaagcaatcggcgcgtacgaccagggccgatatcgatctggccgcccggcgctatcgcgcgctgatgatggagaggaaacgatgaccaacgaacgttacgagagcgtctgggacgcaatcgagggccagccggccgaagccgagaacatgaagctgcgctccgaactgatgatcgcgctcaagcagcgcatcgcgcagctcgagctcagccaggcccaggccgcgaaacagctgggtgtcacgcagccgcgcgtctccgacctgctgcgcggcaagatcaacctgttcgggctcgacgcgctcgtcaacatggcggcggctgtcggcctgcgcgtcgacctccaggtgcgtgaatccgcgtgatgcatcgcggcacgcgccgccaccgcatgccacgcaccgctcacgatccgccgaaccagttgtacccctgatcgacccaatagccgcccggatacgtatcggtcacgaagatttccatgatgtgcttcgggttcttgtagccgagcttggtcggcatccgcagcttcatcgggaagccgaattccggcggcagccggcggccgtcgtagtcgaacgcgagcagcgtctgcggatgcagcgcggtcggcatgtcgatgctctcgtagtaatcgtccgcgcacttgaagcccacgtacttcgcccgtatatcggcgccggcccgtgcgagaaacgcaccgaacggcgtgccgccccagcggccgatcgcgctccacccttccacgcagatatgtcgcgtgatctgctccgcgtgcggcagcgcatacagttcgtcgagcgtccacacgcgcttgcccgtcacgcggccggacagcacgagccggtacgtcgacgcatcgacgtgcggcacgtcgtcgatcccgtaatacgcgttgaacgggaacggtcgcgtgatttcggcttcggtgtaggtcggtgcgagccgttcgccgctgaacagccacgcctgcacacggtcgttcatgcgcgacaccgtctcgaggaacgtgttgaccgacgcgtcgtccttcaacgtgcagccggtcagcatcgtcaggccgccgagcgtcaggatgcgccggttgaagaggcgccgcgacggcatctcgagctcgcggcgcacgtccagctcgagcgacttccggtcgagcgtccagcgcgaaccgtcgcgcttgtattcggattccgacatgatgatttccttcgcccgcggctcgcggtcagcggccgcgcagcatcgcgagcagcgagcgcggcaccagcagcgccatcgcgacgtgaacgacaacgaatgcgacgagcagcgacatcgcccagaagtgcacgacacgcgcgttgtcgtagccgccgaacaattcgcgcagcagcgggaattgcacggatttccagatcgtgagccccgacagcaccagcacgacgagatcgacgatcgcggtcaggtaagcggcacgctgcaccgcgttgtagacgctcaggtcgtcgtgcgacagccgtccgcccagcgcggcacgcacgtcgcgccatatcgacgccggcgtgaccggcagcatcttgcgcgcgaggcgccccgtcgcgatcgacatcgcgaggtagaacagcccgttgccgaccagcagccacattgccgcgaaatgccattgcagcgcgccgccgagccagccgcccagcgtgatgccgtgcggaaacacgaacggcggatagatcggcgacgcgtcgtagatgcgccagccggacagcaccatcaggatcgccgcgagcgcattgagccagtggctcgcgcgcacccacagcggatgaatcgggcgcgcgggcggcgtggcggtcgcgcgcccggtagcgggaacggtttgcatgatgaagactccgggaatgagtcgacgagacaggatgcgatgcgggcggccgccgtgcgacgcacgcgccggccgcaccgcgtccgcctccgtcagttcgacggcgccatcttgtcgcccgacggcttgcccatctcgtcgtgcgacatcgcgtccttcttcatcgcgtctttcttcatcgcatgcttcttcatgccgtccttcttcatcgcgtcatggcccattgcatccttggccatcgcgtcgtggcccatcgcgtccttcgacatcgacgaacccggctgcgacatcgcgtcgttctgcgcatacgcgcccgaggcaatcgtggcgatagcggcgacgcaagcggcgatcagtactttttcatgacatctctccaacacatgggtttaaggagccgaatagacggacgacgtcgcgggaaatgacagccgctgcgaaaattttttgaggttgcgcgaaagcgcgccatgttgcaccgcttcgccccggccggccgagccgtggggccatgcggcggcgacgcgcgctgccatttcgacgggccatcgcaccgcccgccatgctgcggccgcaccggggcagccgattctctcccggttgaaaccgccgcgaagccagtgtatcgtgtgcgctgctaacgcggggtcctgcaatgcgcgcggtcaaacaaccggcattgcgggtgagaaataccctttgaacctgatctggataatgccagcgcagggaagcgtacggatttcgccgccatccttctgacgaaatccgccgcctcaccaagcctcgtctcctgcttagctcgagccccacattcgtcaagggctccgggcaagcgccgaagcgcctgtccggcgctcatacaggagattgcatgaacgccaatccgaagtttctgtccgccgacgcacacgtcgacgccgccgctgtcgccccgctgcccaattcgcgcaaggtttatgtaaccggctcgcagcccgacatccgcgtgccgatgcgtgaaatcacgcaggccgatacgccgaccggcttcggcggcgaaaagaatccgccgatctacgtgtacgacacgtcgggcccctataccgatccggacgcgaagatcgacatccgcgcgggcctcgccgcgctgcgccagggctggatcgaggcacgcggcgacaccgaagtgctcggcggcctgtcgagccagtacggcctcgagcgcgcggccgacccggccaccgccgacctgcggttcccgggcctgcaccgcaacccgcgccgcgcgcaggccggcaagaacgtcacgcagatgcactacgcgcgccagggcatcatcacgccggaaatggaatacatcgcgattcgcgagaaccagcgccgcgccgagtacctcgagagcctgaaggcgagcggcccgaacggcgcgaagctcgccgcgatgatgggccgccagcacccgggccaggcgttcggcgcagcggccttcggcgcgaacgcgccggccgagatcacgccggaattcgtgcgctcggaagtggcatgcggccgcgcgatcatccccgcgaacatcaaccacccggaatccgagccgatgatcatcggccgcaacttcctcgtgaagatcaacgcgaacatcggcaactcggccgtcacgtcgtcgatcggcgaggaagtcgacaagatgacgtgggcgatccgctggggcggcgacacggtgatggacctgtcgaccggcaagcacatccatgaaacgcgcgagtggatcatccgcaacagcccggtgccgatcggcacggtgccgatctaccaggcgctggaaaggtcaacggcaaggccgaggacctgacctgggaaatcttccgcgacacgctgatcgagcaggccgagcaaggcgtcgattacttcacgatccacgcgggcgtgcgcctgcagtacgtgccgctcaccgcgaaccggatgacgggcatcgtgtcgcgcggcggctcgatcatggcgaagtggtgcctcgcgcatcacaaggaaagcttcctgtacgaacacttcgaagagatctgcgagatcatgaaggcgtacgacgtgagcttctcgctcggcgacggcctgcgccccggctcgatctacgacgcgaacgacgaagcgcagctcggcgagctgaagacgctcggcgagctcacgcagatcgcgtggaagcacgacgtgcaggtgatgatcgaaggccccggccacgtgccgatgcagctgatcaaggagaacatggatctccagctcgactggtgcaaggaagcgccgttctatacgctcgggccgctgaccaccgacatcgcgccgggctacgaccacatcacgtccggcatcggcgccgcgatgatcggctggttcggcaccgcgatgctgtgctacgtgacgccgaaggaacacctcggcctgccgaacaaggacgacgtgaaggaaggcatcatcacgtacaagctggccgctcacgccgccgacctcgcgaagggccacccgggtgcgcaggtgcgcgacaacgcgctgtcgaaggcgcgcttcgagttccgctgggaagaccagttcaacatcggtctcgatccggacaaggcgcgcgaattccacgacgaaacgctgccgaaggattccgcgaaggtcgcgcacttctgctcgatgtgcggcccgcacttctgctcgatgaagatcacgcaggacgtgcgcgagttcgcggcgcagcagggcgtgtcggaaaccgaagcgctgaagaaggggatggaagtcaaggcggtcgagttcgtcaagaccggcgccgagatctatcaccgtcaataagcacgcgcggcgatccgcccgaaccgccgcgtctcgtgcttcggcgctgcgcaagcccgctttcgagcgggctttttgtgcgtgtgcacaccgcgtgcctgccggcgcgagggaaacaaatgattacgaaaccgcccgagccttaacaagtccttacagcagccccacgggacggcgcgtagattggggtcatgcgcggtcgccagccggtcgcgcgacctccgttcactaccacaaggacaacgatcatgaactcgattcggcgttttggggtatgcgctctgctcgtcgcgacggtggccagcctgtcggcctgcgattcgatgtcacgacgccagcgcgatacggcaatcggtgcaggtgtcggcggtgtcgccggggcggcgatcggcggcagcgcgctgtcgacgctcggcggcgcagcggccggcggcatcatcggcaaccaggtcggcaagtaaaggcggcgcaacgcgccgcgacagtcgaccagacggcgttttcgcggtgcggaagcgccgttttcgcatgcggcgccgcaacgtggccgacagccatgcggaaatgatccgttaccgttttgcacaccgtgtcatcggcgcgcggcctaagcttaagcatctgccgattgccggctccgccggagagacatcatgaacaggaccctcgtcgccgcggcgctcgcctgcgtgacgctcgccggctgctactacccgtacggctattatcccggcggctactacacggctgcaccggcccccgtctatgtcgatccaggccccgcctattactatccggcgcctgcctacgcgcccgcatggggcggctattggggaccggcggtatcgctcaatttcggcttcggcggacgcggcggacacggcggctggcgccatcactgaccgggctcgaccgccggcacgcggccatcgcgtgccggcaaccggcgacattcccgtttcttgccatttcatcgaaacgtgaaacgacggcctggtaacggggtgtaagattcccgcatcccttccccgcccttcacactcgatgtcgcccaagaacgcccttctgctgaccgtgctcgccgccctgtggggtgcgtcgttcctgtttatccggatcggcgtcgtcgatctcggcgtggcgccgctgatggcgttgcgggtcggtatcggcgcgctgtttctcgcgggcttcgcgctgacgcgcttcaaacccgccgatctcggcacccggctgcgccgtcacgcgtggccgttgttcgtcgtcggcgcactgaactcgggcatcccgttctgcctgttcgcgttcgccgagctgacgctgtcggccggcgtgacgtcggtgatcaacgcgacgacgccgctctggggcgcgctcgtggcctacctgtggctgaaggacaagctgtcgctgccgcgtgcgctcggcctcgtgatcgggttcgccggcgtgctcacgctcgtgtggaaccagatcgcgaatgcgcatggcgaaacgggcgccgccgcgaccgcgctcgccgccgccgcggcactcggcgcgacgctgctgtacggcatcgcggccaattacacgaagcgcaagctgaccggcgtcgatccgctcgtcaacgcgaccggcagcatgatcggctcgaccgtcctgctgctgccgttcgcgatcgccacctggccggccgcgccggtcagcgcgcacgcgtggggctcggtgctcgcgctcggcgtcgcctgcacgggcatcgcgtatttcatctacttctacctgatcgcgcatgtcggccccgcccgcgccatcaccgtgacgttcgtgattccggtgttcggcctgctgtggggcgcgctgttcctcggcgaacacgtgtcggccgtgatgatcgaaggctgcgcgatcgtgctcgtcggcaccgcgctcgcgaccggcgtgatcaagcggattccgggatccggccgcgcagcggcgaagcgacctgacgattcattcgggtgcgcgtatcgccatcggtcgggccgtgatgccttccgaccgggtgcctgctgttctccgcgccgccgtggagggtgccgcagcaccgccggcattcgtctgacggcgacatgcgctcgcggccctgccggccgccgggattgcccgcctcgcctcatcgtgcgcaccatgctcaccatgccgccgggttgtcatgtgcggcggcggcgccggccgcagccgcatacccgcgtgcgtctggagtttccctgatacgcgagcggccccattcccgttacactccgaacacttacccgcagaaggcggcctcgatgtctcacgtcctttcgcgtccgccggcgcgtgcgaccgcttcagcgcggcggcgcgctaccgccccgccgctcgccccgggctccgctgacatgaagcccgcccgcgacctctcgctcgactccctgctcgaccgtctcacgccgacgcccggcggctgggtcgccacctatcgcaccacgacgctgcgcagcgtgttccagcccgtgctgtcgatcacgcacaagcgggtcgtcggttacgaggcgctgctgcgcgtcgtcgacgcgaacggcgcactgatctcgcccgccgccctgttcgacaagacgcgcgccgacgccgacgcgctgctgctcgaccggctcgcgcgctgcctgcatacggccaacttcgtcgcgcagggcatcggcgacggctggctgttcctgaacgtcacgccgcgcgtgctcgactcgggcctcgtgcagcgcgaattcgtcgaggcgctgtgccggcatttcgcgctgccgccgaaccgcatcgtgctggaggtcgtcgaacagccgtctcgcgacgaagccgcgctcgcccgcacgatcgacatgatccagcatcgcgacttcctgatcgcgatcgacgatttcggcacaggcttctcgaacttcgaccgcgtgtggcgcgcgcgccccgacatcgtcaagctcgatcgctcgctcgtcgaacgttcgaccggttcggccgacgatcgccgcatcatgcatcacctcgtgtcgatgctgcaccaggccggcgcgatggtgctcgccgagggcgtcgagaacgacgattcgctgcaggcgctgatggaagccgacatcgatttcgtgcagggtttccagttcggccagcccgacgcatcgatcgcccatgccagcgcggcagcacccgcgatgctcgacgccgcgtggcagcgcttcatcgcccgccggcacacgccggtcgtcgccgagcagccgggcttcgacgcgatcgagcggctcgtgctgaccggcgcggccgcgttttccgcgagcggcaacctgcaggacgccgcgcatcgcgtgttcgcggtgccggccgcccgccgcgtgttcgtcaccgacgaaaccggcgagcagttcctgccgtcgatcggcgcgcccgccgacgacggccaggccggcgtcacccgcctcgcaccgctctttccggagacccacagcaactggtcgcggcgcccgtatttccagcgcgcgatcgccgcgcccggacgcgtcgcgctgatgggcccgcatttctcgctgacggaaggccgcgactgctatacggccgccgtcgcgatccgcgcgcagagccggctcgtcgtgttctgcgtcgacttcgtactcgacagcgccgggaccgtgatgcggtaaccggcgcgggtgcgagcgcccggctgtcgcacccgcggctcgtccgcccgaccattcgtcagtcgatcaccttccctcttcccgacttcaccgcgctgcggcgcgacttgtgctcgagccgccgctccttcgacgcgcgcgtcggccgcgtggcgacccgcgcgcgcggcgtgaacgcaacgccggcgatcaatgcatcgaggcgcgccagcgcggcctcgcggtttttctcctgggtgcggtattcctgcgacttgatcacgacgatgccgtcgcgcgtgatgcgctggtcggacagcgcgagaagccgctccttgatgacaggcggcaacgacgacgcacggatgtcgaagcgcaggtggatcgcgctcgacaccttgttcacgttctgcccgccggcgccttgcgcgcgcacggccgtccattcgacctcggccggatcgagcgtatagcggatcatcatcgcgacgcctccatgcggcgccgtgcaagcgcctcgtcgacgcgcgccgcgagccccgaatcgcgctgcgtgcgcgtcgcgaccgcctgcgccagcacgcgccgcggcccgatcacctgcacgcgcgtgcgggcacgcgtgacggccgtatagacgagttcgcgcgtgagcacacgaccgaacgatgccggcagcacgagcgcggcttcgtcgaattccgagccctgcgatttgtggaccgtcagcgcgaacgcggtttcgtgcggcggcagcgcggccggcgacaccgcgcgcgcggtgccgtccgcacgccggaaccacacgcgcagcacgccgtgcgcgtcgggcagcgcaatgccgatatcgccgttgaacagcccgagcgcgtagtcgttgcgcgtcaccatgatcggccgccccgtgaaccagtgcgcgccgaccgccagcggcacgcgcgccgcgtggcgcacgtgcgcggccacgagcgcattgacgtgctccgcgccgcgcaagccgctgcgggtcgcgcacaggatccggaaccggttgagcgcgtcgaacagcggcagcggatcgggcaccggcgcggccagcgcgtcgcgcaacgcgtcgaggtaagcaccgaaccgccgcgcaagccgctcgagcgtcgacgtcgcgagcgactcgcccgcatcgtcatggaacgacgcagccgccgaatcgtcggcgggcagcgcgtcgagcgcggcctgcacgtcgccgctgcggatcgcgagcgacagccgcccgatcggcgaatcgagaccgaagcggtagttgcgttcgagccagaccacgcagtcggcgagcggtgccggtgccggtgccggtgcgggcgtgggcgcggcggacgcggcggcgggttcgcccggcgggttcgacgtgaccgacgcaagcgccacgtcgcctgcgtcgaacggcggcagctcgacggcgtcgagccacgccagttcgtcgacctcgatccatgcggaggcctcgcctgcgtcgccagtttcaccggtttcggccggcggcggcgcgacgttggacgacgaaacttcgtcatcctgcggttcgtcgtcgaagagcgatgcctgtcgcgcatcggccttccgtcgcgacgccggcttgcgtgtggtggccgatggcggcgccggggcgcgggccgcggcggaaaccggatgcccggcgggaacggctgcgaccacggtcgcggcctcgtcctgcaccggcaacgccgcgacgaatgccgcctcgtcgatgccgagcgcctgagcgatgcgcgtacgcgccgcggcggtaaacgcgggtcgcgcgctcagctccgcgaatacggcacccgcctcgaccgcggccagttgatccttgtcgccgagcagcacgagccgcgcgcccggcgcgagcgcatcgagcagatgcgcggcgagcgcgacgtcgatcatcgatgcctcgtcgacgacgatcaggtcgtacggcagcggattgtcgcgatgatgccggaaaccggccgccccgccgccgcccagcagccggtgcagcgtgtacgacgtatcgggcaggcgcgccgcgagttccggcggcaggtcgccggcccgcgcatgcagtgcctcctgcatccgctgcgcggccttgccggtcggcgcggccagcgcgacgcgcagccccggatgcgcatcgagcagacaggccagcacgccgacgacggtcgtcgtcttgcccgtgcccgggccaccgctgacgatcgtcacgcggccggtcagcgcgacgatcgccgcgacgcgctgccagtcgacttcgccgttcgccggcccgaagtaacgcgcgagactgtcgcgcagccggtcgggcgcaagaccttcgtccggcacggtcgcaccggcctgcgcgacgagcgcatcggcgagccgccgttcgtagtcgaaatagcgcgacaggtacaggtggtcgtggcggtcgacgatcagcggccgctcgtcgccacgcgcgagcgtgccgaacgcgaccacgccgctcgcggcgagcgccgcgcgaacctcgtcgaccggtgtttcgtagcgctgcgcgagcgcgccgagcgcgacgcacacgtggccgcccgccgtcgcacgactcgtcgcgaacgcggcgcgcgccgcccagcgcgcggccgcggccggcgcgccggcgcggcgagcgagatcgccgatccgccgcgcgaaaccttccgcgagcgcgatgccgaaatcggcgggctcgggcagccgcgcgacgaggccgccggtgaattcgagcgtatcgtcctgcgcgttcatgcgcggccccttccatcatccggtcgagtgcgtcgacaagcgcgcgcgcgggccgccgcgcatgcacgccggccggctcgccgccgctgcgccagccgggccgtacaccccgcacgaacaggtacaggtagcccgcgacgtgcgtgtcgtagtcgtaatctggcaaccgcccgcgcaggtagcgatgcagcgcgaccgtatagagcagcgcctgcaggtgatacgcgtggtcggccatcgcgacgtcgagcgcgcgcgggccataggcgtccggcgtcgtgccgagatggttcgacttccagtcgacgatccagaagcggccgtcgtgttcgacgatcatgtcgatgaaacccttgatgaaaccggcgagcatgcccgcctccagtgcaacgtccgggtagccgtgcgcgaccagcaggcggcgtagcgccatcaggtcgagcgacggcgccgggaacaggaaccccatttcgtcgagccgcttcgcgggatcgagatcgacgagccgcatgcccggcacgagctcggtgtgcacgacgtcatcgaccagttgcaccatcatcgccggcagacgtgtcgcgagttcgggcccggcctcgaccggccggtcgtgcagcgcaccgagcgcggccttcggccacgactcgggctcggtgaaccggctgagctcgaacaggcggtgcaggcactcgccggccgccgcgccgcgcgggaacacgaggatgtcgtcgtccggcggttcgggcgcaaccgtatcggccaacagccactcggcatccggcgcgaccgcggcgagcgcatcgtggtcgggccgcagttcgtcatccggcacggccgcgacgcccgcctcctcgcgcgccatcgacgcggtcagcgaactgaagctggccatccgccaggcatcgcgcagcacgcgcgtcgcatggcgcgccgcgagcgtctgcgacgcgtcgtgcccggccgccagacgctcggggcgcgcaggcgccggcagcggcgcgacgctcacggggccgcccgcgagcgcgtgccacgccgtatcgagcgcggcttcgtcgggcggctcgtcgagccatgcatcgaacgactggccggcgccggcgacgagccagttgagcacgctgcgtcgcgcctcgcgcgtcgagcgcgacgacaggtacggcccggcgacgacgtagcagcgatagaccgcacgcgtgagcgccacgtagacgagccgcgcgcgctccgcggcctgctcgcgcagcgcttgctgcgccgcatgcgcggccgcctcgtcgtcgcacccgtaatgcagcaccgcgtcgcccgcatcgtcgtggtattcgcgcgcatcgggcaacgcggacgcgggcggctcgcgcaacccgccgtcgttcaggaacggacagaacacgatcgcgtattcgaggcctttcgacttgtgcacggtgacgatctgcacgaggttgcgatcggattcgagccgcaactgcgcttcctcgccgccgccgtcgagccgttgcgcggcaagccagcgcagcgtcggcgcgatgcccggctgcgcggacgcgcgtgcctgcgtcagttcggccagatggttgatgtcggtcacgcgacgctcgccgtccgcgccggccatcagccgctcggcgatccgcaattcgcgcgtgaacgtgcgccacatcaccgcgaaaccgcgttcgcgccacagcagccggtaccgcgagaagcgctcgacccagctcatcgcgtcggcgctgtcagccgcggacgcttcgtgtgacgcatcaccgtcgccctgctccatccgccacagtgcgccggcatcgaggccgaaccagtcggctgcgagcgccgcgcgcagccgccgcaggtcgcccggcgcatcgatcgccgccagtacgcgttcaagctgctccgcgtcgccggtcgagaacaccgaggcctgcgccagttccacgctgccgatgccccacgtggccagcacgcgcttcacgagactgccctgccggtgcgtctgcacgagcactgcgatatcgcccggcgacagcggcgactcgccgagccgcacgcgccctacgcgcgcgccccgcatcagccgggcaatctcggcggcacaggcctgcgccgcctgtgcctgcgcatcacgcttgagcaacgtgccttcaccgccaggcaacgcccacacccggaagtcgcctgccgggccccgatcggtttcgtcgacgaacggcgcgcgcacgcgcgtgccggcacgcaccgcgtaatagtcgagcccgtccagcacgaacgcgcgcggattcgacatgaaaaagcggttgcacgcatcgacgatcgcgggcgtcgagcgctggttgaccgcgagcgtgtagcacgcgctcgcccgcgcgcgcgccgccagataggtatgcagatcggccgcgcggaagctgtagatcgcctgcttcggatcgccgacgaggaatagcgggccgcccggcgcgaagatccggtcgaagatcgcgaactgcagcgggtcggtatcctggaactcgtcgatcagcgcggccggatagcgcgcgcgcagcgtctcggcgagccacggatgcgcatgcagcgcgtggtacaggttcgccagcagatcgtcgaacgacacgatgcgccgcgtgcgcttgcgctcggccagctcgcccggcgccatgtcgagccattcggcaatcagcgcgagccagcgcgcgcgttgcgcggcttcagccgccgccacggccgcctcgagcgcgtccgccacgtcgaagaacgcgtgttcgggcgtcgcgccgcctttttcgtcgccttcgcgagcgcggtgcgggtgagcttcagcgcggccttcggcagcgcagccgtcgcgtcgccctgcgcgaaatgcgcggcccatgcggcgagcgcatcggcaaccgcttcgggtttgtgcgaacgctggttgagcgcgggctgcgcggtgcgcagcaacgcatcgatcgcttcgcgctcggccgcccacatccgcccggcctccgcgaagcattcggtcgcggcggcctcggccgattcgtcgggctcggtcacgccgtcccagcgcagcgcggcgagcggcttcttcagccggcgcgcgagctgcgcgtcgagcgcggccggcccggcccccgattcgacgagccaggtcgcgaaacccggccagcgtgcggccgccggttcgacgcgcgtgcgccagaaatccgccgcgagttcgaagcgcagcgacgcatcgtcggcctccatgtcgaacgcgaacggcatcgcggccgcgaacggcgcttcctgcagcgcgcgctgacagaacgcgtggatcgtatggatggccgcctggtcgaacgcgcgcagcgcacgccggatccgtttcgcggccgtttcgggatcgagctcgccaccttcgccgagcgtcgtctcgagcaggcgctcgatgaacggatcgccgccgtcgtcacccgtgtcgagcgcatgcgcaagctgcgcgagccggccgcgaatccgctcgtgcagctccgcggtcgccgctttcgtgaaggtcacgacgaggatttcgtccgcgccgagatccttttccagcagcaggcgcacatatagcgcgcagatgttccaggtcttgccggtgccggccgatgcctcgatctggttgacgccatcgagcggacacgcgaacacgtcgagttcgagcgcctgctgcggctgcgacacggcgctcatgcgacctccttcagatgctcgacgagcggatcgaacacgagccgcgcgagcgtggcgaacggctcgtcgagcgacgcatgcgcgccgcgccatgcgatcgcgatggccggatcgtcggcttcgctcacgacccgttcgttaatccagacgctcgcggccttggcctcgccgtcggacacccgcgcccatgcgctgcgcgggaaaaaccgcagcggcatgcgccgccccgcgcgaaacagcgcggcaagcggtgcgagctgctcgagcggcgccgcgacaggcgtcagctcgaacgcgccgccgctgccgaaccacagcgtgcggcgcgggccgccgggctcgatcgcgcagtagacaagatgcgcaagccacgcggacaggtaatcgcgcgcactcggcctcgcataacggtagatgatctgcccggcctgcgtcagccggttcagcgtgccgtgcagttcaagcggcgcgctcaccgcgtcgcccgacagcagcgcgtcgtgcgcgccgaacagcgcctgctcggtatcgggccacgcgggcacgacggtgagcgagaacgaccgccgctccatcccgtcggccagcgctcgacgcacgttcgacgccagttgcgtcatcgagccgagcgcctggtcgcgccacacggcgcccgtcgcgccgcccggcagttcggggctcgcgtccgcgatgcgcagcgcatgatcgtgcacgcagccctcgtccgattcgatcagcagcggcagcacgcgctcggcgagcgcatcgctgccggcgaagtcgagcgcgaacggttccgtatcgagcagttcggcctgcgcgtccgcaagcacgatgccgagccggccgcgcagcaacgcgcgcgccggatggcgccagaagcgttcgaattcgctgaatgcgacaggctcgaccggttcggccggcagcggctgcgcgaagaacggcaattcgcgcgggccgtcgcgcgacgcttcggcggcgagcagcgacgcgagcgtcgcccgctcggcgtcataggacacgagcgcgctgccgggctggaaatacgcggccgcgaacggttgcagcggatgctcgacgatgaacgcgcgccgcgcggcatcgaccgcgtccggcgcggcgtcggggcctgccgtgacgagcgcgagatggtcgagcaattcgtcgacgagtgccgcgggcggcaacggcgcgttgtcgcgaatgctgcggcccgtgtacgcgatcagcaaccggtcgcgtgcggcgagcagcaggtcgagaaacaggttgcgctcgtcgtcgcggcgctggcgatcgccgagcttcggcaacacggccatcaggtcgaattcgtccgcgcgcgcgaggctcggcagcacgccatcgtccatcccgagcaggcaaacgacgcgatacggcagcccgcgcaggctcgtcagcgacgagaacgtgacgccgccccacggcaccccgccgcgcgccggatcgtcgagcgcggtggccagcccggcccggacgacggccgccgacagcgcttcgtcgggcgcccctccgtcatcgcggccagcatcgcgtcgagcgcgtcgcgcacgcccgcgagcgcatccgcatacgcggcgcccgaatcgaagaaacgcgcgagcgtgtcggcgaacagttcgctccagccgtgcggcgtatgcgattcggccagccgccgcgcgaagccgtcgaggtcgtcggtgaagcgtgcgagccggccaagcagttcggcctcgctgccggtggccgcttcgatcggcagccacgcgccgaccggcgccgcgccttccggcatcgcataaccgaggaagagccgcgcgagcgcatcggagaacgtatgacgcggcgacggcacggccgcatcgtcgctcgcgagcggcgacagcccgcgccgcgcgccggcggccgcgagccaggtctgcaccgtctcgagtgccgtcgcatcgatgccgtagcgtgccgacaccgcgtcgacgcgcagccattcgaccagctcgggcgcaccgacctgccgctccggcaatgcgagccagtcgagcagcacgcgcgcgaccgggttcgcctgcgaaggcggcaggccggtgatccggtaaggcacgcgtgcaccgccgctgccggccgtgccgaacacggcatcgatcaacggcccggccgccgcgagatcggcgaccgcgacgagcacgtcggacggctgcaggctcgcgtcggcgtcgaaccacgcgagcagccggtcgtgcagcacctcgagctggcgcgcgaggctgtggcacacgtgcacctcgatgccgcgctcggccggaggatcgccggcttcggcctcgggccgcagttcgaggatcgcgttctgcacacgcgcgagccacgtcggcgcgggattctcgatgaaacgcgacgcgtcgcccgacgcggcgctttcagtcagttcatgcagcatgtgcagctgcgcctgggtctgcctgccccattcggcgagcagcggatggccgacctcctggtagtcgaggcgccctgccgcgtcgagcgcctcggcatgcgcggcggtcacgatgtcgaaccagaattcgcggcacgggttcagcgcatagacgcgcacgtcgatccagcgcgacagctcgcgcagcaatgcgacgtgcagcggcggcatcgtcggcagcgcgaacacgctgaccgattccggccaatgcgtgcgtgcgcgcgcgacggtttcaggatcgagatggcgcgcctcgacgaggaagcggtgcgccggcggcgtgccgctgtcgctcagctcggcgagcagcgcgcgccacagcgcggcctgccagcgctcgtcgtcgcgcgcggcgtcgctgatcccgcgcggcgcgccgtcgcccgcgagcacggactcgccggcctgccacgcggcgagccactcgggacgataggtcaggtaatggtcgagcacggccgcgacgcggtgggcaagctcgtagcgcatcgcatcgtcggacgcggacagatacgcggccagccgcggcgacgcgagccacggcgcaccgtcggatgcctgcgcgaacagccggtagcagcgccacacgaggcggtcgggtgcgaacggcgaacgcgcgggcaccgtcagcacgcggccgatctgcgcccacagccactgcgcgagatacgtgaactcgacgttcgcgcatacgccgttgcgcgcggcgatgtcgagctcgaggcgacggcgcagcgccgcgctcggcacgatgacctgttgcggcgcccacgggccgttgcgggccgggaacgcggccagatcctcgagcagcgcgtcggccagcgtttcgtgacggttcgaatagaagagatggagcatgaagcaggcgtcggaacctcgcgcgggcagggccgggcgaacaggatcaccaaggatagcaaatggaccgccttcgcgaacctcggccggaaagccaggttttgcggaccgcgaaatacgatagactcgtcgccagtcaatacgccgccccgggcgtcttcgtctgccattcagtccatcgatgcgctattcggtcgaaatcagaaagtttttctacagccagtactttttcggcggcctgcggatcgcggtcggcgtctcgctgccggccgtgctgtgcctgatcgtgtttcacaaccgcgagctcggcttcacgatctcgaccggcgcgctcggcgcgtgcgtcgtcgacatgccgggcccgctcaagtacaagcacaacgaaatgctcgcgtgcagcgtgatcggctttctggccgcgctcgcgaccggccttgccacaccaaacatcttcgtgctgtggctcaccatcgtgccgctcaccttcgtgctgtcgctgatcgtcgtctacggcaaccgctggccgcagatcagcttcgcgacgctgttcatgatggtgatgacgctcgaggagaagttcacgccgctgcaggcgttcatcaacgccggctggattctcgcgggcggcctctggtacacgtactgggccacgctcgtgtcgcgatggcaggcgcgccggatcgagcagcaggcgctggccgagagcctgttcgcctgcgccgactacctgctcgcgcgcgcgcagttctacgacctcgatgccgatctcgacgagtgctaccgcaatctcgtcgccaagcagatcacggcggtcgaaacccaggaaaccgcgcgcgacatcgtgctgcgcaacctgccgaagctgcgccgcggcaagctcgatcccggccgcacgacgatgtacaacctgttcatcaacagcgtcgacctgcacgagctgttcgtcggcgcgcacaccgattacccgctggtgcgcaacacgttcggcggctcggacctgatcatcttctatcgcgacctcatcggcaaggcggccgccgatctcgaggagatcggcctcgcggtgctcgaaaaccgcgcccgcattcgcggatcagcgtgaaggccgagctgcgcgcgatcgagtacgagatcgagctgatgcgcaagaagaacttcccggccaccaacgcggaggcgtatgcggccgtgctcgccacgttccggcgcatctggagcgcgacgcgcctgatcgaccggatgcgccgcaacctgtcgggccacgccgatccgcagcaaaccgaactgaagatcgacaaggcgctcacgcgcttcctgcagcgccgccggatgtcgccgctcctgatcttctcgaacctgaacatgcgttccccgagcttccgccacgcgctgcgcgtgacgatcgcggtggcggtcgggttctggctcggccggctgctgccgctcacgaacgcgtactggatcgtgatgacgaccatcatcatcctgaaacccggctactcgctcaccaagcagcgcaacgcgcagcggatcatcggcacgctgatcggctgcgcggcgagcatcgcgctgatctacacggtgaaggagccgcacctgctgatcgcgatcatgttcgggtcgatggtgatgagctacagcctgctgctgttcaactacgcggcgagcgtcgtgttcacgtcgtcgtacgtgctgctgatgttccacctgctcgcgccgggcagcatgcggatcatcggcgagcgcgcgatcgacaccgtggtcggctgcatgatcgcgatcgccgcgagccggctgttcccgtactgggaataccggctgatgggcaagcaggtggccgacatgctcaccgcgacccgcaagtatttcgaggccgtgtggcgggccgggcgcggcgtgtctccgccgcccgtgccggccgccgacggcgcggccgtcgtgccggtcgtcgccgcggccatcgaggcgccggccacgaccctcgacgacgactaccgctaccgcctcgcgcgcaaggacgtgcacatcgcgttcgcgaatctcgggcaggcgttccagcggatgatgatcgagccgaaggcgcaccagcgcttcgtgccggaactgaacgacctgctcgtgcagacccacgtgctcggcgcgcagatcacggcggccgcgccgctgatccgcacggcctgcgcagccgacggcaacatccttcacgacgatgcgctgcaccgcggcctcgccgccgtgctcgacaatctcgagaaggccgaggccggcgagccgccgcccgccgatcagctcgacgcgtcgaagcagatcacgcgcgacctcgacgcgatggtcgtgtccgcggagaaatccgatgcggtgggtgccgagctcacgcacgacctgaaggtactcgcacatcagtgcaagcagatgctcgcgtcgtcgctgctgatccgcaaggatgcgagcgtgatccgcctgcccgcctgaccgcggctttaccgccggtggccggcccgcgcatgccgcggatcggccaccggcgctcccgattcagcgatccccgaagcatgacccgagcgttccaggcggcccgcgccttccatgcgcgaccgccctgccccctgttgcgcccgtcgcgccagtcagggaatacccgattccggtcatccggcccggcttgttatcattcgttcacattcaagttgtatagacaacttgacgcaatcggaccggccccgctcgcccggtccgtcgcataacgatatcggagacacgatgaaaaacttgcagcgccacctgagcgcgcggcacatccgctttctcgcgctgggttcggcgatcggcacgggcctgttctacggttcggcgtccgcgatccagctcgcgggcccggccgtgatcctggcgtacatcctgggcggcgcggccgtctacatggtgatgcgcgcgctcggcgagatggccgtgcgcgaacccgtcgccggctcgttcggccactatgcgaccgagaatctcggcccgtttgccggcttcgtcaccggctggacctacacgctcgaaatggtgatcgtcgcgatcgccgacatcacggcgttcggcatctacatgggcttctggtttccgggtgtcccgcaatggatctgggtgctcggcgtcgtcgcgatcatctgcgggctgaacctgtgccacgtgaaggtgttcggcgaactcgagttctggctgtcgatcatcaaggtcggcgcgatcgtcgcgatgatcggcggcggcgtggcgatcctgctgaccggcatgcacttcggccatttggccgacgtgccgacgttcgcgaacctgtggaaccatggcggcttcctgccgaacggcgtcggcgggctgatcgcgtcgctgtcggtcgtgatcttcgcgtacggcgggatcgaggtgatcgggatgagcgccggcgaagccaaggatccggagcgcgtgattccgcgcgcgatcaacgcggtgcccgcgcgcatcctgctgttctacgtgctgacgatggtcgtgctgatgtcgatcagcccgtggacgggtgtcggcagcgacggcagcccgttcgtgcagatcttctccgcgctcggcgtgaagtcggccgcgacgatcctcaacctggtcgtgatcagcgcggcgatctccgcgatcaacagcgacatcttcggcgcgggccggatgatgttcgggatggcgcgccagggccaggcaccgcgcgtgctgatgacgacctcgcggcacggcgtgccgtgggtcacggtgctcgtgatggcggtcgcgctgctcgccggcgtgctgctcaactacctgatgccgaaggacgtgttcctgatggtcgcggcaatcgcgacgttcgcgaccgtgtgggtctggctgatgatcctgctgtcgcaggtcgcgatgcgccgccggctgtcgagcgccgaagtcgcggcgctgaagttcaaggtgccgttgtggccggtcgcgccggccctgacgatcgcgttcatgggcttcgtgatcgtgatgctcggctggttcgaggacacgcgtgtcgcgctgtatgtcggcgcggcgtggctcgcgctgctcgcggtcgtgttctacgcacggatccgcccgaaattcgcacctgcgtcacgttgacgcacggctgaccggcgtacgcggcgcgccggttccggcgcccgcttcgttcccggctccgcgcggcatccgccgcaccaacagccgggcactcgtcccttcacctcgacgccgcgtgcgcggcccgccgggccgcgcatcggcacgtcagtgcgacgcggcgctcgcggcctcggccggatgggcttcgtcgtacgcgtgcttctgcgaaatcgcgttgtacaggatcgtcccgatcacgagcagcacggccacgacgatcaggatgctcacgttgcggactgggttcttcttgcgctgatcgttcatggtcggggcgactccgtcaaattcatcgaagcgggcattctacgcgcttgcgcccgtcccgcgacgccccgtttccgctcccctttcccgtcctctgcctgcccgtcgttatctttcatttgataacggttcccatttcgatctagaatcccgagtctttcattttgtaatatttcgggtcgctcgagcggcaggcgcgcccggaacgctcccttcgtccacctgcccctccggagtcttcatgtcgaatccgcgcacccgcctgctgccgctcgccggcgccctcgccctgccgccgctgccttcgcgccgccggcccacgcggccgaggaagtcagcctgtacaccacccgcgaaccgaagctgatccagccgctcatcgaagcgttcacgaagcagagcggcgtcaaggtcaatacggtgttcgtgaaggacggcctgctcgagcgcgtgaaggcggaaggcgcgcagtcgccggccgacgtgctgatgacggtcgacgtcggcaacctgctcgatctcgtcgacggcgggctcacgcagccggtgcgctcgaagacgctcgacgacgcgattcccgcgaacctgcgcggcgcgaacggcgactggtacgcgctgtcgctgcgcgatcgcgtgctgtacgtcgagaaggacctgaaggtcgatgcgttccgctacgaggatctcgccgatccgaaatggaagggcaaggtctgcatccgctcgggccagcatccgtacaacacggcgctcgtcgcggcgatgatcgcgcacgacggcgaagccgcgaccgagaagtggctgcgcggcgtgaaggcgaacctcgcgcgcaaggcgacgggcggcgaccgcgacgtcgcacgcgacatcctcggcggcatctgcgacgtcggcctcgcgaatgcttactacgtcggccacatgaagaatgcggagcccggcagcgacgcacgcaagtggggcgatgcgatcaaggtcgtgcggccgacgttcgcgaacgcgaagagcggcggcacgcacgtcaacatcagcggcgcgacggtcgcgaagcacgcgccgcacaaggccaacgcggtgaagctgctcgaatacctcgtgtcgccggaagcgcaggcgctgtatgcgcaggcgaactacgaatacccggtgcgcgcgaacgtgaaactcgatccggtgatcgccggcttcggcacgctgaagatcgacccgctgccgctggcggacatcgcgaagcatcgcaagcaggcgagccagctcgtcgacaaggtcggttttgacaactgacgcaaccaccgccggcgcgcgccgcgtggcgtgccggccgcgcctgctgccgcgcgcgggcagcctgtggctgctcgcggcgctggcgatcgccgcggcggtcgcggcgccgctcgcggtgctcgtggccgccgcgttcgacgccgatctcgcgcactggcggcatctcgccgaattcgtgctgccgcaggcgctcgtcaatacgctgctgctgctcgcgggcgtcggcacgatcgtgtcgatcgtcggcaccggctgcgcgtggctcgtcaccgcatacgacttccccggccgccgcgtgctcacatgggcattgctgctgccgctcgcggtgcccacctacatcgtcgcgttcgcgtatctcgacctgctgcacccgatcggccccgtacagggcgcgatccgctggctgctcggcttcgacggcccgcgccagttccgcctgcccgacctgcgttcgctgcccggcgcgatcttcgtactcggtttcgtgctgtatccctatgtttacctgagcacgcgcgcaatgttcgtcacgcagtccgcgagcctgctcgaagccgcgcgcacgctcggcgcgggacgcatcgccacgttctggcgcgtcgtcgtgccgctcgcgcggcccgcgatcgcggtcggcgtgagcctcgcgctgctcgaaacgctgaacgatatcggcgcatcggaattcctcggcgtgcagacgctgacggtatccgtctacacgacatggatcacgcggtccgatcttgccggcgccgcacagatcgcgctcgcgatgctcgcgatcgtcgtgggcatgatcgtgctcgaacgctacgggcgccgccgccagcgctatgcgcacggccggcgcatgcggccgatcgcgccgcgccgcctgacgggcacggccgcatggggcgccgccgtgctcggctggctgcccgtgctgctcggcttcggcgcgccggccgcgtatctcgcggtcgagacggccaagcggctgcatctcgtcggcggcgtgtccgcgcaactgatgacggggctcgcgaacacgctgacgatcgccaccgccgccaccgtcgcgacactcgcgtgcgggctcgtcgtcgcatgggccgcgcgcgcaacgcgacagcgcaggcgcgggcccggcccgcgtgtgcgcgagaatcgcgagcctcggttatgcggtgcccggcaccgtgctcgcgatcggcctgctgatcccgttcgcggcggccgaccggctgttcggcgcggcactcggccgcgacgggctgctgctgatgggctcggcggccgcgctcgtgatcgcctacacggtgcgttttctcgcgatcccggccggcagcatcgaggccggcctcgcgcgcatcccgccgtcgctggaacaggcggcgcgctcgctcggcgaaacggccggcggcacgctgcgccgcgtgcacctgccgctgctgcggcccgcgctcaccacgagcgcactgctggtgttcgtcgacgccatgaaggaattgccggcgacgctgctgctgcgtccgctgaacttcgacacgctcgccacctggctgtatgccgaagcggcgcgcggcacctacgaggaaggcgcggtcgccgccctcgcgatcgtgctggccgggctcgtgcccgtgatcctgctcgcccgcacccgccacaagatcggagcctgacaccgtgaacctgctcgaactcgatgacctctgcctcgcctacgacacgccgcacggccgccgcacggtggtcgacggcctgagcctcgcgctgccgcgcggcgacatcggctgcctgctcggtgcgtcgggctgcggcaagaccaccgtgctgcgcgcgatcgccggcttcgaaccggtgcgcatggggcgcatcgtgctggacggcgcgcccgtcgcggcgccgtcgctcgacgtgccgcccgagcggcgccgcatcggcatgatgttccaggattacgcgctgtttccgcacctcagcgcggccgacaacgtcgcgttcggtttgcggcgcatgccgaagaccgaacggcgcatgcgtgtcgcggaaatgctcgatctcgtcggcctcgccgattccggcagcgcctatccgcacgagttgtcgggcggccagcagcaacgcgtcgcactcgcccgtgcactcgcgccgtcaccggaactgctgctgctcgacgagccgttctcgaatctcgacgtcgatacgcgcgagcggctcgcgttcgagctgcgcgacatcctgaaacgcacgggccacaccgcgatcctcgtcacgcacaaccaggcggaagcgttcgcgatcgccgaccggatcggcgtgatgaaggatggccggctcgcgcaatgggatacgccgtacgcactgcatcaccatccggccagcccgttcgtcgcggatttcgtgcgccgcgacgcactggccgacgagcgcgcacgcgcactggcgcgcggccgctgaacccgcgggcgcgctgcacgcccgcgccgtttcattgccgcgctacgccggctcggcaaggtcgcgcacgggcagcgcggtcgaatacttgatctgctccatcgcgaacgacgagctgacgtcgaacagcggcaccgtacgaatcagctgcttgtagacgcggtcgtaatcgtcgatgccggccaccacgacgcgcaacagatagtcggtctcgccgctcatccggtacacctcgaccacttccggcatgtcgcgcacggcctgcgtgaaccgctgcgcccattcctcggtgtgctggttcgtccggatcgcgacgaacacggtcgtgccgaccccaagcttgcgcggatcgcacagcgcaacctgcgcgcgaatcgcgccggtttccttgagccgctgcacgcgcttccagcacggcgtctgcgacaggttcacgcgctgtgccagttccgcgatcggcagcgtggcatccgcctgcaacagctccagcagcttgcgatcgatggcgtccatttctccagtccctcgtagatagaaatttattctattcatcctgcacaacggggaacaatatgaaaaccgcctcgccgcgtcgaccggtataaataccgatccggtacgcgcgcgggacgggtgagtccgccggcacgcggcacgctccagacgaaacaggcgatcccgcccgtcaaggtggaatcgcctggcgttcctgcacgtcgcggccggcccaatgcgcacgcgccggccggcgcgccgctcaatacgcgaccgtcgcgatctcgcgcacgaagctgccttgctcgagcgcatcgacgaacgcgaccgcgtagtcttccgtcgaaatcttgctgttgccctgcgcatccacgatcagcttgccgacgcccgtacggaacgtgcccgtgcgctcgcccggggcaatcatcgcggccggcgcgaagaacgtccagtcgagatcgtcgaccgtcttcaggtagccgagcgcatcgcggtgcgcgagcgcctgcgccttgtacgcttcaggaaagccttcgctgtcgaccagctgcttgcccggcgcgacttcgagcgaacccgcgccgcccaccaccacgagccgcttcaggcccgcctggcgggtgccggcgaccagcgctttcgcggccgcgacgaccttcgccgcatcgtcctgcttcgggccatacgcgctcgcgacgacgtcatgacccggcagcgcggccgcaatgctggccgcgtcgaacagatcggccgccttcgcggtgacgccgtcgccggccgcgccgggatggcgcgacagcgcggtcacgcgatgaccgcgtcgaacggcttccgcggcaatgcgcgagccgatcgtgccggtggcgccgaacagcgcgatattcagggtacgttgcgtcatgtcgattctccagtaagcaaaatatgtaacaaagtcaattacagataagaccgaaaaacggggcaaagccccgttgcgccggtcgccgcgcaaacgcgccgtccggcttcctgccctgccgccggttacccgccggcgcgcgcctcatgttgcgtgcgctgctccagatccagcacgtcggccgtgacgtcggccagcgtgcgcgtggcaagcgaggcttccatcgcgcgctgcgcgtcgccgatgtagtcggtcagcgcgccctggatgtgccgcccgacgagacacgcgggattcggcgcctcgcggtgcagcgcgaacagctgcgcatcgtcgaccgcccgatatacgtcgagcagcgtgatcgcgccgggctcacgcgccagcagcgcaccgccgcccgcgcccagctgcgacgtggtcagcccggcggccgccagcatcgacagcaagcggcggatcagcgccggattcgtgttcacgctgcccgcgatgatgtcggacgacagcggcacgccttcctgcatcgacagcaaggcaagcacgtggacggcaaacgcgaaccggctgctggtattcattcctcactcacttgacgacgccggcccatcctgcggccggcgacatgtgtaaccatcataattacattttgtggatcatgcaagcccgcgtcactctccgctcgcgggcttggcgcccgacgcattctgctggctccactgctgcagcttcttgccggcttcggcgatcttcgcgccggcttcggaagccgcatgcgcgacgaccgcggaagcagccgcgtcgatctgcgcctgcgcggcggaggcgaggccgctcgcggacagcggcggcacggccgacgccgcggacgcgatgccggccttcgcggcgttgatctgctggttgacggtgctcgccacctggtcgagcgccttggccgcattgttcgcggcatcggcggccgcgctcgcggccgtatcgggttgcgtgaccggcgcaccggacttctcgcagcccgcgagcaacagcagcgcaccggcggccacggccgccagtacggacccgggtacgcgacgcgcccgcgaagtcttcatcttcatcagcaatctccggccgcgcgtggcgcggcctcgtggttggaccgacgtcgatgataccgcctgttgaacagggccaatcacgtcccgccattaaaaatggctttcaatttcggactcgtctgattcaatcgcacacgcgaggactctaaagtgggcacgcttcaacccgcttcggacgtgcccccttttctcatggatttcctcgtcgactggctcatcgccctggccgcattgctcgccgccaccctgttcctgtgtctgcgcccgcggtcggcgcaccgcctggccgaatccgggcgcccgcgccgcgtcgcaaccgcgcgcctgctcgcgcaggccgtgatcggcttctggaccgccgcgctgatcgtcgcgcaaggcatcctcggtcccgacggcgacggccagtcgctcgcgggcttcgcggcgctcgcgttcgccgcgctcgggctgacaaccgtcgccgcctactggtcggcgtgcgcgctgcggctgcgccggccacccccgctgttcacgcgccactaatgcgccactaacgcgccggttggtgcgcccgccacgcaccatcgcgcaccacgccgcaccaactggctcgtcatgcgcaccagttccgtacgcgccgcaccacacacgtgcaacaggcatcgagctcggcccgcgccggttacgccctcttcccgtgcacgatccatcggaatgcctcaccacgcggcgcacgggcaccaactccatgcggcggctcaccaagttggctcgatatttgcattccttgcccgtttttgcgcaaggaagccacggcatggatggtctgaaatccggcgtcgactcactgttcctgttgatcggcgccgtcatggtgctcgcgatgcacgcgggctttgcttttctcgaactcggcacggtccgcaagaagaaccaggtcaacgcgctcgtgaagatcctggtcgacttctcggtgtcgacgctcgcgtatttcttcatcggctacacgatcgcgtacggcgtcgagttcttcgacgacatcggcacgctgtcccagcacaacggctacgcgctcgtgcgcttcttcttcctgctgaccttcgcggcggcgattcccgcgatcgtgtccggcggcatcgccgagcgcgcgaagttcaatccgcagctcgtcgcgacgctgatcatcgtcggcttcatctatccgttcttcgaagggatcgcgtggaacgaacgcttcggcgtgcaggcctggctcgcgcacgcgttcggcgcgccgttccacgatttcgcaggctccgtcgtcgtgcacgcgttcggcggctgggtcgcgctgccggccgtactgctgctcggcgcgcgccacggccgttacgcgaaggacggccggatcgccgcgcacccgccgtcgaacatcccgttcctcgcgctcggtgcgtgggtgctcgcggtcggctggttcggcttcaacgtgatgagcgcgcagacgctcgacaagatcagcggcctcgtcgccgtgaactcgctgatggcgatggtcggcggcacgctcgccgcgtggatggccggccgcaacgacccgggcttcacgtacaacgggccgctcgcgggcctcgtcgcggtatgcgcgggctccgacgtgatgcacccgatcggcgcactcgtcacgggcgcggccgccggcgcactgttcgtcgcgatgttcacctgcgtgcagaacaagtggcgcatcgacgacgtgctcggcgtgtggccgctgcacggcatgtgcggcgcgcttggcggcctcgcggccggcgtgttcggcctgcccgcgctcggcggcctcggcggcgtgtcgttcatgtcgcagctcgtcggcacgctcggcggcatcgcgatcgcgaccgcgggcggcacgctcgtgtacggtgcgctgaaggcgaccgtcgggctgcgcctcgaccgcgaagccgagttcgacggcgcggacctgtcgatccaccgcatctcggcgacgcccgagcgcgattgagcccctgacgaacgcccggcccgccattacgttttcaattcaaaaactttcatcgagcgtccttacacttccgtccagttttcaatttgccttcgcgacgcttgccgagcgcctgcttcgcgaaggccattcttccaacaactgaaactggactccacatgcccgcgttgcccaatgcttcccgtcgtcaggccctgaagatcctcgccggcgcgccgatgcttcccctttccggcctcgcgctgccggccctgctgacgggttgcggcggcgacgacaatccggcgtcgacgccggccccggtcgccgccgcgtacacgtcggcgacgttctcggcgatggccgcacccacgctcgacaacgcggccgcgatggccacgacgacggtcggctcgacgctgtcggtgtcgttctcggacggctcggcgcgcaacttcaagctcgcgtaccggccgttcttcgtgacgggcgacatggtgccggacggcaagggcggcacgacgctcgcgggcggctactacgacatcaacaaccagccgatcatcgaccgctcggttgccggcaaggagcgccagttctattccgactgcccggacggcagctcgctgctgacgctgaagaacgcgaacgtgcccggcgtgaaaggcaacacggtgttcgccgtcgtgcagttcgaatacacgacgcgcgaccaggcgagcgcatcgcagtacggccagctgccgtcgccgatcgcggtgctgacgctcgaccaggatccggccaacggcgcgctgaaggtcgtcaagtaccacaacgtcgacacatcgaagacgcacggcctgtggatcacgtgcggcgcgagcctgtcgccgtggggcacgcacctgtcgagcgaggagtacgagccggacgcgaccaaggccgcgaccgacgcgcagttcaaggcgttcagcaggaacacgttcggcgacgagacgaaggcgaacccctaccactacggccacctgcccgagatcaccgtgaatcccgacggcacgggcaccgtaaagaagcactattgcctcggccgcatctcgcacgagctgatccaggtgatgccggaccagcgcaccgtgatgatgggtgacgacgccaccaacggcggcctgttcatgttcgtcgccgacaaggccgccgacctgtcggccggcacgctgtacgtcgcgaagtggacgcagacctcgtcggccggcgccggcaccgcgacgctcacgtggatcaggatcggccacgcgacgagcggcgaaatcgaagcgctcgcgaacacgttgaaggcgtcggacatcatggacctggtgaccaccgacccgaacgatgcgagctacacgaagatccacttcggcggcaagttcaactggatgcgcgtgaagccggggatggaaaaggcggccgcgttcctcgagacgcaccgctatgcggcgctgctcggcggcagcatgggcttcacgaagctcgaaggcacgaccgtgaacgcgaaggacaagatcgtctacacggcgatgtcgcggatcgagacgtcgatggtcaagggcaatgcggcgtcgcgcgacgtcgcggtcgacaagaagatcgccgcgggcgccgtctatgcgctgaacctgaagggcagccagcgcgacacgacgggcagcgcgatcgacagcgaatgggtgccggtcgacatgggcgcgccggccgcgctcgtcggcgaggatctcgccgcggccgacgggctcggcaacctcgcgaacccggacaagatcgcgaacccggacaacctgaagttctccgaaaagctgcgcacgctcttcatcggcgaagactcgggcatgcacgtgaacaacttcctgtgggcgtacaacgtcgacacgaaatcgctggtgcgcgtgctgtcgtgcccggccggcgcggaatcgacgggcctgcacgcggtcgacgagatcaacggctggacgtacatcatgagcaacttccagcacgcgggcgactgggaatcgccgctgcacgacaaggtcaagccgacgctcgacccgctcgtgcgcgcgaacttcaaggaccgcttcggcgcgagcgtcggctacctgacggccgagcagaccagcatcaagctcgcgaaggcctgaccgggccgcgcgaggaggcgccgcccgccggccggggacgtcctgaccgggcgtccctaaccgggcgtccctttcttcatcaccgatcattcgtcggcgctccacgccgtttgatgcgcgatgcccagtgcaggcatcgcgcttttgcgcgtgcgaatcgcgtcaggcgcacgcgcgagcagacgccgcgcgggtgtaaacgggggtttcgacgatcggggataatacgggcctgacgcgtccgggcgggcgagcagaaaaacgggcaaaaaagcgccacggagaccgtggcgctaaaaagttctagccattccgagggccgtgctagaacctgagagactgcgcgaaacatcgttgccggttaaactcttgaaacgatgtttcgaaaacgtgagacattctttccgtttccgcccgacaagtcaagcggtatttgcaccggttcatgcactttctggcaacgctcatttgagcgttttcctaataaaccaagggtgaacccgtaaaatctcatccgatgaccggttcacccgcggaacatgcatcctttgacaatagtcctacaataccaacaaaattgaaatcgagtttcggaaatagagagaatccctcgtgtcgaccactgtaacccctccgcgtcgcgggaccgtgaatcctcgcccgacgaaatcaccgccctcgcccgcggcctcgccgtcctgcgtcgcatcgcggctgccgacgcgcccgtcagcaaccgcgagctgaccgaactgaccggcatcccgaagccgaccgtctcgcgcatcaccgcgacgctcgtcagcgccggcttcctgttccagttgcccgacagcgagcgcttcgtgctcaccgcgtcggtgctcgaactgagccacggcttcctgcgcaacttcgacatccgcgcgcgctcgcggccgttcatgatcgagctggccgaacgcacgtccctgtccgtgcacctcgcggtgcgcgaccggctcgacatggtcgcgatcgacgtgatccggccgcgctcggccgtgctcgtcacgcgtctcgagatcggctcgcggatggacatcgcacgcaccgcggtaggccgtgcgtatctcgccgcactcgaggacgacgaacgccgcctgctgctcgagtcgctgcgcaccacggccggcgacgactggccgcacgtgtccgcgcgcctgacccccgcactggacgacgcaatgcgcgacgggtgcgcgatcgcgatcggcgaatggcgcgagggcctgaatgcggtggcggccggtttcgtcggcccgtcggggcagcgctattcggtgaattgcggcggcgcgtcgcaccagtgcccgcccgaatggctgcacgaacacgtggtgcccgcgctgcacgaatgcatcgcgaaaatcacccgcgagatcggcggcgcaccggcccggcggcacgccgtgtaatcgattcgtcatcgtccaattgcgttctgtaacgaccgtaacccgttgaaagatagtccactggactgtaacggggacgggacgtaggatcatgcccatcgtcgcgccgccttcgcggtgcgcaccgctcttttcccgcgcaggccggcggggccccggaccgagccgggcgccccgtcccggcaccgcccgcccacgcgcagcccagcagtccgatttccggcacgccgcgccgtcttcctgacagaacacgatggataacgaacaaaagcccacgcctccttcgaacgacccgcgtctcccgccgcacggcgcccgcgccgcacgctgatggccggggcgctcgcggtcgtcgtcatcggcggcctgctgtggtggcacccgtggaaccgcacgccggcggccggcagtgccgcgacgggcgcgggtgcaagcgccgccggtggcggcggccaccgcggccgaggcggccccgccgcgatggcgaacattccgcagcccgtgcaggtcgcgaccgcgacgcagggcgaaatgccgatcgtgctgtccgcgctcggcaccgtcacgccgctcgcgaacgtgacggtcaagacgcagctgtcgggctacctgcagtcggtctcgttccaggaaggccagatcgtcaggaaaggcgacgtgctcgcgcagatcgacccgcgcccgtaccaggtgtcgctcgagaacgccgaaggcacgcacgcgcgcgactcggcgctgctcgcgacggcccgcctcgacctgaagcgctaccagacgctgctgtcgcaggattcgatcgcgtcgcagacggtcgatacgcaggcctcactcgtcaagcaatacgaaggcgcggtgaagaccgaccaggccgcgatcgattccgcgaagctgaacctcacgtatgcgcgcatcaccgcgccggtgtcgggccgcgtcggcctgcgccaggtcgaccccggcaactacgtgacgccgggcgatgccaacggcatcgtcgtgatcacgcagttgcagccgatgagcgtgatcttcacgacgtcggaagacaacctgccgcagatcctcaagcaggtgaacgcgggccagaagctgtcggtcaccgcgtacaaccgcaacaacacggtgccgctcgagacgggctcgctcgcgacgctcgacaaccagatcgacacgagcacgggcacggtcaagctgcgcgcgaacttcgataacaaggaaggcatgctgttcccgaatcagttcgtgaacacgcggctgctcgtcgacgtgatgcgcaacgcgacgatcgtgccgacctccgccgtgctgaccggctcgatcggccagttcgtctacgtcgtgaaacccgacaacacggtgacggtgcgcaaggtcacggtcgggccggtcgacggcgaacgcacgagcatcgtcagcggcgtgtcgctcggcgagcgcgtggtgaccgacggctccgaccgcctgcgcgaaggcgcgaagatctcgatcccggccgacaagccgaaaggcgcgtcgggcgcgcgcggcgccggtgcggcgtcgggtgcatcgggcgccggtggccatcgcggcggacaccggcacggcgcgtcgcaggcagcggcccccgcggcccagtaacgcgcgggccgctcgatgaatccatcccgccttttcattctccggccggtcggcaccgccctcctgatggcggcgatcatgctggccggtctcgtggcgctgcgcttcctgccgctcgccgcgctgccggaagtcgactatccgacgatccaggtccagaccttctacccgggcgcgagcccggaagtgatgacctcgtcggtcaccgcgccgctcgaacggcagttcgggcagatgccgtcgctgaaccagatgtcgtcgcagagttcggccggctcgtccgtgatcacgctgcagttctcgctcgacctgccgctcgacatcgccgaacaggaagtgcaggccgcgatcaacgcggccggcaacctgctgccgtccgacctccctgccccgccgatctatgcgaaggtcaacccggccgacgcgccggtgatcacgctcgcggtcacgtcgaagacgctgccgctcacgcaggtgcaggacctcgccgacacgcgcctcgcgatgaagatctcgcagatcgcgggcgtcggcctcgtcagcctgtcgggcggcaaccgcccggccgtgcggatccaggcgaacccgaccgcgctcgcgcagtacgggatgaacctcgacgacctgcgcacgacgatctcgaacctgaacgtgaacactccgaagggcaacttcgacggcccgacgcgcgcgtacacgatcaacgcgaacgaccagctcacgagcgccgatcaatacaacagcgcggtcgtcgcgtacaagggcggccgaccggtgatgctcaccgacgtcgcgacggtcgtcgccggctcggagaacaccaagctcggcgcgtgggtgaattcggagcccgcgatcatcctgaacgtgcagcgccagccgggcgcgaacgtgatccagacggtcgacgcgatcaaggcgcagttgccgaagctgcaggaaacgctgccggccgcgctcgacgtgcagatcgtcaccgaccgtacgacgatgatccgcgccgccgtgcgcgacgtgcagttcgaactgctggtcgcggtcgggctcgtcgtgctcgtgatgtacctgttcctcgcgaacatctacgcgacgatcatcccgagcctgtcggtgccgctgtcgctgatcggcacgctcgcggtgatgtacatggccggcttctcgctgaacaacctgtcgctgatggcgctcaccatcgcgaccggcttcgtcgtcgacgacgcgatcgtgatgatcgagaacatcgcgcgctacgtcgaggaaggcgaatcggggctcgaggccgcgctgaagggctcgaagcagatcggcttcacgatcatctcgctgacggtgtcgctgatcgcggtgctgatcccgctgctgttcatgggcgacgtggtcgggcgcctcttccatgaattcgcgatcacgctcgcggtgacgatcgtgatctcggcgatcgtgtcgctcacgctcgtgccgatgatgtgcgcgaagctgctgcgccattcgccgccgcccgagagccatcgcttcgaggcgcgcgtgcaccacgcgatcgactgggtgatcgcgctacgcggtcgcgctcgaatgggtgctgaaccgccagcgctcgacgctcgtcgtcgcgttgctgacgctcgcgctgacgggcctgctgtacgtctacgtgccgaagggtttcttcccgcgcaggacaccggcgtgatccaggcgatcacgcaggcgccgcagtcgatctcgtacggcgcgatggccgagcgccagcaggcgctcgcggccgagatcctgaaggatccgaacgtcgtgagcctcacgtcgttcatcggcgtcgacggcagcaacatcacgctgaacagcggccggatgctgatcaacctgaaggcacgcgacgagcgctccgaaacggccgcgcagatcatccgcgacctgcagcaccgcgtggcgaacatcaccgggatctcgctcttcatgcagtcggtgcaggatctgacgatcgactcgaccgtcagcccgacgcagtaccagttcatgctgacgagcccgaactcggaagagttcgcgacctgggtgccgaagctcgtcgcgcggctgcagcaggagccgtcgctcgccgacgtcgcgaccgacctgcagagcaacggccagtccgtctacatcgagatcgaccgcgcgagcgccgcgcgcttcggcatcacgccggcgaccgtcgacaacgcgctgtacgacgcgttcggccagcgcatcgtgtcgacgatcttcacgcagtcgaaccagtaccgcgtgattctcgagtccgagccgaaggagcagcactacgcgcaatcgctgaacgacatctacctgccgtcggcgggcggcggccaggtgccgctgtcgtcgatcgcgtcgttccacgaacggccgtcgccgctcctggtcgcgcacctgtcgcagttcccgtcgaccaccgtctcgttcaacctcgcggcgggcgcgtcgctcggcgaggcggtcaaggcgatcgaggccgccgagaaggacatcggactgcccgcgtcgttccagacgcgcttccagggcgcggcgctcgcgttccaggcatcgctgtcgaaccagctgttcctgatcctcgcggcggtcgtcacgatgtacatcgtgctcggcgtgctgtacgagagctacatccacccgatcacgatcctgtcgacgctgccgtcggccggcgtcggcgcgttgcttgcgctgatgatcaccgggcacgacctcgacatcatcgggatcatcggcatcgtgctgctgatcggtatcgtgaagaagaacgcgatcatgatgatcgacttcgcgctcgaggccgagcgcgtcgaaggcaagccgccgcgcgaggcgatctaccaggcgtgcctgctgcgcttccggccgatcctgatgacgacgctcgccgcgctgctcggcgcggtgccgctgatcgtcggcgccggcgcgggctccgagctgcgccagccgctcggggtcgcgatcgccggcggcctgatcgtgtcgcaggtgctgacgctgttcacgacgcccgtgatctacctcggcttcgactcgctcgcgcgccgcgtgcgcggctggttcgagcgccacggcccgcaagccggcacgcgcacggatgcgtaaatgacacgaccccacgctcacttcgttcgcgtgggggcgcagccccatctcccgaaaacgcatccgtcggaacacgcggcggcccagcgagtgccgacatgaacctgtcgcgccccttcatcacccgccccgtcgcgacgacgctgctcgcgatcggcgtcgcgctcgcgggcctgttcgcgttcgtcaagctgccggtgtcgccgctgccgcaggtcgacttccccaccatctcggtgcaggcgtcgctgcccggcgcgagccccgagaccgtcgcgaccagcgtgacgagcccgctggagcggcacctcggctcgatcgccgacgtctccgaaatgacgtcaacgagcacggtcggcaatgcccggatcatcctgcagttcggcctgaaccgcgacatcgacggcgccgcccgcgacgtgcaggccgcgatcaacgcggcgcgcgccgacctgcccgccgcgctgaagagcaacccgacctaccgcaaggtcaacccggccgactcgccgatcatggtcgtgtcgctgacgtcggagacctcgtcgcccgcgaagctgtacgacgccgcgtcgacggtgctgcagcagtcgctgtcgcagatcgacgggatcggccaggtgtcggtgagcggctccgcgaacccggccgtgcgcgtcgagctcgagccgcaggcgctgttccactacgggatcggcctcgaggacgtgcgcgcggcgctcgcctccgcgaacgccaacgcgccgaagggcgcgatcgagttcggcccgcagcgctaccagctctatacgaacgaccaggcgtccgaggcgtcgcaataccgcgacctcgtcgtcgcgtatcgcaacggcgcggccgtgcggctgtccgacctgtccgacgtcgtcgattcggtcgaggatctccgcaacctcggcctatcgaacggcaagcgcgcggtgctcgtgatcctctaccgctcgcccggcgcgaacatcatcgatacgatcgaccgcgtgcgcgcggcgctgccgcagctcaccgcgtcgctgccggccgacataacggtcacgcccgtactcgaccgctcgaccaccattcgcgcgtcgctgaaggacaccgagcacacgctgctgatcgcgatcagccttgtcgtgatggtcgtgttcctgttcctgcgcaactggcgcgcgacgctgatcccgagcgtcgcggtgccgatctcgatcgtcggcacgttcggcgcgatgtacctgctcggcttctcgatcgacaacctgtcgctgatggcgctgatcgtcgcgaccggcttcgtcgtcgacgatgcgatcgtcgtgctcgagaacatctcgcggcatatcgagaacggcaagtcgcgcatgcaggccgcgttcgacggcgcgcgcgaggtcggcttcacggtgctgtcgatgagcatctcgctcgtcgcggtgttcctgccgatcctgctgatgggcggcatcgtcgggcgcctgttccgcgagttcgcgctgacgctgtcgcttgcgatcgcggtatcgctcgcggtgtcgctcacggtgacaccgatgatgtgcgcgcgcctgctccccgagtcgcacgaaccgcagaacgaaggccgcttcgcgcgattcctggaacgctgtttcagccgcatgcagcgcggttacgaacgctcgctgtcgtgggcgctgcgccggccgctgctgatcctgctgacgctcgtcgcaacgatcgggctgaacgtctacctgtacatcgtcgtgccgaagggcttcttcccgcagcaggacaccgggctgatgatcggcggcatccaggccgaccagtcgacgtcgttccaggcgatgaagctgaagttctccgagatgatgcggatcgtgcagggcaacccgaacgtgaagagcgtcgcgggcttcaccggcggcacgcagaccaactcgggcttcatgttcgtcacgctgaaggatcgtaccgagcgcaagctgacggccgaccaggtgatccagcaactgcgcccgccgctggcggacgtcgcgggtgcgcgcacgttcctgcaggcggcacaggacatccgcgtcggcggccggcagagcaacgcgcagtaccagttcacgctgctcggcgattcgagcgccgacctgtacaagtggggccgatcctgaccgaggcgctgcagaagcgccccgagctgaccgacgtgaactcggaccagcagcaaggcggcctcgaggcgatggtgacgatcgaccgcgcgacggccgcgcggttcggcatcaagcccgcgcagatcgacaatacgctgtacgacgcattcggccagcgccaggtctcgacgatctacaacccgctgaaccagtaccacgtggtgatggaagtcgcgccgaaatactggcagagccccgagatgctgaaccaggtgtgggtcagcacgtcgggcggcagcgcgaacggctcgcagaccaccaacgcggcggccggcacctacgtcgcgacgtcggccggcacctcgagcgccggcacggccgcgcagagcgccgcggcgatcgcgtcggactccgcgcgcaaccaggcgctcaacgcgatcgcggcgagcggcaagtcgagcgcgtcgtcgggtgcgtcggtgtcgacgtcgaagtcgacgatgatcccgctgtcggcgatcgcgacgttcgggccgagcacgacaccgctgtcggtcaaccaccaggggctgttcgtcgcgacgacgatctcgttcaacctgccgcccggcgtgtcgttgtcgcaggcgacgcaggtgatctatcagacgatggcgcaggtcggcgtgccgccgacgatcgtcggcagcttccagggcaccgcgcaggcgttccagcagtcgctgaacgaccagccgatcctgatcctcgcggcgctgctggccgtctatatcgtgctcgggatcctgtacgagagctacatccacccgatcacgatcctgtcgacgctgccgtcggccggtgtcggtgcgctgctcgcgctgctgctgttcaagaccgagttcagcatcatcgcgctgatcggcgtgatcctgctgatcggtatcgtgaagaagaacgcgatcatgatggtcgacttcgcgatcgaccagacgcgccactacggcaaatcgtcgctcgacgcgatccacgaggcgtgcctgctgcgcttccgcccgatcatgatgacgacgatggccgcgctgttcggtgcgctgccgctcgcgttcggcagcggcgacggcgccgagctgcgcgcgccgctcgggatcgcgatcgccggcgggctgatcgtgtcgcaggtgctgacgctctatacgacgccggtcgtctacctgtacatggaccgtttccgcgtctgggccgagaagcggcgcaaccgccgcgggaattccggcgggccggccgtcgccgggagtgatggaagcggccgcccgccgggcggccgcttgccgcgcttgcgcatcggcagcgatcggctatcgtgagtccatgcccaccgcgggacccttcacggggacacgccatgaacgtccagctcaaccatacgatcgtctggtgtcgcgacaagcacgcgtcgagccgcttcctcaccgagcttctggaactgccgccgccgacgccgttcggcgcgatgctggtcgtgccgctcgacaacggcgtgtcgctcgatttctacgaacaggcaggggacatccggtcgcagcattacgcgttcctgctcgacgaagccggcttcgaccgcgtgctggcacgcatccgcgagcgcgggctgccgcactgggccgatcccgcgaagcggcaacccgatgacatctaccgccacaacggcggccgcggcgtgtatttcgacgatccggacggccacttcctcgaagtgatgacgcagccttatgcgctgaacggtcaggtcggctgaagggccggcattgcgccggccgttgttgcgctgcgagaaaccggcccgggtgccgacctgcttcggacggcacccggccggggacgttaccgggccactacccggctcggccattactcggccgttacctcagcccctacacgaccattactcggccgctgccgccgtcttgcgcggacgccgcgcgcgcggtgccgccttgcgggccggtttcttcggcttggcttcggcgggcgcctcgacagccgcctcggccggtgcggcagccaccccgccgccgacatcgccggccgccggctcgacgtgcgtcaccgcggcgggccacatgtcgccctgctccgggtcgcgatgcgggtcgcccgcatgcttgccgtgcgcgtgcttgtcgccgccgtgcttcgccgcgccatgcccggcgtcgtccggcctcccggccgactcacggcctgcgctcttcgcggcggcacccttcttcgcgccggtcttcttcgccgcgctcttgcgcgcacgcttgcggccatccttcgcgtcgccgtgcgcctcggctgcttccaccgcttcgaccgcttcggtcgtttctgccggcacgactgccgcgatttcggtggctccggccgattcggccatcgccgcgtcgtccgcgtcgacctgcaccgtttcatgcacgacggcttccgcccgctgctcgcgacgtcgcggctcgcggccggcccgcgccggctccgccgcgcgcgcgccgtggtggccgccgtggtgtgcagccccgccttcgccggcctgcacaacctgctccgcagccgccgactggcgtgcccgtgacacgaacgcgcccgacttgtcgtcacgccccacttcgagcaggccgcgcgcctgcgcctcgtcgagcaggttgccgaacgcgcggaatccgtagtacgactcgttgaaatccggcttgcgacgcttgatcgcgctcttcagcaccgacgcccagatcttgccgacatcgtcccgctccgacgcgagcgcgtcgaacgtctccacggccagcgcgatcgcctcggccttgcgcgcgtccaggtcgtgcttgcgcgacgccgccggctcgtccggccgcttcgcgccgccgttgcccgcgcgctgctgctgttcgcgcttcgcgagcgtgcgctgctgctcacgtaccagatcgtcgtagaagatgaattcgtcgcagttcgcgaccagcaggtccgacgtcgatttcttcacgccgacgccgatcaccttcttcgcgttctcgcgcagcttcgacaccagcggcgaaaatccgagtcgccgctgatgatcacgaacgtatcgacgtgcgacttcgtgtagcagaggtcgagcgcatccacgacaagccggatgtcggccgaattcttgcccgactggcgcacgtgcggaatctcgatcagctcgaagctcgcctcgtgcatcgacgccttgaagcccttgtagcgatcccagtcgcaataggccttcttcacgacgatgctgcccttcagcagcaggcgctccagcacgggcttgatgtcgaacttctcgtacttcgcgtcgcgcacgccgagcgcgacgttctcgaagtcgcagaacacggccatgctgacgttgtccagggtaatgccatgtgtactccaaccggtgggccgctgcgttgtatgacgtagcggcgaaaaatgcatcgcgcacatgatagccggtcggcgcgtcattcccgcatccgtgtgaacgaatggcggcaggaaggcccgtcgccggtacgccccttaatacacacccgccgcacgggcaaatcgacattacacttgagttatcggtcgtccgtccctatctgggaggacgacgcatcgagcaaggagcggtttcatgacgacgaaggtactgctgattggcgcgaccggccgaacgggccaggcctgcgcggatctgctgctcaagcagccggagttcgaggtcacggcgctcgtgcgccggcacggctatgcgctggcgggcgcgcgggtggtcgaggccgatctgacgaacgatttctcgcacgcattccagggcatcacgcacgtgatctacgcagccggctcggccgaatcggaaggcgcggccgaagaggagcaggtcgaccgcgacgcggtcgcccgtgcggccgaatacacgctggcctacaacgcgcagaagctcgtggtgatcagctcgctgtccgcgtaccggcccgaactcggcccggacgcgctgcgccactattcgcagatgaagcgcgaaggcgacgatcgcgtgatcgcgtcgggtgtcgactacgcgatcctgcgccccggcccgctcacggacgacccgggcgtcggcaagatcgcgctgaccgacgcgtggttcgacggcgccccgcccgtgtcacgccaggacgtcgcctgggccgcgatcgaggcgatcaagctcggcatctcgcgcaagatcgtcggcttcgtcggcggcagcgtgccgatcgagcaggccttgcgcgcctagcgccctcacacgcgccgccgcgcggcgcgcgccgatccgtaccggcggcccgcacgacgggccgcctcgacgcttgacgcacgcggtgccccggtgccgtggtgccccgtttactgcttcggatgcgcgtcggcccacgccttcaccgcggcaagcgtgttctcgacgtgcttgtcgggcgacatgctcgtgtattcgtagaggatcttcccttccggcgaaatcacgtaggacacgcggttcgcgcggtcgatcgccggcagtttcgcgtcgtattcccggatgatcttcgcgtccggatcggccgcgaccgggaacttgctccggcactcgctcaccgagaacttcgtcagcgtgtcgatcttgtcggcggatacgccgatcaccgtcgcgccgtaagccttgtaacggtcgactgcgtccgcgaacgcgtgcgcctcgatcgtgcagcccttcgtgaacgcagccgggtagaaatagagcacgaccggcccctgcttcagcgcgtccgcgagcgcgtaggtgtaggtcttgccgcccagcgacgcctgcgtcgtgaaatcgggcgccgcggcgcccggcttcagttccgcctgcgccatcagtgcatgaccggccaccagcgccgccacggcggcgcccagcaacagttttcgcttcatctgcatcctcatttcttataaagtcagcctcgatgtgggccacgcaggcgttcgcctgtcgaacacttgcgtgaccgattcggacctgcggcagcgccatccgcgcccggcccgttaaagattccgcacagtctgccgttattccttccggacaaccggttccagcccttcacgtcagcgagaaacatggaagccaacaggaaacagacgtcacgcaagggctcctggcgcagcgccttgcatacgctgcgccgcttcgcctggtcgggcggcgcgctgatgcccgcgcgcgccggcgccccgcgccgcgacgactccgtacgcaactggctggaacagacggttggcacggtggatttcctcgcccatgtcgaccgcgaactgcgttttctttacgtgtcggacgcgagcctgcgcttcatcggctaccaccgcgactacctgcacacgctgacgctgcgcgacctgatcgccgaacaggataccgcggcgctcgaaggcctgcttgcgcgcgccgcgcgttccggccaggtcgagaaggcgacgatgtgcatcgtgaaatcgctgacctacccgctcgacgtcgagatccgcgcgttcaagagccgccaccatggcgtcgacgggttcgcgatcgcggcgttcgacgtgtcgtcgtggcgcgcgctcgaggcgcgcctgacctacgagatgcaccacgacccgatgacgggcctcgacaacctgtccgcgctcgtgcccgcgctgatgcgcgcgcagcaggccgccgacgaaggcggcacctgcgcggcgctgctgctgctcgacctcgacgactaccagcggatcaaccgcgcgctcggctacgacgcgggcgacacgctgctgcgcgaaaccgcgcagcggctgaaggcgctcgtcacgcagaacgaacagctcgcgcgcgtcgcgagcgacaagttcgcggtcgtgctcagtgcgccggaccgcacgcaggcgagcaatgccgccgatgcactcgcacgccggctgcaggccgcggtgcgccagccctacgtgtaccaggggcagaccgtgcacctgtccgcgagcatcggcatcgcgctctaccctgacgagcgcgccgccccgcatcgcgcgcagcaccacagcccgctgctgcgccgtgccgatcacgcgctcgcgcaggcgaaggcgtcgggcggcaacgcgctcgcgttccacgcgcccgtcgacgacccggcggacgccgaacggctgaagctcgaagccgacctgtacgacggcgtgcgcaacggcgagttttcgctccatttccagccgatcacgcgcagccagtcgggcgcggtggtcggcgtcgaggcgctgatccgctggcgccatccggtgcacggcctcgtgccgccggcgaccttcattccgctcgccgaatcgatcggcctgatcaactatctcggcaactgggtgctcaaggccgcgtgcatgcagctcgtcgcgtgggaccgccagggctcgcgctgcagtacgtggcggtcaacgtgtcgccgcagcagttccgcgacccgcgcttcacgcaaagcgtgcgcgaggcgatcgcgctgacgggcatcgacccgcgccgcatcgtgctcgagatcaccgaaagcctgctgatgcacgatcccgcgcaggcgaagggactgctcgaggagctgaccgatctcggcatccgcttcgcgatcgacgatttcggtaccggttattcgagcctcgcgtatctgcagcgcttcccgctcgcgaagctgaagatcgatcgcagtttcgtcgagaacctgctgacctcgcgcaacgaccgcgcgatcgtgtcggccgtggtcggcctcgcgcagacgctcgatctcgagctcgtcgcggaaggcgtcgagaccgaggcgcagcgcgaattgctgacggaaatgggctgcaaccatatccagggctggctcgtctgccaggcgctgccgtccgaggagcttgcgcggcgcttcgaggcccatcagctgcacctgcacgccgccgcctgacgcgcggcgaaccggacagatccgtatgtcaatcaccgaacacctgccccgcaccgcgttgctcgacaagctgtgggcccggatgaacgaacggggcgatttcccgttgctgtcggaatcgctgcgcgcgacgatggccgcgatgaagaacgacgacctcgacttcaccgcgctcgtgcgcgtcgtgctgtcggacttcgcactcacgcagaaagtgctgcggctcgcgaattccgcgatgtacatggcgttcggcggcaacatcacgaccgtgacccgcgcactgatggtgctcggcatggatgccgtcggccacctggtcgtcgggctcaagctcgtcgaccatttccaccacagcacgccgcggcgcatcgacgcgaagctcgaactgaaccgcgcgctgctgtccggctgcgtcgcacgcaagctcaccgaacgcgtcgagctgcgcgcgggcgaggaagccgtcgtctgcacgctgatgcgccaggtcggcaagctgctcgtggtctgctatctcgacagcgaatgggaccggatccgccgccgcgcggccgaactgaacggcgacgaagcggccgcctgcatcgacgtgctcggcgtcggcttcgacgagatcgggctcgaggcggccgcgcgctggcggctgcccgacgtgatccgcgcggggatggccgaccacgaccacgtggtccgcaccgacgcgttcggcaacgacgaggacgacctcgatgcgggcgaggtgtccgacgacggcccgaccgagcgcgtccgctggctgcgcgagatcagccgctgctcgaccgacgtcgcgggtgcgctcgtgatgcccgcgagcccgcagcgcgacgcgcgcatcgcggcgctcgcgcagcactacggcgcggaactcggcatggaacccgacgcgctcgtcgagatcgccgaacggctcgcgcgcgaggaagcgagcgacaccatgatgcgcgagatcgtcgagctgcgcgcgaacgccgatgcgatcgcgcgcgcgcaggccgagcccgaggcatgcctcgaagccggcctcgcggacctgcgcgcgctgccgtccgagcacgtgctgacgccggtactcgcgctcgcgtcggaaagcctgctggccggcctcgcgttcacgcgcaccgtgatgttcgtgcgtcacgacgacggcatgttcgccgcgcgcctcggcttcggccccggcgtcgatacgatgctcgaccggctgcgcttcgacgagcgcttcgagccggacgtgtttcatctcgcgatctcgaactcggtcggcatcttcatcgagcaggcacgggagccgaagatgctcaagcgcctgcccgcgtggtatctcgacgcgttcgacgacacgcgcgcgttcgtgctgctgcccgtgcgcgtcggcacgacgaccgtcgcgctgctgtacggcgactgggccggcgcgcagcccgcgcgcaagatcacgcagcaggagatgggcgtgctcaacgagctcgcgcgcgaactgggccggttctttccggcgtgacgcggcgccggccgctccccgccgttttcggcggtttcacaccctgtttcgcatcctgtttcacaccgttccccgcctgcaaaagcaaaccggccgcatgagcggccggtttgtttgcatcgtgcgatcgaacgcaacgcttacttgagcgtcacgggcacgctgaagtacttcttcgcgaggttgtcgatcgtgccgtcggccttcaggtccttcagcgcctgatcgagcgcggtcttcagcgccgcgtcgttcttgcgcaggccgaaaccgacgcccgagccgaggatctcggcgtcgctcacggtaccgcccgcgaacgcgaagccctggccttgcggcttcgccaggaagcccttcgaaccggcttccgcgtcctggaacgtcgcgtcgagacggccggacttcaggtcggcgtaggccaggtcctgcgtctggtacggcacgacctcgacgcctgccggcgcccacttcttcttcgcgtacgcttcctggatcgtgccctgcagcacgccgacgcgcttgcccttcagcgattgcggggtcggcagcaggccgctgccctgcttcgcgatcagctggttcggaatcgtgtagatcggatcggtgaacgcgatcgcatgcttgcgctggtcggtgatcgtcatgtccgagttgatcgcgtcgaacttgcgcgcctgcagcgccgggatcaggccgtcgaagtcgttctcgacccacacgcacttcgtcttcagcttcgcgcacaccgcgttgccgatgtcgatgtcgaagccggtcagcttgccgtcgggcgtcttgtattcgaacggcgcgtacgaggcttcgacgccgaaacggatctccttcagatccgcggcaaccgcgctgcctgccgccaccgccgatgccgccaccaccgcatgcgcggccactttacgccaatccaacttcatcaggtgctctcctcgatactcgaatgttccggaactacgggcgcttgcatcattgcagggtcggatgaccacgacaatcgcgatgccacgccgtgatgcggcgcaacagccgcaaggccgcgattgtaccaatccgcgcggcccgatatggcaaagcgggcgacgtcgcgcgatgctgcgctgcgtgcgcggcaccggtcaggcgatccgccgaacttgcaaaacggtgtcgcaaatacgcaagccggggcgcgtgccgtcggccccggcatgcgggcgacgacgacgggataccggcaggttgcgggtcaggcgcgggccgcgtgccgtcgcggcagcgcaatcagcagccggtcgggacatgcgctcaaacgagcgccgcgatcgtctcgcgcgtcgtgtcgatgacgagcaggcccgcgcgcaggcccggcttcacggtcgggttcggaaagacgatccgctcctcgtcgtgtgtcaccgtgtagcggtagtcgccgtcctgcgcgagcaccgtgccgcgtgcaaacgcggtgaagttcgcgacgtcggccgcgacgaacagctccagcgcgtcgctctgcttcgtgatctggtcgatcaccgtgaacacgcgcggcagcggcggaggatcgccctgcgcgaccgcatctcccgccgcgcccgacacgagcttgcgcaccgcgcgatcggccggtgcgaagcgcgtcaggtcgttctggccgaacgggcgcaccttgccgagttccagcgtgcacgcgagcgcgccgcagcgctcggccgtgaaatgcgaatacgtattgcccttcgcggtatgcagcagcacggccgcgatccgtgcgtcgccgagccattcgaacatcgtgcgcgtcggcggcgtgcccgtgtgcggcagcagtgcgaactgctcgaacaccgacgcgcggatcgccgtgtgcatgtcgatgtgccagcgcgcggcgccggccggcgcgtccgcgaagaacgctgcggcggctgcttccagctgcgcggcgcgcggtgcttcgcggctggcgggcacctgcgcatgacggccgctgaacaggcggttcaggtcgtcgtcgagataacgctcgccggcacgcatcgccggcacgttgccgagcacgacgagcagccggcacgcgagcggcagcgcgcccgatgcgagatcgcgcacgagcatcgacagcagctcgatcggcgccgtctcgtcgccgtgcacaccggccgacacgagcacgctcgggcgcgccgcgccggcggccgcgaccggttcgagcgcgagcaggccgtcgccgcgccatgaccagcgcacggcgccggccgcgcaggtgccgtccgtcgcggacggcgcgctgccggccagcgtgaacgcgaggaagtcgtcgagcagcgcgttggccggcatccgtgcctcagcgctggaagtcatacagcgaaccgacgcgcagaatctgcgtgagctcgtcgagcgccgtgcgcgattcgtcgagcagcgccggatcggcgaggtcttccggtgcgaggcgatcgcgatagtgccggtcgatccacgtgtcgagcgacgtgaacagcgtgtcgttgatccacacgttcgacgtgacggccgcgcgttccgcgtcgttcagcacgacacgcaggcgcaggcaggcggggccgccgccgttcttcatgctttcgcgcaggtcgaacacgagcacgtcgtgaatcgggccgttgccggccgcgagttcgtcgagataagccgcgacgttcccgttctcgcggcattcctgcggcacgacgagcacctgcgagccgtccgcgcgcgacagcagctggctgttgaacagatacgacgtgaccgcgtcgttcacgctcacggccgcctcgggcacctcgatcacgttcaggcgcgcgccgcgtgcgtcgagcgcggcggtcagcgtgtcgtagatcgcctgcttgttgacgaacgcgcgctcgtgcgtgaacagcgtgtcgcggttgccgaccgagatcacgtcgttgtggaacacgcccgcgtcgatcacgtccgggtcctgctgcgcatacaccgtcgcctcttcggcgagcccgtggcgatgcgcgaccgcgcggctcgcctcgaacgtctggcgtgccgggaagcgcttcggctcggggccgcggcgatattccgcgcggccgtacacgaagaactcgatgcccggcttgccgtattcggcacagaagcgcgtgtggttcgccgcgccttcgtcgccgagtgccggcgtgccggtcagcgcctcgtgcaccgcgaagtgcgcgggatcggcgaacagcgtcgacagcgtgcggcgcgtcgcttcgtgttcgatcgcgcgatgcagcttgctgcacaggttcgccggcgtgaagtgcacgcggccgtcgctcgtgtcggccgacgggctgacggtggccgcgttcgcggtccacatcgccgatgccgagctcgcggcggcgagcagttcgggcgcctgcttcgcggccttcgcgatcacgtccgcgtccttgcccgagaagccgagctcgcgcaacaggcgcagcgacggccgctcctgcggcggcagcacgccttgcgcgaagccgagatccgcgagctgcttcatcttgcgcagcccctgcttcgcggcggccttcggattcgcggccgacttctcgttgttgagcgacgccacgttgccgaacgacaggccggcgtagttgtgggtcgggccgacgagcccgtcgaaattggcttcttgtgcgttcatcgtcgttccctcgatcagaagtgcaggcccggcgacaggctcgcgggcaaagtcagttgcgtgctttccaccgacgccatcggatacgcgcaatagtcggccgcgtagtacgcgctcgggcgatggttgcccgagcggccggtgccgccgaacggcgcggcggacgatgcgccgttggtcggacggttccagttgacgatccccgcacggatcgtgcggcggaagtggtcccatgcgttcgcgtcgtcggccagcaggccggcggacaggccgaacgccgtgtcgttcgcgcgctcgatcgcttcgtcgaacgtcgcgtagcggacgatctgcgcgagcgggccgaagtgttcttcgtcgggcaggttcgccacgcccgtcacgtcgacgatcgccgcgttcacgaagcccaggcgcggatcgcgctgcgtcatcgagatgatcggcttcgcgccctgctcgatcaggcgcgactgcgcgtcgaccagcttcgcggccgcgcgcgccgagatcaccgcgcccatgaacggctgcggatcggcgtcgaacacgtcggccgtgatcttcgacgtgacgtcggcgaagcgtgcgaggaagcggtcgccaagcgcgccctgcggcacgaagatgcggcgcgcgcacgtgcagcgctggcccgccgacaggaacgccgactggatcgtgtgatggacggccgcgtcgatgtcctcgacttcaccgatcacgagcggattgttgccgcccatctcgagcgcgagcacgatttccggacggccgccgaactggcggtgcagcagcgtgccggtatccgagctgccggtgaagaacagcccgtcgatctgccggtgattcgcgagcgcgatgcccgtgtccttctcgccctgcacgaggttcagcacgccggccggcagcccggcttcctgccacacctcgaccgtcgcgcgcgcgacgcccggcgcgagctccgaaggcttgaacacgaccgcattgccggcgatcagcgcgggcacgatatggccgttcggcaagtggccggggaagttgtacgggccgaacaccgcgacgacaccgtgcgggcggtggcgcagcaccgcgacgccgtcggccatgtcctggcgcttctcgccggtgcgttcctggtacgcctggatcgagataccgaccttcgcggccatcgacgcgacttcggtgcgcgcttcccacagcggcttgcccgtctcgcggccgatcgcggtcgcgatcgcttccttgcgttcattgagcaatgcggcgaaacgcttgacgatcgcgcagcgcgattcgaagtcgagcgccgaccagccggcgaatgcgcgacgcgcgctcgcgaccgcacggtcgacgtcggccgccgacgcgctttcgccctgccatgcgatctcgtcggtgcccgggttgcgcgaagcgaacacggggcccgagcctgcgacccaggcgccgtcgatgaagagttccgtcatgattcgtttatccctgtttgactttgagcggcagcacgcggaccggatcgccggccttcacgtcgagcgcggcggcatcgtcggccgacagcacgaacgagccgttcgcgaccacgcccggcgcgacgccgacgcggaaatcggtgagcgacgtgttcgacacgagtgacgtcgacggatggtcgccctgcgcgtcgggcacgccgatcgcgaccggcacgacgacgctctcgcgcaccgtgcgcaggtcgttcacgtggcattcgagcaccgggcccgcgtcgaagatgtcgacgtggttctggtagcgcagcccttccgcctcgagcatcttgcgggccggcagcgtgtcgcggtgcgtgaggccaaccgcgtcctgcgcgtcctgcggcagcaggtcgacgtacaccgggtagcgcggcatcagttccgcgagaaacgacttgcggccgtgcgagctgagatagtcggccgcgttgaaatcgatctggtagaagtgcgaaccgacggcgcgccagaacggcgacgtgccgtcttcgtcgaagtggccgcgcagttccgcgcagatgcgttccgggaagcgttcgcggaactgcgcgatgaacatgaagcgcgagcgcgacagcaggccgcccacgccgcccgtgcgataacgcgggctcaggaacagcgagcacacttccgcgtagccggtcaggtcgtgcgagatgttcagcgcgtgcatgcgcgtccacactccgagctcctggctcgcatgcacgaccgtgctcacgcggtagttgtagaacggctgttcgaggccgacctgcgactcgatcccgcacacgcccgcgatgtcgcccgtcttcgattcttccatcacgaagaagtagccggcttcgcctgcggcggcctcgccctcgagcgtgcggcgcgtgcgctcgatgcgcgcggcgagcgcgtcgcggtcgggcttgaacgtggtcaggcccggcccggtttccttcgcgagcgacacgagcgcgtcgacgtcgcccgtttgtacgacccgaacgacgatcatgctgcgtctccttcaaatcttcatcgtcgcggcggtgcagtggcacgcagcgcacgacatcgccatccttcacatcgagcgccgcgcgcacgtcgccggcgagcggtgcgtcagccgcatcgcccggcaggtcggccagcacgcagcggaacgattcgccgctgcccgtcgacaccatgtacgcgacgtcgccctgctggtgcgcggcctcgcgcacgacgcgctccgaaccgtgcttcacgcacgcagtgcggtcgacctgcgcggtgagcaccgggcccgcgtcgaagatgtcgacgaagcggtcgggctcgaagccttcctcgagatggatgtcgtaggcgagcagtgccgattcgttcggctcgccgagcacgcgctgcgcggcttccggcagcagcggcacgtagagcggatacgccggcatcacttccgcgatgaaggtgcggctgcggccgcccgacgcgatgtcgacgtcggtgaagttgcggccgaagaacttgcggcccaccgcttcccagaacggcgacgcgcccgtgtcgtcgctcacgccgagcagcagcgtgaacacttccggcgtgaagcggcggcggttcgcggcgatgtacatcatccgggcgcgcgagatcaggtgcgcggccgcgtcgccgcgcagcgacggatcgacgtagaagcccgcgagccggctcttgccggtcagctcgtgcgacatcgtgagcgcgtggatcttgcggttcacgtgcagctcgcgcgacgcgtggatcaaggcgtcgttgcggaacgcgtagaacggttccgagtaaccggccgcggccacgatgctcgccgtgccgagcagcttgcccgtcgacgaatcctcgagcacgaagagatagaactcctcgccggcgaagtcgacgtccgcgcgaaacgaatcctccgagagcgccacgcgcgcttcgagcgccgcgcggtcgtgcggcagcgagtgcaggaccggttgcgcggtgcgcgccatgtgcgcgagcgcatcgagatccgtgagtttgccggggcgaacaaatagcatcgtcgttcctgtctgcgatgggtgcgccgatcagcgcgcggtggcttcctgggcggcgagcacttgttcgacggccttctcgaagcgcttgacgccttcgtcgagcaggtcgaacgggatcaccagcgacgggacgaagcgcagcacgttcgggccggcgatcagcatgatcaggccgttttctgctgccgcggtgacgaagtccttcgcgcggccatcgaatgcggcagtgagttccgcgccgacgagcaggcccttgccgcgcacgtccttgaagatgccgaagcgtgcgttgatgcgctcgagcgcgcccttcaggcgcacgctgcgttcgcgcacgccttcgagcagtgccgggtcgccgatcagttcgacgaccttgtcggcgatcgccgatgcgagcgggttgccgccgtacgtcgtgccgtgcacgccgaccttgaagtgcgcggccagttcgttggtcgtcagcatcgcgccgatcgggaagccgttgccgagcgccttggcggtcgtgaggatgtccggcgtgacgcccgtgtccatgtacgcgtagaactggcccgtgcggccgacgcccgtttgcacttcgtcgaagatcagcagcgcgtcgttcgcgtcacaggcttcgcgcagtgccttcaggaatgccggatcggccgggatcacgccgccttcgccttgcacgggctcgacgatcactgcgcaggtttgcgggccgatcgcggccttcgcggcttcgatgtcgttgtacggcagatgcgtgatgccggccggcacggggccgaagccttccgagtacttcggctggccgccgacgctgaccgtgaagaacgtgcggccgtggaacgactgcacgaacgagatgatttccaccttgtcggcgccgtggcggtcgaacgcgacgcggcgcgcgagtttcagggcggcttcgttcgcttccgcgcccgagttcgcgaagaacgcgcggtcggcgaaggtcagcgattcgaggcgcttggcgaggcgcagcaccggctcgttcgtgtagccgttgccgatgtgccagagcttgcggctttgttcgtccaggactttcagcagttccgggtggccgtggccgagcgacgtcaccgcgatgccgcacgcgaaatcgatgtactcgcggccggccgtgtcccacacgcgggagccctctgcgcgatccggcacgaacggcgcgggagaaaataccggcaccatcacttcatcgaatgtctggcgggtcacggtcgaggtcgtcatggtcgttcctttcggtttcgtaagagggttcaacaggatcaagtttaggtaagggtgacgcaagcgtcttgcggaattgcgacgggttctatcggaagcggataatgcgctttattttgccctctctccgggcgggggcgtggaagcttgtctggttttggggcttgtgggtcgtgtgcttgcctttgtcgtgaagcacctgtgagctcgtcggtctattagcgtcgcctgcgcggcggcggttacttttctttgtcttgccaaagaaaagtaaccaaagaaaggcgctgggaaaacgcatgacttcccggtgccatggttcccggagtggacaccgcctaagtgtccgcgccagtctggaacacggagtggttcgagcaatggttctgacaccactccctacccaacagagcggtataccacccgccagctccgccctcgcttcgctcggccgacaggtacacccctccagtagcgcataaggtcaatcctcccggcaatcgcacgcgcaagtaccccgaactcagcaaatcaagggcacaccctcattcacaaggaaaaagggacgcagcgacccatcacgaaaacacacggccaccgacggtatcaaacacgtaccgatgacaagcagtccgacaggtacgaatggtgtaagcaaagagagtgtccgatctgctgatcagcgcaggcagaagcagcgagggcatgaaacgcgacgggaggtaccgtgcagccgagcgaagcgaggatggagctagcggacggtataccgctctgttgggtagggagtggcgtcagaaccattgctcgaaccactccgcgttcctgactggcgcggacacttaggtgcgaaccactctgacgaccatggcaccgggaagtcatgcgttttcacagcgcctttcttttggttacttttctttggcaagacaaagaaaagtaaccgccgcgcgcaggggcgacgctaatagaccgacaagctcacaggtgctccacgacaaaagcaagcacactgcaaaaacctgaaatcaatccttcccacgctcgacgagcgccccaccccgcggttcactgcccccgccggtctgcttctcgagccacgctcgccgatcctcccgaggcgtgaccccgaacctttcgcggtacgcgttggaaaaatgcgcagcagaagaaaacccacaggcaaggctaacctgcacaaccgacttgctggtccgctgcaactgagtccgggccttgagcaaccggaggttgaggtaatacttcgagggcatcgccccgagatactgtcgaaagagccgctcgagctgccggcgtgaaacgccgacgagttcggcgatctcgtcggtcgtcaacggatcctcgacattggcttccatgagcagcaacgcatcgttcaaccgaggatgccgctcgcccggcgcagtcacaaaggaatccgctgccgctcttcgccgctccgcaaagtcccgaccccgagtgcatcggcaatccgctccgcgaggtccgccccatgttcccggccaatcatggccagcatgaaatccacggtagcctgcccacccgcgcacgtcgcgcggtcccgatcgatctcgaagatctgctgcgtgacgatcgaccgctcgaactgttcggcgaactgctgatacgtctcccagttcacgctcacccggtacccggaaagctgcccggccatcgccagccaccacacgccgtgatgaattccggtcacgagcggcgtgcgctgcccgacccgcgcgagactcgcgagaaacaaccgatagtcggcaaactgctgaaaccgctccgacacgacgatgacccagtcgcatgcgatcgcgtcgttgaacgccgcatcggcatgccactgcgcaccgccggcaagcggcacgggccgcccgtcccacgaacacacctgccagcgatacagcagccgcccgtcgatctcgttcgcgaggttcagcgcatcgacgatcggacccacgcccgacatcgacacgggcggcaatgcaacgatcgccacctgcatcgtgcgggtggcgcctgcgggacgagacaccggtaccacgtatgaaacccgccctgtcgcgttacttgagactgcccgacaggaactgcttcagccgctcgctctgcgggcgtaccagcacttccttcggatcgccctcttcctcggtccgcccctgatgcaggaacatcacatgattcgacacgttgcgcgcgaaacccatctcgtgcgtgacgacgatcatcgtgcggccttcctcggcgagcttctgcatcaccttcagcacttcgcccaccagttccgggtcgagcgccgacgtcggctcgtcgaacagcatcacgtccggatgcatcgccagcgcgcgcgcaatcgccacgcgctgctgctggccaccggaaagatgcgacggatactgcttctcgacgcgcggcggcaagccgaccttctccaggtactcgcgcgcacgctcctcggcttccttcttcgaaatgccgagcacgtgcaccggcgcttccatcacgttctcgagcacgttcatgtgcgcccagaggttgaagtgctggaacaccatcgcgagcttcgtgcggatgcgctgaagctgcttgtgatcggcgacttcgagcgcaccggcgcggtcggtcttcgtgcgcacggtctcgccgtcgacgacgatctgccccgcattcggccgctcgagaaaattgatgcagcgcaggaacgtgctcttgcccgaaccgctcgcgccgatgatgctgatgacgtcgccggccttcgcgttcagcgatacgcccttgagcacctcgttgtcgccgtagcgcttgtgaatgtcgaccgcggcaagcttggtggaagcggacgcgctcgtttgagtgatctcggccaactggctctcctcgaagtgaatcaatgacgggcggccgcgagatacgcgagccagtggcgctccgcgcggcgaaacgccgcgacgagtgcgaacgataccgcaagatagatcagcgcggcgattccgaacgactggaacgccatgtaggtcgcggaattcgcatcgcgtgcgaccttcaggatgtccggcacggtcgccgtgaacgcgacggtggtcgcgtgcagcatcaggatcacctcgttgctgtacagcggcagcgcgcggcgcagcgccgacggcaggatcacgcggcggtacatcgtgaacggcgacatcccgtatgcccgcgccgcctcgacctcgccgtgcggaatcgcacggatcgcacccgcgaagatctcggtcgtgtacgcgcaggtgttcagcgcgaacgcgagaatcgcgcaattgaagccgctgcggaagaacgcgtcgagcagcgagtgcgaccgcacgaactcgaggctgtacatgcccgtgtacagcagcagcaactgcacgtagagcggcgtgccgcggaacacgtacgtgtagaaccgcaccggcgtcgacacccacttcttcttcgacacgcgcgcgaccgcgagcggcaccgcgcacacgaagccgagcgaaatcgacgcgacgagcagccacagcgtcaccgcgaggccggagaggcgctggccgtcccagtaaaggaacgcctggccgaattcctggaggatctcgatcatagttctgcgtgccgcacgcccatggaataacgcttctcgagctggatcagcacgaggttggaaacggtcgtgatcgcgagatagatcagcgccgcgacgaggatgaagaagaacatgttgaacgtgctcttgccggcgtcctgcgcggccttcacgacgtccgcgagaccgatgatcgacaccagcgcggtggccttcacgagcacctgccaattgttgccgatgcccggcagcgcaaaacgcatcatctgcggaaacatgatccgcacgaacacgcgcatcccgctcatcccgtaagccgcaccggcttcgagctggccgcgcggcaccgacaggaacgcgccgcggaacgtctcggtgaagtacgcgccatagatgaagccgagcgtgagcacgccggccacgaacgggtcgatgtcgatctggtcccagccgacgaagtcggtgaactggttcagccagatctggatgctgtagaacagcagcagcatcaggacgagatcgggcaccgagcggatcagcgtcgtataaccggtcgcgatcgctcgcagcacccggttgtgcgacagcttcgccaccgcgccgatcagccccagcgccaccgcagtggcgagcgacagcaccgacagctcgatggtctgcacggtgccggcccagaggacaggaccaaagccgtaaaggaacacgcgcgtctccagagttggaatggatgccgacgcgtctgcctgtcccgcgccgggctgacgcggatagtcgcaagcgaaattgattgcctcaaatcacccggcacgcgattgctgcgtcgcaacaatccgttccatcattttccaccgcgacctacaccgctgtttcaaaggaaaaagccgctccctgacaaccggataacggccggggaagcggacttttgcaattttccggtcgctttttcgatatagcgccgaagaagacggtcgggcttaccgccccttcaggatgtcggaacgcgaagtcgtgtagacgagcccgtccgggccgaaatggacgttgaagaacgcgtcggtgttgacgccgtcctcgagccagcgccagctccagaccgtctcgggcttgagcggatactgcgcgatgtcgccgggcttgccgagcaggcgccgcacctcgtcctcgttcatccccgggcgcactttcgcgaaattctcggcggtcagcacctgcgtcgcgcccgtgtagcggccgttcgcatcgaggtcgacgaaccacgtctggttgcccatcgggccgcgcgggtattcgagacgcttcgagccgtcggtgaagtcgcgctcggtctcgggcttgcccatcgtgccgcgcacgtcggcctcggtcgattcgccggccttcagccccttcagcagcagcggcgcgggcttgatcgcgttgaagaagtccctgatacgttgcacgtcgaggttgccttgcttgtcgtcgcagccggtcagcgccagcgcgccggccagcatcgtcacgggagcagccggaaacggaaattcatcggaagaaatgcgcgtcgagaaaacacgcggcaaggatacccgcgcgacgccaaagcgcgagacgggcgcgcggcccgtctcgtggtcaatgcatcgtttcggtttcggattcggccacgcggcccgtcgcgtgcggcgcgcgcggcacggccggcggcgcaccgatgctgcggcgcgtgcgcacgagttcggcaagctgccacgaaccgagcgcgaggcagccgaacagcacctcgcggccacgcttgaccagcgcgagcgacagcgccgtctcgcggtcgacgccgaacatctgcgcgagcagcacgacggtcgcctcctgcacgccgaggccgcccggcaccatgaacgccgcatggcgcacggcctgcgtcatcgcctcgatcgcgatcgcgccgccgatcgacaccggatggccgagcagcgcgagcgcccagtagatctcgagcgcgccgagcacgtagccggccagctgccagaagaacgcgctgaacaacaggcccgtgcgcgacatcagcgcatcgatgtcggcatcgaggcgcttgccgtcgacgccctgcagcagccggtgcgaatcgccgagcaggcggcccgcgaaacgctcgatcgcgtggaagatcccgccgcggcgcatcagcacgacgccgagcaccggcagcggcagcgtcaacagcagcgcgaggccgatcgtgccgccgcccatgttgtccgtcgtcgcgagcagcagcacgaggccgagcgcggcaaacgcatactggacgacgatcgtcacgagcacctcgacgatcaccgacgccgtcacgcggctcgcgtcgggcacctgccagcgcgcgagccggatgccgaccagctcgccgccgatcccgaccaccggcagcagccggttcacggcttcgcgcacggtcgcgatccaccagaggaacggcagcgacgagcgcttgtcgagcagcaggtgccacgcgtaggcgtcgagcagcagcggcagcgcgtggaacggtacgagccacagcagcgcgtaaccggcgcgcgcgagcatctgcgacacgtcgccgatgccttcgtgcagccccagcgccagcaggatgccgatgccgagcggccagccgagccatttgatccacttgatcatgacggctgcgctcccggtgcgcgcgacgcctgcccgccgcgacgcgccgcaggctggccgaacacgtcggcaaaaccgccggtcgcgacgcccgcggccttcagtgcggccgcgacgcgcggcgacagcagcgcatcgagttcgtccaccggacggtagccggccatcgtcggcgtgatcgggccgtcgccggcctcggccggatggcagtagatctcgccgacgcccggcggcagcttggccagcgcgtcgagcagcacggcctcgtccatcgcgcccgtatgctcgatcccgaccacgtagtcgttgtgcgcgagccccgcccggtcgagccgcgcgcacgagcgcgatccacggcttgagcagcgcgggcgcgctcgtctcgtacggcagccgcaccgcgcgcagcccgtagtcgcggccgatctcgatgatcagcgacagcacggtcggatgcaggtggaaatgcttgtgcgcgttcacgtgatcgagcggcaggccgctcgccgcgaacgcgtcgaactgcgcgcgaatctcgcggcgcagctgcgcccgcacgtgcggcaggaagaagaagcggcagccgtccttcgccatcgcgtcgccgaaccgcccgtcggggccgacgagcgcgggaatctcatgcgcgggcagcgtggccggcccgtccgcgagcacgagatgcaggccgaccgcgagcgacggcagccgccgcgcgcgctcgatcgcatccggtgcggcgctcgcgccgaccatcaggctcgcggcgttcagcacgccgtcgcggtgcgcgcgttcgactgccgcgttgacgcgcgggtgcagcccgaagtcgtccgcggtgaagatcaacgcccgcgccgcccgctgcgtcgccacggattacgcctcgtgcgcgcgcaggaagcggaagaactcgacgccttcgcgcaggcggcgtttcatcatgtcccagctcgtcagcatctcgcgcacgatctcccagatcttcgacggacggaagtagaactggcgatagaactgctcgaggtggtgatagatctcgtcgcgcgacaagtgcgcgtagccgatcgccgcgagctgcacaccttccttgctcaccaggttgatggtcttgttctcttccatccagccgttctccacggcctgcttgtagagcgtcgtgcccggatacggcgcggcgagcgagacctggatcgtgtgcggattgatttccttcgcgtactcgatcgtcttcttgatggtctcctgcgtctcgcccggcaggccgaggatgaaggtgccgtggatcttgatgccgagcttcttgcagtccgcgctgaagcggcgcgcgaaatcggtgcgcacgcccttcttgatgttcacgaggatctggtcgtcgccggattcgaagccgaccagcagcaggcgcaggccgttttccttcatgatcttgagcgacttgtacggcacgttggccttcgcgttgcacgaccacgtcatgccgagcttgcccaggccgatcgcgatcgcttcggcgcgcggcaggtcgtcggtgaaggtgtcgtcgtcgaacatcagttccttcacttccggcatgttgtcgcggatccacttcgcttccgcgagcacgttctcgaccgagcgcgtgcggtagcgatggccgctgaccgtctgcggccacaggcagaacgtgcagcgcgacttgcagccgcggcccgtgtagatcgacacgtacgggtagttcaggtagccgatgaagtagttgtcgatcttcaggtcgcgcttgtagacgggcgcgacgaacggcagttcgtccatgttctcgaggatcggacgcgcttcgttgtgctcgatcgagccgtccttcgcgcgccagctcaagcccttgatctcggcgaacggcttgccttcggcgatttccttgcaggtgtagtcgaattcctcgcggcacacgaagtcgatcgcctcgctcgccgtgagcgagttgtgcggatcgaccatcaccttcgcaccgaccatgccgaccagcatcgacggcttcatcttcttgaggtcctgcgcaaacatcgcgtcggtcgggaacgacggcgtgctcgtgtggatgatcacgagatcgtagtcgttggcgatcttcagcgtttcctcgaccgacaggccgtcggccggcgcgtcgacgacgcggctgcccggcacgagcgcggccggctgcgcgagccacgtcggataccagaaggaacggatttcgcgcttcgcctgatagcgcgagccggctccgccgtcgaagccgtcatacgaaggggcctgcaagaacagcgttttcatgaatgctccggtagcctgcatagttcgtttcgttacaacgattcagtcaaaaaccgcgggccgccctgccggcgcccgcctctctgtcatgtcgcgccgcgcggcctcgccgcgcagcgcgtctcggccctcgggccgggttcgaccggaacggccctagcggccgtccactgcttccacggccgccgtcgcgcgctcgccgccgacgaccgtcatcctcgcgccgcgccacacgacatgcgtgccgaacacggccgcgagccactcgagcgcgagcagcgtgtcgcgcaccgcgacgagcggcaagtcgcgccagaatgcgcgccagccgtcctcgccgcgcgcgtgcagcacgagccgcccgaacgcgcccaccacggccgcccagcccgccagcgagccggcgaaggttccgtcgagacgcagcgcgagcgccgcgccgatcgcgagccacggtacggtgaacgtaatgaacaggaacgcgaaaccggccgggttcagcgaacggatcgtgcgcaaccagcgcgtctcgcggtgccaaagcggcccgaacgacggctcgatcacgtcggtcgcgacctcgacctccgacagcacggtgcggcgcccaaggcggcgcggcagctcggccagccagaaatcgtcggccagttcgtccttcagcacgggaaagccgccgatccggtcgagcgtgtcgcgcgtcagcgcgagcgtcgcgccgaagccgaagcggctcgagcggccgagatgcgtgatccggaccgacggcgcgaaccaggcgtcgacgaactgcgcgccgattcgcgtccagaacccgccgacgctgcgcgcatgatacaggcacgtgacgacgccgaccgacacgtcggcgagcggtgccgtcacgcgctccagataatcgcgcgtcaccgcgatgtcgctgtccgcgatcacgatgcggccgtatttcgcgcgttcggcgaggttgatcaggttgctgaccttcaggttcttgccgtgcacgcgcgcatcgatcacgagcgtgatgtcgcactcggggtaatcggtgcgcagccgttcgaccacggcgacggccggatcggccgccgacgcgacgccaaacagtacttcgtaacgcggatgacgctgctcgcagaacgtcgcgaggttttcgtacaggtgcggctccgcgccgcacagcggcttgagcacgctgaccggctcgaagccgtcgcgcgcggccgtgcgcggcgtacgcggccgcggcgcgaacgcggcgacgagcgcatagccggccgcggccagcgtaaagacgatcaggagccagtcgagcatcgttgcggttgccgtcatgcgcgacgcctcccggcgacctgaacgccatggaaaacgcttgagcgcgattgagcgtgattcggtattccgacaacgacgaacgcgggcacgacccgactccttgttccagcagcgtctgtatatgagggaggctcgacccatccttcgggtgtggccatgcccggcttcgcgtggggcacctccgcgcgaaacccggacgagatgcgggaagactcgtatggctaccttcggcacaacatgggcaggcgccggattttagcagtctgcagcaccccgcgctcggcgctccgagaaacggacttgtgcaattccggcaaagctgcgcagtcggcgaaccatttgagcgcacccgcgttcacgttagcgtaagcggtttgcaggcgtattgcagtcttgaaaatcaatcgtttcgtgcaaatttgtacgtcgatgcggattcacatccaatcgccgtaaagattggtaattaatcgtcgattggattgatttttgcaacgatcgccggattcagccttgcacccctgaaaggcgcatgggtatcgcgccgccctcagcaggttccggaaccctttggcaaaatccctggcatttgttgcgtaagcgcatcaccccgccccctgttcgaaggccaaccgatgactccgttttccgtactcgatctcgcccccattccggccggcgccgacgcctcccaggctttccgcaataccgtcgatctcgcgcagcacgcggaacgctggggttacctgcgctactggctcgccgagcatcacaacatgcccggcatcgcgagcgcggcaacggccgtcgtgatcggccatgtcgcgggcgccacgcagacgatccgcgtcgggtcgggcggcatcatgctgccgaaccacgcgccgctcgtgatcgccgagcagttcggcacgctcgcgtcgctgtatccggggcgcatcgacctcggcctcggccgcgcgcccggcaccgaccagaccacgtcgcgcgcgctgcgccgcgacctgatcggcagcgccgattcgtttccggacgatgtcgccgagctgcagcgctacttcgcggagccggtgcccggccagcgcgtgcgcgcggtgcccggcgcggggctcgacgtgcccgtgtggctgctcggatcgagtttgttcagcgcgcagctggccgcgatgctcgggctgccgttcgcgttcgcgtcgcatttcgcgccggattacctgatgcgcgcgctcgagatctatcgtgcgcagtaccggccgtcggccgcgtggccgaagccgcatgcgatggtcggcgtcaacgtgttcgtcgccgataccgacgacgaggcgcagcgcctgttcacgtcgctgcagcagcagttcatcaatctgcggcgcggcacgccgggcaagctgccgccgcccgtcgacgtgctcgaggccaacgagctcgagctcgcgaccgtcgcgcattcgctgtcgttcgcggcggtcggctcgcgcgacaccgtgcgcgacaagctgcgcgaccgcatcgcgcagacgggggccgacgagctgatcgtcaccgcgcagatctacgatcacgcggcacggctgcgttcgttcgaactgaccgcgcagatccgcgacgagctcgcgagcgaggtgcgctgacggcacacgcccgcggccgcccccgcgtcactgcgggtgcacggcctccagcccgtcgagcagcgccttgtgaaacgcgtccgggtcctggatctgcggcgcgtgtccgagcgccgggaattcgacgagctgcgcgccggggatcgcggcctgcgtccgcttcgcgagttccgggtagcggccgagcttcgcatgcacgtcgggcggcgacacgtccttgccgatcgcggtcgtgtccttgtcgccgatcatcagcagcgtcggcacgcggatcgcgccgagttcgtagaccaccggctgcgtgaggatcatgtcgtagatcagcgcggagttccaggcgactgcgtcgcggccggcgccacggtacatcccggccagcatctgcacccagcgctcgtacgacggcgaccatttgcccgcgtagtacgtgccctgctcatagcggcgaatgctgtcagccgtggtcttctgctcgcgcgcataccagtagtcgaccggcagcggcggcacgccgagcgccttccagtcctcgaggccgatcgggttcacgagcacgagctgctcggtcgccttcggatacatcagcgcgtagcgcatcgcgagcatcccgcccgtcgagtggccgacgatcgtcgccgacttcacccccaccgattcgagcagcgcgtgcgtgttgcgcgcgagttgctggaagctgtactggtagcgatcgggcttcgacgacttgcagaagccgatctggtccggtgcgatcacgcgatagccggcacggctcagcacgccgatcgtgtcctcccaggtcgccgcgcagaagttcttcccgtgcagcagcacgacggtgcggccgttcgggtgcgccggcggcacgtcgagataggccatctcgagcgtttcgcgttgcgacacgaacgtatacacccgcacgggtgccggataggtgaacccttccaggcgcgggccgtacacgggcccgtcgttgccggcgggcgatgcggcggccgccgcgacaggcatggcgcacgcggcggcgacacccgcgccgagcacgacggcgcgcacggcatacaacatcttgcgaatcgaaagcatggcgatcacggtgattggagacgcacgcgggcagccgggccgcctcgcgccacgcgattctacgcggtcgcgctgacgacggcgcgcaacactccggggccgcgcgacttccgcgcgcgcgacgaactcgggtatcgtgtgacgtgaccctgaaacgcgtgcaggcgattcccatgaaaaacgtcctcagcattcagtcgcacgtcatctacggccatgccggcaacagtgcggccgtgttcccgatgcagcgcctcggcgtcaacgtctggccgctcaataccgtccagttgtcgaatcacatgcagtacggccattgggcgggcagcgcgatcgatgccgcgaagatggagcagctcgtcgacggcatcgccgcgatcggcgcactcaagcgctgcgacgccgtgctgtccggcttcctcggctcgccgccgcaggcccgcgcggccgtcgagatcgtccgctcggtgaaggcgatgaacccgaacgcgtggtacttctgcgatccggcgatgggccagacgggcggcatccggcccgaacccggcgtcgaggaattcatggtccaggaaatgccggcgctcgccgacggcatgtcgccgaaccacaccgaactgcagaagctggttgggcggcgcatcgaaaccgtcgcagaagccgtcgaagcatgccgcgcgctgatccggcgcggcccgcaaatcatcctcgtcaagcacctgcacgaccgcaacagcccggccgatcgcttcaacatgctcgccgtcaccgaaaccgaggcatggatcggccagcgcccgctgtacgcgtttccgcgccatccggtcggcgtcggcgacctgaccagcgcgatcttcgtcgcatgccggctgcgcggcgactccgtgcgcgccgcgttcgagcacacgctcgcagccgtgcatgcggtcgtgaaggcgacctacgatgcacgccgctacgagctcgaactcgtcgccgcgcaggacgagatcgcacgcccgagcgaatggttcggcgcgtgggtgacggacgcctgacgtaccggcatcgcccgccgcttcagcggcgcgcgtcccgcgctttcccgttgtcctgctttcctgctttcctgctttcctgctgtcctgctgtcctgctgtcctgctgtcctgctgtcctgttgccccgctttcccgctctacccctgcatcaccacgaccgttcgcgatatgccccgacgcagcgtcgatatcgcttcgacgcggatgcaaacgtttccggacttcacatgaatgacactgattcctcgctatgctcgcggcggcaccacccggcgcagccgcatcctgctacccgagtgcgccctttcagcaggtcccgccaatcggctctccctttaccccacgataacgaccatgacccgatcgaaccgtcgtgacttcctgcgcgtcgctgccggcaccgccggcgccgccgcgctgaacctgttcccgcccgtgatccgcgatgcgctcgcgattcccgcgaaccgccgcaccggcaccatccgcgatatcgaacacatcgtgatcctgatgcaggagaaccgctcgttcgaccactacttcggcacgatgcgcggtgtccgcggcttcggtgacccgcgcccgctgcgcctcgcgaacggcaagtcggtgttccaccagccggtcggcccggccgagctgctgccgttccatccgggcgcggacaagctcggcctgcagttcctgcaggacctgccgcacggctggcaggacatgcacgcggcatggaacaagggccgctacgaccagtgggtgccgaacaagggcaccacgacgatggcgtacctgaagcgcgacgacatcccgttccactaccagctcgccgacgcattcacgatctgcgacgcgtaccactgcgcgatcccgagctcgaccgacccgaaccgctactacatgtggacgggctacgtcggcaacgacggcacgggcggcggcccggtgctcggcaacgaggaaaagggctacggctggacgacctatccggaagtgctcgaacaggccggcgtgtcgtggaagatctaccaggacatcggcacagggctcgacgcgaacggctcgtggggctggacgcagaacccgtacatcggcaactacggcgacaactcgctgctctacttcaaccagtaccgcaccgcgctgcccggcacgccgctgtacgacaaggcgcgcaccggcaccaacatcagcgccggcggcacgctgttcgacatcctgcagcaggacgtgaagaacggcacgctgccgcaggtgtcgtggatctgcgcgccggaagcgtattccgagcacccgaactggcccgcgaactacggtgcgtggtacatcgagcaggtgctgaaggcgctcgtgtcgaatccggacgtgtggagcaagaccgcgctcttcatcacgtacgacgaaaacgacggcttcttcgaccacgtgcagccgccgttcgcgccgcagtcgcgcgacaacgggctgtcgacggtcgcgacgaccaacgaggtgttccccggcgacgcatcgcacatggccggcccgtacgggctcgggccgcgcgtgccgatgctcgtcgtgtcgccgtggacgaaaggcggctgggtctgctcgcagaccttcgatcacacgtcgctgctgcaattcatcgaggcgcgtttcggcgcgcaatacccggtcaaggcgggcaacgtgtcgccgtggcgtcgcgcggtgtgcggcgacctgaccgccgcgttcgatttcgcgacggccgacgccggctggccgacgctgccggatacgagcggctacgcgccgcccgaccgcctgcgccaccccgactacatccccgtgccgccggtgctgcagaagctgccgaagcaggaggccggactgcggccggcgcgcgcactgccttacgagctgttcgtgcacggccgcgtcgaatcggtcaacggcctgttccggctgaccttcgcgaacacgggccgggcaggcgccgcgttccaggtgcagtcacgcaaccgcctcgacggcccgtgggcgtacacggtcgaagccggcaagcggatcgccgacacgtggagcgccgcggcgtcgctcggcctgtacgacctcgacgtgtacggcccgaacggcttctactgccatttccgcggcccgttcgcgaccggcgtcggcagcgcgaacgtgaaccccgaggtgatctacggctatgacgtcgcgaacggcaacatcacgctgcgcctgatgaaccgcggccacaaggcggtgcggctcaaggtcacgaacgcatacggccacggccgcgcgcgcacgttcgatctcgcgccgggccagcagatcgacgactactgggatctgcgcggcagccacggctggtacgacctgaccgtcagcgacggccggctgctcggcttcctgcgccgcttcgcgggccacgtcgagacgggtcgcccgagcaccagcgatccgctgatccgcacgcacgcatcgcacgacgatgccgaagccgcatcggacgcgctgtccgactgacggcctcacgtgaggcggcgcggccccggcgggccgggccgcctcccaacgcttccgctcctcctctccgcccgctccgttcgcgacggaaactcccgataccggctgcctccgcacgcgcggaagctatgcgcaaatccgcatcgaatgcgcggcaaattgccaagacccacgcatatcggcgacctatatatcgaaacgatcggggctcttcgccgagcctgacgggagattcttccgaggatcacgatgccgacctccccgcccgattccgagaagcggtcgaaccgcccgcccgtcgcacgcgttcagccatcccgagcgcgtgcggtacttactcgcaggtatcgaacaagaggaacaacatgaaattccgtcattccctgctgtcggtgtcgattgcatccgcgcttgccctcctctcgcaacaggccgcccgggctgccgacacgaccgacgtgaaggtcggtttcgccgcgccgctcacgggcgtgaacgccggctacggcaaggacctgcagaacggcgtgcagctcgcgctcgacgatgccgccgcgcagaaggtgcagatcgccggcaagcccgcgcacttcaacctcgtcgtgcaggacgaccaggccgacccgcgcatcggcgtgcaggccgcgcaggcgctcgtcgaccagaacgtgtcggtcgtggtcggccatttcaactcggggacgacgattccggcctcggtcgtctacgacaaggccggcatcccggtgatcgatccggcggcgaccaacccgacgctcacctcgcgcgggctggcgaacatgttcatggtgatcgcgaccgacggccagaacgccggcaacgcgggcaagtacgcggtcgacgtgacgaaggcgaagcgcatcgcgatcatcgacgaccgcaccgcgttcggccagggcgaggccgacgagttcgagaaggccgtgaaagccgccggcgggaacctcatcggccgtgaattcaccagcaaccaggcggtcgactttcgcgcgcagatcacgagcctgaaggccaagaatcccgacctgatcttcttcggcgggctcgattcgctcgccgcgaacttcatcaagcagatgcgccaactcgggctgaacgcgcagttcgtcggcggcggcggcgtgaaggacaacgagttcatcaagatcgcgggcccggccgccgaaggcgcgatggcatgggaatacggccggccgctcgacgagctgccgcaagggaaggatttcgaacagcgcttcaggaagcgcttcggcgtcgacgtgctgtcgtacgcgcagttcggctacgacgccgcgtgggcggcgatcaaggcgatgcaggcggccagctcgaccgacccgaaggtctatcgtccggcgctgaagaagatcgacttcgaaggcgtcaccggccgcatctcgttcgcgaacgacggctcgctgaagagcgggatgtcgacgctgtaccaggtgaagagcggcgcgtggaagacgatcacgacgaagggaggctgatcggcggtgccggcggccggcggcggacacgccgcccggccgcggagatcgatgaccggatatcgacctcgtatgacgactgatgttgacgcgattcgaccgggcggacgcaccgcccggcacatcagccggcctgcgtgtcgcgctcggcctcggccgcctcgtgcgcgcggcgcagccgctcgcggctgttggtgaggtgcgtgcgcatcgcggcgcgtgcggcctccgggtcgtggcgcgcgatcgcctcgtagatgtcctcgtgctcgtggttcagccggccgacgtaccgctccagatcgtcaccggcgaagcgggccgaattcacgcgcgtgcgcgggatgatcgacgtgccgagctgcgtcatgatgtcgacgaaatagcggttgccggtggattgcgcgatctgaaggtggaactggaagtcgagctgcgccgtgtcgcggccgccgcccgcccccgttgcgatcgcgtcgagcgcgcgccgcagcgcgaccaggtcggtttcgttcgcgcgctgcgcggcgaggctcgcgcattcgctctcgaggctgatgcgcagttccagcaccgcgagcacgtcgcgcagcgtcgtgatcgtcgccgggtcgatcccgagcgtctggcggcgcgacggctccagcacgaagctgccgataccgtggcgcgtctcgatgaggccgctcgcctgcatccgcgagatggcctcgcgcacgaccgtacggctcacgccctgcgccgccatgacttcggtttcggtcggcagcttgtcgccgggacgcagcgtgccgttttcgatctgcgcggtcagcgcgtcgacgacatcttgtgcgaggctgcgtgcgcgacggcgcggcgctgcgggaagcgtaggcacggacatgaggccggttccttttgaatgatcgtaatgtgagccgagggtttacgcggggtttgagcgaaagccgatgattcattatactgcgtcacaagtcatccgacgactgatgatcaaaacacggatctcctgtcgactcaagcgcgcacgccggcactgcctggtcccatgccttacgatcagccagctttcgcgttctgcgctccgctggtcaggttgtcgctcccaccccgttccgggttgcatcgacctgcggggcttgcgcgccgcgcacgtcggttgtcgaatgatcgcacctcctgccgcgcgcggcaaagcttttgccgcacggcattgcccacccttctgccatcgccgcccatgaacgccgtctctgcctcgccctcccacgacacgccgcgcatcgtcgacctgcaagcgatcccggtcgccggccacgacagcatgctgctcaacctgagcggcgcacacggcccgttcttcacccgcaacctcgtgatcctgaaggacagcgcgggccggaccggcgtcggcgaagtgcccggcggcgaaagcatccgccgcacgctcgacgatgcgcgtgcgctcgtcgtcggccagccggtcggcaattaccatgcggtgctcaacgacgtgcggcgcaccttcgccgaccgcgacgcgagcggccgcggtctgcagaccttcgacctgcgcacgacgatccacgcggtcaccgcgctcgaggccgcgctgctcgacctgctgggccagcatctcggcgtgccggtcgccgcgctgctcggcgagggccagcaacgcgagcgcgtcgaaatgctcggctacctgttctacgtcggcgatcgcacgaagaccgcgctgccctaccgcgacggcagcggcgcgaccgacgactggacgcgtgtgcgcgacgcagccgcgctgacgcccgaggccgtcgttcggctcgccgaggccgcgcatgcgcgctacggcttcaacgacttcaagctgaagggcggcgtattcgaaggtgcgagcgagatcgaggccgtgacggcgctcgccgagcgcttcccgacgcgcgcgtgacgctcgacccgaacggcgcatggtcgctcgacgaggccgtgcggctgtgtcgcgaccagcatcacgtgctcgcctacgcggaagatccgtgcggcgccgagaacggctactcgggccgcgaggtgatggccgaattccgccgcgcgacgggctgccgacggcaaccaacatgattgcgaccgactggcggcagatgggccacgcggtgcagttgcaggccgtcgacatcccgctcgccgatccgcacttctggacgatgcagggttcggtacgcgtcgcgcagatgtgtcgcgactggggcctcacgtggggttcgcactcgaacaaccacttcgacgtgtcgctcgcgatgttcacgcatgtcgcggccgccgcaccgggccaggtcaccgcgatcgacacgcactggatctggcaggacggcgagcggctgacgcgcgagccgctgaagatcgagaacgggctggtggaggtgccgaagcggccgggtctcggcatcgatatcgacatggatgccgtcgcggtcgcgcacgagctgtacaagcagcacgggctcggtgcccgcgacgacgcggcggcgatgcagtacctgattccggggtggactttcaacaacaagcgcccctgcctcgtgcgctgagcacggaacggaccgggcggctgaatcgcccggccgagacgggctcgataggagcggcgaggcccggctggcgggtgtctggcggaaaacgccgctcgagtcgaacaggatccggatcgggatggcgatgcgaaccgggccggccatatcgagactcggccgggcctggccggtcttggccgtccgcacctagccggccgccccaatccccgcgcccgcccgccgtgcgcgggacttgtcagacgatctgcttgagcgcggcgtcgagcgcgagcaccgcgacgcggtcgccttcggtcgcgagcggcgcgcgcatgacgatctgccggttatggccgacggccgccggcgaatcccacagcagctcgaccttcggtcgattgaacaggccgccgcggcgcggcggcacgaccggggctgtccgcccgtcgccccttcgccggcggcaggcgccgtacggccgggccagcgcaccgacagttcgcgcgcgtcatactggccgaccttgcggctttccatccagacgatcgcggtgcgcgtcagcacgtcgagcgaaatcgcataacggccgaccgcgaagcggcgggccgccacgttggtccgccacagcggccgcgggcggcagatccagacgatcgccgcataaagcgccggggccgcaacgagccagccgttggtcgcggtcacggcatgcagcgcgaggcgccagccatccacccagacgaacatgccgatcgaccagaccgcgaacaggaaaccgatcagcgcgaagacgcgcagcgcctggcgcagccactgcggcagcggatggaacggccgctcggcgcgcgcgactgcacccggcaacgcgagcagcaggaagatcagcaggaggtagacgaacgcccagggcgacgacaccatcgcggacagcgacgagcgatagcccatctgggacatcgagaacagccagcgcgcgagcagcacgagaccgatcgcacgcaacgcgaagatcacaccggcgccggggccggcgctgcgcgcgtggatttcgttctcgccaagactgctctcctctggatattcgtgcggggccggatttcacggcacggccattatagggacattaccgtctggacagatggctggatgccatgccgggccgcttcgagggccgttcgcggcgtcgggcgcggcgagaatacaacagatccgcgccgcggatgtgacaacgccccgccggaaacccggacggggcgtcgttggcgagccgcgcgccgccaggcggcggcccgcaatcagcctgcgttgacttcgcggagcaccgtgcgacgcttctggcgcagcagttcctcgtagcccttcacgtagttctgcgccatcaccttcgacgagaagcgtgcttcgaacgcggcgcggaccttctcgcgcggcagcgtatcgaggcgcttgagcgccgcgacggccgacagttcgtcttcgacgacgaagcccgacacgccgttgtcgatcacttccggcaccgagccgcgcttgaacgcgatcaccggcgtgccgcaggccatcgcctcgatcatcaccaggccgaagggctccggccagtcgatcgggaacagcagcgcgtgcgcgttgcccaggaattccgtcttctcggcttcgctgatttcgccgatgtactcgacgtgcggcagcgcgaacagcggcttgatcttctcttcgtagtacgcgcggtcagccttgtcgagcttcgcggcgatcttgatcggcaggccggcctgctcggcgatgcggatcgccgtgtcgacgcgcttctccggcgagatgcggccgaggaacgcgaggtagctcggcttcacgttcgggatcggcgtcagcaggttttccggcaggccgtgataaacggtcgacagccagttcgcctgcggcagcgggatgcgctggttgtcggagatcgacacgaccggcacgtcgctgaacgcgttgaagatcggctgcagttccggcaggtcgagacggccgtgcatcgtcgtcagatgcgggaccggctggcgcgagaacagcgagaacgggtagtaatcgatgtggcaatgcaggacgtcgaactcttccgcgcggcggcgcacctgctcgaggagcagcatgtgcggggccatcacgtcgcggatcgtcgggtcgaggcgcagcgcctgcggccagcacgcttcgagcttcgcggaggtttgcgaatcgccgctcgcgaagagcgtaacgtcatgccccatctcgacaagtgcttcggtgaggtaggacaccactcgctcggtaccaccgtacagtttcggggcaccgcttcgtgcaacggagcgatttgggcgattcgcatgcgtaactcctaaaaatcggctaaaaaccaggtatgggtcggcaacctgccggcggtccgggctggatgcatttcgcccgaaaagtcagacgaatcagcctgccggggcgtcaaacccgcgctgctcaaggagcgtcggcgacgcgacaggcatagaacgtttgaaacgaagacccgttgacaggggttcgtaaaaacctggaatcgaacccggagccgattatctagggttaatcccgatacggcgcacaacatttcaaacactttactttgttacaaaggtgcaacactttgcaacccgcggacgtgggtgtccgttctagagtggaaggcccttttggcattccttgcccccgtgactgccggcagcgtgattccggcacatgagacaggacgggatgccggattttatctcaaaatcgatcgcgcacccctggccgaggcaagattcgcgcagcgcagcgcacggccttgtttacaatgccggattattcagtccgggcgaacgccggcaagcgatcccgccgccacgctcaatcaccgaatcaccgcacgcatattttggaatctctcaccctgcccagcgcaacgcccacaacgcgaagctgtcgagctacgcgcaccggccgatcgcgttcctgttccgctacatccgcctgcatcccgttgcccacctgatcgtgctctgcagcgtgctggccgccgtcggctgcgcgctcggctcgcaatacgcgatcaagcacctgatcgacgtgctggcgaccgggcgtcatcaccccggcccgctgtggagcgcattcgcgctgctcgtcgggctgatcgcggccgacaacctgctgtggcgcgtcggcggctgggtcgccgcgcatacgttcgtcgcggtcaccggcgacctgcggcgcgacctgttccagtacctgatcggtcattcgccgacctactactccgaaaagcagccgggcacgctcgcgagccgcatcacggccacgtcgaacgccgtctacacgtcggagaacacgatggcgtggaacgtgctgccgccgtgcatcgcggtgatgggcgcgatcctgatgatcatcgtcgtcaatccgatgatggccgccggcctgctcggctgttcggccgtgctgtccgtgatcctgttcaagctcgccgggcgcggctcggcccgccaccatgcgttcgcggcgaaggccgccgcggtcgacggcgaactcgtcgacgtgatcggcaacatggggctcgtgcgtgcgttcgggatgacgctgcgcgaacagaagcgcttcggcgcaacggtcaaggccgagatggatgcgcgccagcaaagcctgctctatctcgaaaagctgcgcctgctgcacgcggtgatcaccgcgatgctgtccgccggcctgctcggctgggcgctgtggctgtgggaccagggccgcgcgacgtcgggcgacatcgtgctcgtcagctcgctcggcttcacgatcctgcacggcacgcgcgacctcgcggtcgcgctcgtcgacgtcacccagcacgtcgcgcgcctgtccgaagccgtcaagacgttgctcgagccgcacgggatgcccgatcgctcggacgcccagccgctgtcggccaagggcggccgcgtcgacttcgagcgcgtgacgttcgcgtatccgcaccggcgcgcgatcctcgaccacttcgatctccatatcgagccgggccagcgcgtcggcctgatcggcaagtcgggcgccggcaagtcgaccgtgctcgcgctgctgcagcgcttctacgacacgcaggacggcgtcgtgcaggtggacggccaggacgtgaagacgatcacgcaggacagcctgcgccacgcgatcgcgctcgtgccgcaggacatctcgctgctgcaccggaccatctacgacaacatcgcatacggccgccccgatgcgacccgcgacgaagtgctcgcggccgcgcgacgcgcgctgcgcggagttcatcgaagcgatgccggaaggctatgacacgatcgtcggcgaccgcggcgtcaagctgtcgggcggccagcgccagcgcatcgcgatcgcgcgcgcgatcctgaagaacgcgccgatcctgctgctcgacgaagcgacgtccgcgctcgacagcgcatccgaggaagcgatccagagcgcgctcgaccgcctgatggtcggtcgcacggtgatcgcgatcgcgcaccgcctgtcgacgctgcgcaacttcgaccggatcatcgtgatgaacaacggcaaggtcatcgacgacgggccgcccgacgtgctgcgcaaccgccccggcctgtaccgcgacctgctcgcgaagcagcacggccgccatcacgcggcgcccgacggcagcacgccgaccggcgaacgcgtggcctgacgcaccggcccgcagccagcaaaagccgcagtgctgctcgcactgcggctttttcatttccggcgggaggcgtcggttacgcgtgctgcagatcgcgcaggaagttgtcgcgccacaccgacacgttgttctcgcgaagctgcgcgatcatgtccgcataacgcgcgcgccgctcggcgagcggcatcgtcagcgcctgcgacaacgcatcggccatcccgtcgatatcgatcggattgacgatcagcgcccccgtcagctcgcgcgcggcgcccgcgaaacgcgacagcacgagcacgcccggatcgtccggatcctgcgcggatacgtactccttcgcgacgaggttcatcccgtcgcgcaacggtgtcacgtagccgacccgcgcgagccggtacagcgccgcgagcagctggcggtcgtactggcgatggatatagaggatcggtgcccagtcgagctcggcgaagcgtccgttgatgcgccccgactctccttcgagctgcaggcggatgtcctggtacgcgcgcagctccgctcgggtcgacggcgcgatctgcaggaacgacacgcgattgcgatgcgacggctcgtgctcgagcagcttctcgaacgcgcggaagcgctcgacgagtcccttcgagtaatcgagccggtcgacgctcatgatcagcttgcgcccccgcagcgacgtcgcgagcgtgcgcaccgccttgccgtgctcgccggcctgcgcaagcgacgcgatctcgtccggatgcacgccgatcggatacgcggccgcgcgcagcgtccggccgaatgcgcgcaccgtcaccaggtggccgtcgcgctcgatcacgccgtccgcttcggattcgacgtaatcgcagaatgcgcgcaggtcgggttcggtctggaagccgagcaggtcgaacgcgcacagcgactcgaccaggtcgcgatgcggcggcacgttgacgagcacctgcgcggcgggaaacgggatgtgcaggaagaaaccgatgcggttcttcacgccggccgcgcgcagcgcgcgcgcgaacgggatcaggtgatagtcgtgcacccagatcacgtcgtcgtcctgcagcagcggcacgagctgctgcgcgagccacacgttcacgcggctgtagccttcgaactcgtgacggtcgtactggatcaggtcggtgcggtagtgaaacgcgggccacagcgtcgcgttcgagaagccgcggtaatactggtcgtagtcgcgccgcgacaggccgatggtcgcgaacgtgaccggcccgtgctcctcgacgcgaatctgcggcgcgccggacgcgacgacctcgccgctccagccgaaccacatgccgcccgtctccttcagcgcatcgtagacaccgatcgcgaggccgcctgccgccggttcgccttccgaaatcggtgcgacgcggtttgaaacgatgatgaggcggctcatgcgtgcggctgccccgcaccgagccagtgcgcgatctgctcatgcagcgcgtcgaccgaatcgagccgcgtgcgggcggacgtctcgcccgcgccgaccttgatcgacaggccgccgcgcgcgttgaccaccgcgaagcccttctcgtcggtcaggtcgtcgcctgcgaacagcggcacgcggcccgcgaacggcggctcgtcgaggaacgcggccagcgcgcgcccttgtcgaccccttcggcttgatctcgaacaccatcttgccgggctgcagcacatacgcatcggcatagtcggcgacgaggcgctcggcggccgcccgcgcagccgcctcgcgctcgggcgcgttgcggtagtgcagcgcaacggccgcgcccttgatttcgagcagcatgcccggatgacggtcgacgacggccgccagctcgcgctcgatgcgcagcaggcgttcgtcgttgaagccgatgcgctgcgtgtcgccgttcgcatcgcggcgctccgcgccgtgcaggccggcgatcggcaggccgggcatcttgaggaacgtgtcgaggttgtcgataccgcgcccggacacgatcgcgaccgcaccgtgcgagcggcgccgcagctcgtcgagcagcgtcagcagcgacggcggaacgtgaatgctgtcgggcgtcggcgccagttcgacgagcgtgccgtcgaagtcgaagaagaacgcggtatcggtcagggacagggaagccggaacggattgcatcgattcgatagtctgagaggcggccggcaaacgccgcaccgccgctgcgcgatggaattgtgcgcatcttaccgcgcctgcgcaccgagatgggcgaaaccggcgcatcgccggccgtgcgccgccgattgcgtcaactgcgacatattgccccgctcgcccgccccgtacgggtttcgaaaggacgcgggcgcgcgaattgcgctacagtcgcaaccgcctgccgcgcgacgcatggcatcgcgccggccggtcacctttccgtccgatcgagccccaggatgtcgtctgcccgcccagcgccgcaccggcgcttctcccgcctcatccgcacgaccgcggccctcgccgccgccgtggcgctcgccgcgtgcacgcacgacgagccgcgctggaacctgaccaacgtcaccggccacctgcccgacctgtcgttcacgctgacgggcggcgacggccatccgtcgacgccgatgcgttccacggccaggtcgcgctcgtctacttcggctacacgcactgccccgacgtctgccccgaaacgatggcacggctgatggaagtgctggcgaagctcggcccgcaggccaacgacgtgcgcatcctgttcgtctcggtcgatcctgcgcgcgacacgccgcaggcgatgcaatcgtatgtcgccgcgttcgacgccgcgcatgcgcgcggcctgaccggcaccgaccgccagatagaatcgctcgcgaagcgctatcgcgtcgcgtaccagatggaacagcgcgatccgtccggcggctacgaagtcacgcacagctcggccgtctacatcttcgacgcaaccggccgcgcccgcctgcttgcgaccgaccgcgactcgcccgacgccatcgccgccgatgtgcgccggatcatcgacaccgcctccaccacctgaattcctctcacgacatgaagacgaagacgacactcaagacgctcgccctcctcgccgcgctgtgcgccggcacccacgcctatgccgccggcgcgatcaccgcgcagaacgcatgggtgcgctggctgccgaacaagctgccggccggcggctacgtgacgatcgtgaacacgggcgacaagccggtcgatctcgtcgacgtcgacagccccgactacgggatggcgatgctgcaccagaccgtctcgaacggctcgacgcagaagatggaaatggtcgacaagctgacagtccccgcgcgcggcaaggtcgacatcgcaccgggcggctaccacttcatgctcgaggagccgaagcacgcgatcaagccgggcgacaccgtgcacctgcgcctgaaattctccgacggcgaaacggtcgatgcgccgttcgccgtgaaatcgccggcccaggcgaagtgatgcgcgcgcgatgaacctcctgtactggctcgatccgtgggaaccgtcgccgaccgtggtgatcgcggtgctcaccgctgccgtgctgttcgcgcgcggcgtgaagaaggcgaaggtgtcgccgctgcggcagttctcgttctggttcgggctgacggcgctctacatcgcacttcatacacggctcgactatttcttcgagcacgagttcttcctgcaccgcgcgcagcacctcgtgctgcaccacctcgggccgttcttcatcgcgctgtcctatccgggcgcggcgattcgcgcgggcatcccgtttcgctggcggcagcgcttcgtgcgccccgccctcgcgtgggcgcccgtgcgcgcgacactcgacgtggtgttccatcccgtcgtcgcggtcgtgctgttcgtcgggctgatctatttctggctgctgtcgccgatccacttcatcgcgatgctcgactggcgtctctatcgcgtgatgaactggagcatggtgatcgacgggctgctgttctggtggctcgtcgtcgatccgcgccccgcgccgcctgcgcggctgtcgccgggccgccggatcctgatcgtcgtcgcggcgatcccgccgcagatcgcactcggcgcgctgatcttcttcacgccgcacgagctgtatccgatctattcgatctgcggccgcgcgttcacgtggctgagcccgctgcgcgaccagcagatcggcggcctgctgctgtggattcccggctcgatgatgagcgtgatcggcgcgctgatcgcgctgcggcactggctgcggctgtccgcccgcggccgcctgatcggcgaacgggccgcgcaacgcgcggacgcgccatcggtcgcgcgcgccgcgcactgacggccgcgcggcgcggcgcgcattacgcgcgtgcgctgctcatccacacgtgcgggatgccgtcctcgtcgtgcacgtccgagctcggcgtgaagccgaatgccccgtaaaaacgctgcaagtgggcctgcgcatgcaggctcaccggcgtatccggccactgcgcgcgaatatgctcgagcgcgcgcgacagcagcccgttgcccaggccggcgccgcgaaacgcggcggtcgtcagcacgcggccgatgcggacatcggtgttctgcgcatccggcaacagcacgcgcagatagccggcgaggcgcccggccggatcgaatgcagccaggtgccaggcggcctggtccgcgtcgtcgatgtcgcgatacacgcaattctgctcgacgacgaacacggcgctgcgggcttcgaggatcgaatagacttcgcgcgccgtcagcgcgtcgaaggatttccagcgccagtcgagatcggcggcgctcggggatgcggcggatgcgttcatggtcggtcctgattcgggcgcgccggccggcgcgcggcaatcgtcgattatgccccgaagcgcacgcgccgcgcgaccggctgcccgcacccgaaaaaggccccgcattgcgcggggcctgtccgtcatgccggcatctggccgaaacggccgttgttgaagtcctcgatcgcggtgcggatctccgcttgcgagttcatcacgaacggcccgtatccgacgacgggctcgtcgatcggttcgccgctcaggatcagcagcttcgcgtcgccgttcgcttcgatctcgacgtcgctgccgtcgcggccgagctgcacgaactgcgcttcgcgggcgaccgtctcgccgttcacctgcacggtaccgctcagcacgaccaccgcgagcgtgcgcccttcggcgaccgggaaccgcgcatggccgccggccacgagccgcacgtcccatacgtcgatcggcgtatgcgtgcgggccgggccgcgccgcccgtcgagctcgcccgcgatgatccgcgcacgccccgcgccgtccggcagctcgaccacggggatgtccgcgtccagcagcgtctggtagccgggcgcccccatcttgtccctggcgggcaggttcacccacagctggaccatctcgagcgggccgccacgcttcgtgaactcttccgagtggaattcctcgtgcaggatcccgctcgcggccgtcatccactgcacgtcacccgggccgatcacgccgcccgcgccggtcgagtcgcggtgcgcgacctcgccgtcatagacgatcgtcaccgtctcgaacccgcggtgcggatgctggccgaccccgcgcggcgccgaggccgagcccggctcgaacgtcgccgggccggcgtagtcgagcagcaggaacgggctcagatgcgcgccgtgagactggtagctgaacatcgaacgcaccgggaaaccgtcgccgacccaatggccgcgcggcgcactgtacacaccctggatcttcttcattgccttctccgaattgcggcgaaacacgtgtttcgcatcctggacaggaatatagaggtggaacgatcgatccggtagactgccaaaatcgcactcagcgttccatttcatgaacgataaagcgcgggatctgaacgatctctattatttcgtgcaggtcgtcgaacacggcggcttcgcaccggccgggcgtgcgctggacatgccgaaatcgaagctgagccgccgcatcgcgctgctcgaggcgcggctcgggatgcggctgatccagcgctcgacgcgccgcttcaccgttaccgacgtcggccagacctactacgcgcattgccgcgcgatgctcgtcgaggccgatgccgccgacgaggcgatcgcgctgctgcacgaggagccgcgtggcatcgtgcgcgtcagttgcccgatcgtgctgctcgattcgctcgtcggcgagatgatcgccgcgttcatggtcgcgtgtccgcgcgtcgagattcatctggaagcgaccaaccggcgcgtcgacgtggtcggcgaagggatcgacgtcgcgatccgcgtacgcccgccgccgctcgaggacagcgatctcgcgctgcgcgtgctggccgagcgcggccagtgcctcgtcgcgagccccgcgctgctgcgcgagcatggcgcaccggccgttcccgccgatctcgcgcgcctgccgagcctcgatcacggcgtcccgcagtccacgcacgtgtggcggctgcgcgggcccgacggcgcgcatgcggaaatccaccacctgccgcgctttgtgaccggcggcatgctcgcattgcgcgcggcggccgtcgcgggtgtcggcatcgtgcagttgccgacgatgatggtgcgcgacgaggtcgcgcgcggcgcgctggtaaccgtgctgcccgactgggcaccgcgccgcgagatcgtgcatgccgtgttcgcgtcgcgccggggttgctgcccgccgtgcgcgcgctgctcgattttctggccgcgcggtttgccgaactcgaacccgactgagcttgccgcgtcacgcgcaaccgcgcgctgcaaaccgtgcgtgcgtgccgtagactgcggtacgcgcatcgcgcattccacaaccctgatcgcttttccgccatgttcacgctgtccaacgaccccaacgcctccaaggccgatcaatacgcgacgctcgtcgagcaagcacgcgcgctcgtcgaatccgaacgcgacctgaccgcgaacgcggccaacttcgccgcgctggtctaccactcgctcgaccgtctcaactgggccggcttctacttcttcgacgggacggaactcgtggtcgggccgttccagggcaagcccgcctgcgtgcggatcgcgctcggcaagggcgtgtgcggcacggctgcgcagacgcgcgagacgcaggtcgtgcgcgacgtgcatgacttcccggccatatcgcgtgcgacgccgcgtcggaatcggaaatcgtcgtgccgctggtggccagcgacggcacgctgatcggcgtgtgggacgtcgacagcccggtagccgcgcgcttcgacgaagaagaccgccaggatggaggcgctctgccgcgtattcgtcgaatccgcctggcagaaggcgcgcggttgagcggcggctgagccgcgttcatccaccgcgcggcgcgcggcaggtcgccgcgttcacgcatgaatcgcgccgcatgacctcgaacgaaacgggctccgcaaaggagcccgtttcactgtgccgccgcaccgcccttagcggcgcactttacgcgtcaggcagcatgcgtgccggtcagcgccgggaacgcttgcggcttcacatcctcggtcagcacctcgaagcccgtttccgtcaccacgaccatgtgctcccattgggccgacagcgaatggtccttcgtgacgaccgtccaaccgtccgccagcatgcgcgtgtcgcgcttgcccgcgttgagcatcggctcgatcgtgaaaatcatccccggccgcagcggtacgccggtgcccgggcggccgtagtgaagcacctgcggctcgtcgtgatagacgtcgccgatgccgtgcccgcagtactcgcgaaccacgctgaatccttcgcgatgcgcgacctgctggatcgcgtagccgacgtcgccgagcgtggcgcccgggcgtaccgcgcggatgcccgcatgcatcgcctcataggtcgtcgcgacgaggcgccgcgcgagttcgttcggttcgccgacgaaatacatgcggctcgtatcgccaaaccagccgtccttgatcaccgcgatgtcgaggttcacgatgtctccgtcgcgcaacggccgcgacgtcgggataccgtgacacaccacgtggttgaccgatgtgcacagcgtcttcggataaccgtggtagccgatgttcgccgggatcgcgccgagcacgtcgacgatgtattcgcggcagcgtgcgtccagttcgtcggtggtgacgcccggcttcacgtgctcggtgatcatcgtcagcacctgcgacgccagcttcgcggcttcgcgcgacttggcgatttccgccatgccgcggatcgggatgtctcgcttcgccattacgccacctgctcgatgccgtgttcgaccggttccgccggccccgcctcgccgccccgtgcttcggcctcgatcagcatccggcagatgtcgccgtaggacagcgccggattgagttccgccagcatcccgacgcgcagccagtgctcggcctgtgcgttgatcgagcggctcagcgccgtgctggtcgagcgcagccgctcgtgcatgtgctcggaaatcttgatgatgcccatatatccccaattaaacgaaacgtagtcggttcgtatattacgctgcggtcggctggcgggcaagccatgcggattccgtcgagccgccagcccgtcatcggcgttgacactgaattccagtttgctagaaaataaatccaccatgaaagaatccgtcaccgccgctgccgacgacaccggcatcaacgaacgcatcgcccggcgcgtgcgcgacctgcgcaccgtacgaggctacacgctcgatgcactggctgcgcgctccggcgtcagccgttcgatgatctcgctcatcgaacgtgcatcggccagcccgacggccgtcgtgctcgacaagctggcagccggtctcggcgtgtcgctggccgggctgttcggcggcgaccacgacgacgcgcccgcgcagccgctggcacgccgcgcgcagcaggccgaatggcgggatccggcgtccggttatgtgcgccgcaacctctccccggctggctggccgtcaccgatccagctcgtcgaggtggatttccgcccggtgcgcgcgtcgcgtacgacagtggcgggcgcgaaagcgcgttgcatcagcaggtgtggatcatcagcggccgcgtcgacgtcacgctcggcgaaacgcttcacgaacttcgcgaaggcgactgcctggccatgcggctcgaccagccgctgattttcagcaatccgtcgccgcacgtcgcgcgttatgtcgtcgtgatctgcgacgcgtccgccgccggtatgcgcaccctctgatgaacgcgtcgtcgcagcagccgtgcgcgcgacccacttactgcccacaggagtccgtatgaattcccgaaacagcgcgacgacgtgcgcctgatcgattgcagcgaggccgagcatgcgccggccattctcgagatcctgaacgacgcgatcgcgaactcgaccgcgctgtacgactacaagccgcgtccgccggaagcgatggtcgcgtggttcgcggcgaaacgcgcaggcggcttcccggtcatcggcgcggtcgacgcgtcgggcacgctgctcggcttcgcgagctggggcacgttccgcgcgtttcccgcgttcaagtacacggtcgaacacagcgtgtacgtgcatcacgaccagcgtggccgcgggcttggcgaagtgctgctgcgcgaagtcgtccggcgcgcgcgggaagcggaagtacacgtactggtcggctgcatcgatgcggccaatgcgggagcatcgcactgcatgcgaagctgggattcgtgcactcgggcacgatcaaggaagcgggcttcaagttcggccgctggctcgacgcggcgttctatcagttgacgctcgacacgcctgcgcaaccggtggacggctgagcggatgtcgcgatggacgagcggcatcgcatggccgaagcctgctcgcagcgggctttcgtatttctggacgccagatcccgccaccggagttgcaaagcaacttgcagtgccgaacgacgcagtcatgtctgctcgcgtggggcattcaaatagacttgggccaagcgacgctaccgtgtgacaaaagagactttgccggcgcatatgctcgtcatccgacatcaggtcgtcgcctcctatctgcgatgcgcatatcgcgagcaacgaagaagcaatcgctcctgggttcgcacgctgccatccgaagcgacaccaatcccggtaaaaattgaccgatcaaacagaatgttactgttggtttcaaagatgcccaaatagtaggctggagtgccgctattcttccgtcacccacaataacgatcccaacttgggggtgacatgaacaacatcatcaaaggcgccctttgcgccgccttcgtaccattcatcctcgccggttgcggcggcggcgacgacggtggcggcacgcaaaccggtacgctgcacgtcgcgatgacggatgcgccatcctgtggcttcgaccatgtgtacatcaccgtctcgcaagtccgcgtcaacgcaaacgcgaacgccgcagacaacgacgccggctggtcgaccgtatccctcgctacaccgcagaaaatcgatctgctgtcgctgaccaacggcgtgctcgccgatctcgggcagaccgccctgcccgccggccagtatcagcaagtccgcctggttctcgcacagaatcaaggtaacaacctcgcgaactcggtcgtcccgaccggcggcaccgaacaggcgctcgccacgccgagcgcgacgcaaagtggctacaagatcatccacccgttcacggtccagcccaacacgctcgtcgatctcgtgctcgacttcaacgcatgcaagtcgatcgtccagcgcggcaacggctcgtatgcgctgaaacccgtcgtcactgcggtcccgacagttgtgagcggcgcgatctccggttacgtcgcctcggccgaagccggcgcgacggtctatgccgagcaaggcggcaaggtcgtccgcggcacagtggccgacagcaccggcaagttcgtgctatcgccgctgatccagagctcgacgcaaggcaattacgatgtcgtgatcgtgcagaacaacttcgcgtcgggtatcgtgcgctccgtcccggtcgtcgtgaacacgaccacggcggtgtcggcgtcgaccgcaccgatcacgctgccggcgtcgacgatgagcaccgtcagcggtgcggtgactgccagcgccaatgcattcgtgcgcgcgctgcagacgatcgacgcgaatgcctacgagatcacgtcgatcaacgcgaacctggatacgggcgcctatgcgctcaacgtacccactgccgcgccgatcgtcggcacttactcgggttcgctaccggtcgcgctcgccgcatcgccggccgccgccgcacaatatacgatcgaagcggacgcagcgtcgggggcaacgcaatcgacgaacgtcaacgcaacgaccagccagtcgaacgtcaatttcagcttctgacgcgtcggcagcgcaccgaaagggccgttcggccctttcatcaataacgggagaacgaagtgaaaaaggggttatcgcgttgcttgcagcggcgagcatggtcggcgcgctcagtgggtgcgtcgcatacgttccgggtgcaccggtagttgttgcaccgcagggtggcccgggaacggattctgcccaccgggacaggcgaagaaaggcaattgctgattgcacaggggcccgcattcagcgggcctgtccagactttgtttgcgaattacaggccataggaactggttgctgcgcccccaattggcgtatcggctccgtttcgtcaagagcaccgatgtccgcaagacactcaacgaaccggacgtagagttcgtcctgtactaggccgtttgatcgcatccattccatggctgcgtttgggttcagtagcaagacatgatggaactgcccagacggcccaggcttggttcggatgaaattcagttcgcgtagcctactcatcctgcgacgccaggtgtcgacagcgcactcgccggtgaatccgacctctgccgccaaggtcaagggatcggcaattgacagcactggataattccacgcccttgcccacaggcagaaaagtgtttgacctgctggctgtctctttgactgggcgtcgacggcttgcatcgcaatcggtagcgtacgaggaatagtgacgaacccaacgtttcgatgtgggtgccaaagccaaatttcaggtatgccgggaaaatgaagatccagcagttgctgggcacggtcagccattttcagacgacgaggaattgtatgttgaatgttcgccatggtcgtcccctggatgccgcttatttgtctgatgttttaattgggatcgcctgccagaccacaagtttcgatgctgcgtttggcctcgcaacgacgcaacttcgtccggacgcgcccccttttccgtggcagtggagagcgaccgcaccacgtttcggacgccctcccgagacgcatgcaagttgaatcgtcgggtgatcgtgaatgggcaacgactatcgttcccaacgcaactgatgaagcgaacaacgtgccagcctcacgactgcaccgcccgaacagtgctcggcgatgccgagcatcaagtacgggcgagtcctggcaaatgcgttgcagcgtcgatacaccgtgcgggtggtcaatgggacgaaatcggcgaaaagtgtcgagactgacgatgtgagaggcgccgcatcacaacggttccgcgctcgccaaatgcctttactggaactcggcgagtgtgccagtacgtcaccgaataatgattcgaacatgcaacaccggcgctgcatgcatgtcaccgcccaagttactttggctctgcggccatctgttccgccggatagaactgcagcatcatgcgcgcagcttccgcattcttcttgtgcaaccgttcgtgatagtcaaagaaaaagccctgatttctcagggctttttctttcttacttggaggcgcgagccggagtcgaaccggcctaaacggctttgcaggccgctgcataaccgctttgctatcgcgccaaaagcggactgtccggatgccgtgaggcaagagacagatttttattcgaggaccggaggtccatcaaataaaaagggaagcgtggcttccccattacttggagcgggagacgagtctcgaactcgcgacctcaaccttggcaaggttgcgctctaccaactgagctactcccgcattgtcctgcatctgcagcgcttcgccgtaccacacgctgccagaaaaatctggagcgggagacgagtctcgaactcgcgacctcaaccttggcaaggttgcgctctaccaactgagctactcccgcatgtgtcctgcatctgcagcgctttgccgtactacacgctgccagaaaaatctggagcgggagacgagtctcgaactcgcgacctcaaccttggcaaggttgcgctctaccaactgagctactcccgcatgttgctgcgctactgctttcccgtcacacacttacttcgtcgtgcagcggagaagcgagattatgtcgaaggcactttcgtgtgtcaagggcttttccagccctttttccaaaaacctgctcgaccgaacgcgtgacacgcatcacgcgccgccgcgctcgcgaatttgcggccacgcgagcttcatgtagtacagcatcgaccagatcgtcagcaccgccgcgagatacatcagccactcgccccacacgcgcgtatcgatcgtggcgatgccgagcggcagcggcccgtagaacagcagcatcggaatcgcgaccatctggcatgcggtcttgaacttgccgagctgattcaccgccacgctcttcgacgcgccgatctgagccatccattcgcgcagcgccgaaatcgcgatctcgcggccgacgatcacgagcgcgatcgccgcatcgacgcgcgaaatctgcacgaggatcagcagcgccgccgtcaccatcagcttgtccgcgaccggatcgagaaaggcgccgaacgacgacgtctggttccacttgcgggctagaaacccgtcgaaccagtcggtcagcgcagcgagaatgaagatcgccgccgccgcgagattgcggtgcgcgccgcccatcaccgtgtccggcagatagaacacgccgacgacgagtggaatcagcacgatccgtacccacgtcaggaaaatcgggaaattgaacggcatggcatgcgggacagtaaaggattcgcaattgtgccgtgtcgaccggcctgccacaagaacgctggcaaggcagccggccgcacggccgcgtcagtgaagctgcttgtagatctgctcggcgagcgcgtgcgagatgccctcgacgctcgcgagttcctcgacgctcgcggcaacgacaccgcgcaacccgccgaaccgcgcgagcagccgctgccggcgcttcgcgcccacgccctcgagctcctcgagccgcgacgtctggcgcgccttcgcccgcttcgcgcgcatgccggtgatcgcgaagcggtgcgcctcgtcgcgaatctgtgcgacgagcatcagcgcggcgctctccttgccgagttcgagcggcgtgcggccgtccgcgaacacgagcgtctcgaggccgaccttgcgcccctcgcccttcgcaacgccgaccagcatcgacgtatcgaggccgagctcggtgaacacctggcgcgcgatttcgacctgacccttgccgccgtcgatcagcacgatgttcggcagcaggctcgacgcctcggcctggcgcgtcgactcgccgtcgatgccggccgcttcgtcgacagccgccgcctgggccgcctgctcgaccatcttctcgtagcggcgcgtgagcacctgccgcatcgccgcgtagtcgtcgcccggcgtaatcccggtgatgttgtagcggcggtactcgcccgactgcatcttgtgatggtggtagacgacgcacgacgcctgcgtcgcctcgcccatcgtatgactgatgtcgaagcattcgatccgcagcgtcgcgagatcgtcgcattcgtagctgagcgtctccgcgagcgcacgcgtgcgcgcctgctgcgagccctgctcggacagcagccgcatgagcgcgatctgcgcattctgctcggccatcgacagccacgcgcgccgctgcccctgcggctgccgcaccagcgacaccttgtggccggcctgctcggacagcaactcgagcaggtcgcggctcgcgggcgcatggctcacgaccagcacgggcggcacgcgattgccgagatagtgctgagcgatgaacgcgtcgagcacctcggcctcgaccgacgccgccgcgtcgccgcgcgtgcgaccggtttcttcggcgggcaggtcgggtaatgcttcggccggtgcagcggccacctccgccagttcagactcgtcgccgagaccgccttcggcgagcgtcagcgcgctttcgacgtgcgtcgggaaatacgccttgtcgccgagatgccggccgccgcgcaccatcgcaaggttcacgcacacgcgcccgccctgcgcgaccaccgccaggatgtcgacgtcgctgtcgctgccgacctcgatcgcctgctggtgcagcaccgtcgcgagcgagctcatctggttgcgcacggccgccgcctgctcgaatttcagctcggacgcgaacgcgtgcatcttctgctcgagctccttcatcacttcggactgccggccgagcaggaaccgcgcggcgttcgacacgtcgatcgcgtaatcctcgtcggagatcgcaccgacgcacggcgccgtgcagcgcccgatctgatgcagcaggcacggccgcgtgcggttgttgaagaccgaatcctcgcaagtgcgcaactggaacacgcgctgcaggatctggatgctctcgcgcacggcccaggcgctcgggaacggcccgaaatactggttctgcttgtcgaccgagccgcggtaataggccatgcgcggaaagcggtgcgcggtgagcttcaggtacggatacgacttgtcgtcgcgaaacaggatgttgtagcgcggcgcgagcgccttgatcaggttgttctcgagcagcagcgcttcggcctccgaacgcgtgacggtcgtctcgatgcgcgcgatgcgcgtgaccatcatcgcgatgcgcggcgaaagctgcgtcttcgtgaaatagctcgatacgcgcttcttcaggtcgcgtgccttgccgacatagagcacggcgcccgtcgtgtcgtaatagcgatagacgcccggcatgtgcggcaactgcgcaaggatcttcttcggttcgaacggggtatcgggagcttcaggggatgtcatgcgtgatccgggcgccttgtaacgcggaacgggtctattagaatcgccagtttagagcattcaccggcccgcttcgatgccacgcaccaccgctgccccctgcccgccgcgccgggcgaaccgatcgcctgcgacctcttctgtaccgtgatcgacaatttcggcgacatcggcgtctgctggcgcctcgcgcgccagctcgcgcacgagcacggctggcaggttcgcctgttcatcgacgacctgcgcacgttctcgcgcctgctgcccggggtcgatcccgacgcgggtcggcagacggtcgacacgatcgtggtcgagcactggcatgcggaagtcggcgacgcgctggagatcgccgatgtcgtgatcgaagcgttcgcgtgcgagttgcccggcgcgtatctcgcggcgatggcgcgccgcacgcgccgcccggtgtggatcaacctcgaatacctgagcgccgaggactgggtcgccgacttccatctgcgcccgtcgccgcatccgcgctacccgctgctgaagacgttcttcttccccggcctgtcggccggcaccggcggcgtcctgaaggagcacgacctcgattcgcgccgcacggcctttgaagccgacgcggcggcgcgcgacgcatggtggcggcgcgcgaccggcggcgcgccgccggccgccggcacgacggtcgtcagcctgttcgcgtacgagaatccggccgtcgacgcgctgctcgcgcagtggcgcgacggcccgtcgccggtcgtcgcgctcgtgccggcgggccgcgtgtcgcctgccgtcgcgcgtttttcggggtcgagtcgttcgacgcgggcacgcatgcgcacagcggcaacctgacggctcacgggctcgcgttcgtccccaggctgactacgatccattgctgtgggtggccgacatcaatttcgtgcgcggcgaggattcgttcgtccgcgcgcagtgggcacgcaagccgttcgtgtggcacatctatccgcaggccgacgacgtgcacctgccgaagctcgacgccgcgctcgcgcacctgtcggccggcctcgccgacgcgccgcgcgcggcgctcgagcggttctggcatgcctggaacggcgccggcacgcccgactgggcggatttctggcagcaccgcgccgcactggacgccaacgcggcccgctgggccgatgcgctcgcggccgtcggcgatctcacgggaaagctggcggaatacgcaaaatctcagttaaaataagcggttatccgacggccgaccgcgcaagcgcttgcttttggcgcccaccggaacgcgtctgcttggcgcctcacccgttgtgcaacgctcaggcacctatttatttgatttgatcaggacagtttttatgaaaaccgcacaggaactccgcgtaggcaacgtcgtgcagatcggcagcgacgcatgggtcatcgccaaggctgaatacaacaagtcgggccgtaactccgccgtcgtcaagatgaagatgaagaacctgctgacgaatgcaggccaggaagcggtgtacaaggctgacgacaagttcgacgtcgtcgtgctcgaccgcaaggaagtgacgtactcgtacttcgccgacccgatgtacgtgttcatggacgccgactacaaccagttcgaagtcgaagccgaaatgatgggcgaagcgctgaactacctcgaagacggcatggcttgcgaagtcgtgttctacaacgagaaggcgatctcggtcgaactgccgacggttctcgttcgcgagatcacctacacggaaccggcagtcaagggcgacacgtcgtcgggcaaggtgctgaagaacgccaagctcgcaacgggcttcgaactgcaagtgccgctgttctgcaacaccggcgacaagatcgaaatcgatacgcgcacgaacgaataccgcagccgcgcgtaatcgccggcgatgcccgcatcgaacaaagcgcccttcggggcgctttttgtttgtccggcgccaacaagcgagcgcgggccaggctcatgtaaagcacaaaagccaccggtaaagatattcaatttgtatcatcggtaactgttttatagcgccggagaaataatgctcgttacgcgttcagcggggcataaaatcagtctttaatctgacatgcggctgcggccccgatgaccgacagcccgcctctcttgactcgactcgcgtccaccatgccacacgccctgattgtcgaagacgatcccaacagtctgtccggcctcaccgcgctgctcgccgcggacggcttctcggtcgacacggccacgtcgctcgccgaagcgcgcacggcgctcggtcgctcgattcccgatgtcgtgctcgtcgacctgaacctgccggacggcagcgggttcgacctgctccagcacctgccgcagcaacagccgaacggctcgctgcccgtcatcgtgctgacgggcaatgcgacggtcgagagcgccatcgagggcctgcgtcacggtatctgggactacctgctgaagccgatcaacattccgcgcctgcgcagcctgctcgcgcggattccccgcccctacgaactgatcgacgaagtgcagtcgttgcgcgcatcgctgcgccatctcggccgcttcggcgcgctggtcggccgcagcgacgcgatgcagcacgtgtacgacatgatcgagcacaacgcgcgcaccgaaacggccgtcctgttctccggcgaagccggtaccggcaagctggccgcgcgcacgctgcacgacctgagccggcgccgcaaggggccgttcgtgtcgttcgactgcaggacgatcgcgcaggccggccggcacggcgcatcgctcgacagcgtactgttcggccatgagcgcggcgcgttcgacggcgccgagcgccgcgaatcgggcctgttcgagcaggccggcggcggcacgctgttcctcgacgaaatcactgcgctgccgctcgtgctgcaggaagcgctgctgcatgcactcgattcgcagaacttcatgcggatcggcggcacgagttcgatcacgagcgatttccggctgatcgcgaccacccgccgcccggcgcgcgaagcggtcgcgaacggtacgctgcgcgaggatctgtggttgcgcctcgacgcggcgtcgatcacgatgccgccgctgcgcgagcgcgacggcgatgcactcgcgatcggcgacgcgctgatcgacgagctgaaccgcgaagcgcgcgcaaccggccgcagcacgaccgacaagcgcgcggcaccgggcttcgtgcgcgaatgcctgtcctacgaatggccgggcaacgtgcgcgaactgcaggaacgcgtgcgcttcgcgtacgacgcatcgggcgatttcatcgagacgctgcgcgcgggcgagccgagtttctcggccggcgccgcgctgaacggcagcagcgtgcagatcaaggtcggcacgccgttgtctgacgtcgaggatctgctgatccgcgcgaccctcgatgcggtcggcggtacgcgccaccgcgcggccacgctgctcggcatcagcccgaagacgctgtacaacaagctgcagcggatgaaggtgaactgagcgggcgtcgatgcttgcaggcactggcggaatcagaccgttagttgcgccaaaagaatcaccgcccccgcccgcttgactcgtgacgctgcccggttcgcacctgcagtaacccatgaaaaagccgcgcaactgcgcggctttttgtttcggcgaccggggaatggcacacgtcgtgccatccctccccgttcatgccagtgcgctgctcaacagcgcctgcgcctgcaggtattcgggctgcgcgatcagcttgtcccacttgggtgccttgccgcgcgcgcatccgcttgaggcgtcgcaccgactcgtccgttgcccgcgctttcaacccgttcagcacgacctcggccgcgtccggctggttgcagacgagcaccatgtcgcaaccggcagcgagcgcggcgtcggccgcctgcgtgagcgtgccgccttcgcgcgcggcttccatcgacaggtcgtcgctgaagatcgcgccggtgaagccgagccgcccgcgcaggatgtcctgcagccacacgcgcgaaaaaccggccggccgcttgtcgacctgcgtgtagatcacgtgcgcgggaatcaccgcggacagcgacaagccgagccagtcgtaaggcgcgacgtcctgcttgaggatcgcatcgagcgtgcggtcgtcggtcggcagcgcgacgtgcgagtcggcctccgcgaagccgtgccccgggaaatgcttgccgcagttcgccatcccggcgagcgacagcccgtggttcaggctcttcgcgagcagcgtgacgacgcgcgcatcgcgatggaacgcgcgatcgccgatcactttcgagtgcccgtaatcgaggtcgagcacggggtgaaactcatgtcgatcccgcatgcgcgcaattccgcggccaggatatagccgacggccgtcgcgaccttcgtcgcgagcagcacgtcgcgatcccacagctcgccgagacgccgcatcgcgggcagcacggtgaagccgtcggtgcggaaacgctgcacgcgcccgccttcgtgatcgacggcgatcaggatgtcttcgcgcaccgcgcggatcgagtcggtcagcgcggtcagttgcgcacggttctggaagtgccgcgcgaacaggatcacgccgccggtattcggatgcgcgaggcgccgcgcatcgtcgcgcgacagggccgtgccgacgacgtcgagcatgaccgggccgggagtcgttttcatcgaatcgggaattccgtcaggaggaggttcgggaaacaggggcaggcgcggcgtccgtctcggcgatcacgaacgacaccgcgtagtcgcgctcgtcgctgaccgtcacgcgtgccgtgatgccgcgggcggcaagccagtcggccagctcgcccgacgcgaccacgtacggctcgccgctcgggtgattgagggtctgcagcgcacgccacgtcatcggccagtgcatgccgagcccgatcgccttcgagaacgcttccttcgcggaaaagcgcgtcgcgaggaacgcgatgccgcgcgcctcggagcgggcgcggcgcgcatggaacacgcgcagctcgtcggggcccagcaccttctcggcaaaccggccgcccgtgcgttcgagcacggccgcgacgcggctcacctgtgcgatgtcggtaccgatgccgtagatcgccatgtcagtacgcgccggtgtggcccggctgagccgggtcaggcatgacgtgcgatgcgcggcggcctttcatcttcaacgcgcgccgccatgcagcgcggcgacgcgtgcggcgaccatgatcgccttcatttcgcgcaccgcattgtcccagcccgtgaaaatcgcgtgcgcgacgatcgcatggccgatgttcagctcgacgatgccgtcgatcgcggcaatctgctgcacgttcgtgtagtgcagcccgtgaccggcattgaccttcaggccaagctgcgcaccggcctgtacgcccgcgacgatgcgctcgtattcacgctgctgctcggcttcgtcgtgcgcttcggcataacggcccgtatgcagctcgatcaccggcgcgcctgcttcgtgcgcggcacggatctgcgtctcgtccgggtcgatgaacagcgacacgcgcacgcccacgtcggcaagctgcttgcacgccgcacgcacggcctcgaagcggccggcgacatcgagaccgccttcggtcgtcagttcctcgcgcttttcgggcacgaggcacgcgtcgtgcgggcgcacttcgcaggcgatatcgagcatctcggccgtcaccgcgcattcgagattcatgcgcgtcttcagcagcgggcgcagcttgcgcacatccgcatcgacgatgtggcgacgatcctcgcgcagatgcagcgtgatcgcgtcggcgccggcttcctcggcggcgagcgcggcgcggatcggatcgggataggtcgtgccgcgcgcattgcgcagcgtcgcgacgtggtcgatgttcacgccgaggtcgatggcggtgggcgttgtcaggaagaagctcataggttttgcaggtcgatcaggatctgacgcgtggcaagcggcgtaccgccgagataggtgttcagcaggaagcgcatcagcgtcttgctttgcgcaaccgtctgggctcgatggtaatcgtcctgctccatgtcgagcaacgtctgcccggaaatgaccggccagtgcgacggaacttcgtcgtccgcgttgcgcacgccacgctcgggatcgaacacgtagcggcggtcaggctcgaccgcgcggcgcgcgaccgtgcggttcagcgccatcgcgtagccggtctcgcgcaacagcacgcgctcgaacgagcgcagtacctgcaccgcgggctcgccgtgggcgaggcgcgtgagggtcagcacgtagtgattgaagagcggcggctggggatcctcgcgcgcgcagaatttcacgagcagctcgttcgcgtagaagccgcacagcagcccgtcgccgccgagcggcagcatcccgccgacccactcggcgcccgtcagcgtgcgcacctcggatttgcccgaccacgacagcagcagcggctggaaagtctgcagtacgccgcgcagcgcgggcgcttcgcgcccttcgcgacgagcgcgagccggccgtgatcgcgcgtcagcacgtcgacgatcaggctcgtttcacgatacgggtaactgtgcagcacgaacgccggctgctcggcgacgcggaaatcggacgtgcgagacgtcgcgcgccgcgccttgcgcggcggttcgggcggtgccggcagcggcgcatcgttcgcgccggccgtcaccgcgtcttcggtcgacgtcagtgcgtcattcgtacccataggcgcgcagccctgcctcgttgtcggcccagccgctcttcaccttcacgaaggtctcgagatacacggggccgtcgaacagcttctccatgtccatccgcgcctcggtgctgatctgcttgagcttctcgcccttcttgccgatcaccatcgccttgtgcgaatcgcgctcgacgaggatcgtcgcgaagatgcgcttcaggcgcccttcctcctcgaacttgtcgatcagcacggtgctcgtgtacggcagttcgtcgccggtccagcggaacaccttctcgcgcaggatttcggcggcgaggaagcgcgagctgcggtcggtcagctcgtcctcgccgtagatcggctcgccttccggcaggtacggcttgatcgtgtccagcaggcgcttgatgtcttccggacgctgcgccgacagcggcacgagctcggtgaattcgcgcagcgtgctcatctgctgcatgaacgggaacagcgacgccttgtcggtcacgcggtcgatcttgttcgcgatcagcagcgtcggcatgcccggcgggatcaggtcgagcaccttctggtcgtcgggcccgaaacggccggcctcgatcacgaacaggatcacgtcgaccgacgtgagcgtcgacgtgaccgcgcggttcagcgaacggttcagcgcggtgctgtggcgggtctggaagcccggcgtgtcgacgaacacgaattgcgcgtcgtcgaacgtattgatgccggtgatgcggtggcgggtcgtctgcgccttgcgcgacgtgatgctgatcttctggccgacgagtgcgttcatcaacgtcgacttgccgacgttcgggcggcccacgatcgcgatcatgccgcaacggaaaccggtaggagcgggagtgttcatatcgtttgggagacaggttcggaaacggccgcgcggcgcggcacgatcgatgggcaattcagtggtcggcatcggccacgcgcgcctgcgcggcagcgaggctcacgccgcccggcggcgtctcggaatccggtgccgccgtgtcgcgcgtgcgcgcagccgtgcgcgaagcggagtcggtaccggcggaagtcttgtcggcagacgcgggggccggatcggcggcctgcgcagccggcttgtcggctgcgcgtgcggcgggcacggcttcagcgggcttctccgcggacttgtcgggtcgctcggccggcttttcagctggcttctcggcagccttgtcgaccgccggcttcgccgcccgctcacccttctcggcaactgcgtcgacatgcgccgcgcgaatcgcggccatcggcgccgcggccggctcattaccggtcgctgcggccgccgcgggcgctgcaccagccgccctcgcctcgcgcgccgccgcgcgttccttgcgctccggcgagcgcaggtcgagtgcttcctgcacgcccttcacgcccggtacgatttcgggttcgacatgcttcgacccgcgtgcgtttttcgagcgcttcggcttggcggccagcatcggcgcggccgccatcacctcgtcgagcgccttcttcgcggcggcctgctcggccgcgcgccggctcgcaccggagcccgacaccttcacgtcgagcttcggcaccgtgcattcgacttcgaattgctgattgtgcgccgcaccatgcgtggcgaccaccgtgtaggtcggcagcgcgatcttgtgcccctgcaggtattcctgcagcagcgtcttcgcgtccttgccgagcgtgcgcggatcgatgtggtcgagaatcgggatatagaggcgcttgatgaccccttgggcggcttcgaagccgccatcgaggaacacggccccgatgatggcttcgaacgcgtccgcgaggatcgacgggcggcggaacccgccgctgcgcaactcccctcgccgagccgcagcccgtccgagatattcagggcctgagcaatttcgtacagcgactgctgtttgacgaggttggcgcgtacgcgcgacagatcgccttcgtccagcttgctgaaacgctggaacaaagggcagccaccgcgcaattcagaacggaatcgccgagaaactcgagccgttcgttgtgcgtggcactgtgactacgatgggtcaaagcctggcgcaacaattccgcattgcgaaattcgtagcgcagccggctttccaactgggataggggcatgtgcaggagtataacgcgggcgccggtcgggccgaaacggcacggccggacgcgaaaaggcgtgacgaggcggtgttaccgccggttcttaaagtagttcggcaatacgcgacgcggcccgtgcgtcgcgtattgcgagtgacccggatgcgatcagttgaaggaaccgatgcgcttgaggtcgctgaagttcatccagatgaagaacgcgcggccgacgatgttctggtccggcacgaaaccccagtagcggctgtccgcactgttgtcgcggttgtcgcccatcatgaagtagtgaccgggcggcaccttgcagatcacgccgcggctgttgtacgtgcagttgtcgcgaaacggatagtcgtatgcgcccatcacgaacggcggcacggccgggttgttgaggatcgcgttcttcttgttgccgatcgtttcctcgaactgcttcgcgtaattctggcgctcgtcgtcgaagaaatcgggcagcggcgtttcgggcaccggctggccgttgatcgtgagctgcttgtcctggtatgcgacggtgtcgcccggcaggccgatcacgcgcttgatgtagtcgaccgactcgtccttcggatagcggaacacgacgacgtcgccgcgcgacagcgggctgccctgcgtgatcttcgtgttcgtcaccggcaggcgcagcccgtattcgaacttgttgacgaggatgaagtcgccgacgagcagcgtcggcaccatcgagcccgacggaatcttgaacggctcgacgacgaacgaacgcacgacgaacaccgccaggatcaccgggaagaagctcgcggtgtactcgagccaccacggctgacgcagcttttcgtcgcgcagcttcgaacgcgtctgcaccgcgttttcatccgcgaaacgcttgtcgatgcgcgactgctggcgatcgaactcctcgatcgccgagtcggccgccttgcgtcgctgcggcaggaacaccagtttgtccagcacccacgctacgcccgtcaagatgacgagcacaaaagaatcagcgcaaaattcataaaaggaacagtcctgttatttgtcttcgacgcgcaagatcgcaaggaacgcttcctgcgggatctcgaccgaacccacctgcttcatccgtttcttgccttccttctgcttttcgagcagcttcttctttcgcgtgatgtcaccgccgtagcacttcgcaagcacgttctttcgcagcgccttgatgttctcgcgcgcaacgatgtgcgcgccgatcgcggcctggatcgccacgtcgtacatctggcgcgggatgatctcgcgcatcttcgcggccacttcgcggccgcggtattgcgactgcgagcggtgcacgatgatcgacagcgcatcgaccttgtcgccgttgatcagcatgtcgaccttcacgacgtccgacgaacggtattccttgaactcgtagtccatcgacgcgtagccgcgcgacaccgacttcaggcgatcgaagaaatcgagcacgatctcggccatcgggatctcgtacgtgagctgcacctggcggccgtgatactgcatgttgatctgcgagccgcgcttctgctcgcacagcgtgatcaccgagcccacgtagtcctgcggcatgtacaggttcacggtgacgatcggctcgcgcacttcggcgatacggccgggctccggcatcttcgccgggttctcgaccatgatcgtcgagccgtcgctctgcacgacctcgtagacgaccgtcggtgcggtcgtgatgagatccatgtcgaactcgcgctcgagccgctcctgcacgatttccatgtgcagcagcccgaggaagccgcagcggaaaccgaaaccgagcgcctgcgacacttccggctcgtactgcagcgacgcgtcgttcagcttcagcttctcgagcgattcgcgcagcgcgtcgtactggttcgcctcgaccggatacagccccgcgaacacctgcggcttcacttccttgaagcccggcagcggctcggcggcagccttggtcgcatgcgtgacggtatcgccgaccttcgcggccgtcagttccttgatgccggcgatgatgaagccgacctgcccggccgacagcgattcgagattgcgcgatttcggcgtgaacacgccgacgtgctcgaccggatactgcgcgccggtcgccatcatcttgatcttgtccttcggacgcagtgtgccgttgacgatgcgcaccagcatcacaacgccgacgtagttgtcgaaccacgagtcgatgatcagcgcctgcagcggcgcggccggatcgcccttcggcggcggcaccttcgcgatcagcgcttcgagcacgtcctcgacgccgaggcccgtcttcgcgctgcagcgcgtcgcgtcggtcgcgtcgatgccgatcacgtcctcgatctcctcgatcgcgttctcggggttcgcggccggcaggtcgattttgttcagcacgggaacgacctcgacgccgagctcgatcgccgtatagcagttcgcgaccgtctgcgcctcgacgccctggctcgcatcgacgaccagcagcgcgccttcgcacgcggacagcgaacggctgacttcgtacgagaagtcgacgtgccccggcgtgtcgatcaggttcaggttgtagaccttgccgtcgcgcgcgcgataggacagcgcggctgtctgcgccttgatcgtgatgccgcgctcgcgctcgatatccatcgagtcgagcacctgcgcttccatttcacggtcggcgaggccgccgcatacctggatgatgcgatccgcgagcgtcgacttgccatggtcgatgtgcgcgatgatcgagaaattgcgaatatgatccattcagtgccgatcaagcgaaaaaggcgcgctcgacgaccgctgagcacgccttgtgtaagtcggtgaaaaacggcttattttagccgaaaaggccttcgccgggcggtatttccaacgccggcccgcgcggcaccctgccggggccgcccgccgggcaaagcccggtgccaggcgccgccgcaaggcggcagcccggcttcagcgccgggccgcgagcgcgtcgtgcaccttcgcggcgtcgaaccggtggcggcacacttccgcaccgtccagcagcagcacgggcacgtcctcgtcgtagcgggcgacgagtgccgcatcggtatcgatgtcgatgtaatcgaccgcaacaccgaattcggccgccaccggcgccagggcgtcgcgcatgtcgtcgcacaggtggcaccagctgcggccgtagagcgtgaacatcagcgcgttatttctggcgcggccgcacgggcacgaactgcgtgttgtcgccgcgccgcacgagtaccgcgaccgccttctgcggatcgagctgcgcggtcacttcggcgaactgcttcgcgttcgtgatgtcggtgtcgccgacacgcagcacgatgtcgccgcgctgcaagcccgcacgggcggccgggccgtcgacgccgtcgatctgcacgccgttcttcagcttcagcgtcttcatctgctccgccgtcaggtcgctgaccgtcagaccgagcgagttggcctggcgcggcttctgcggcgcgttcttgcgctgctcggccttcgccgtcgattcggccggggtttccgcgatcgtgatcggcagatcgcgtgcctgacccttgcgccacacgctgaccgtcgccttcgtgcccggcttcgtgtcgccaaccatgcgcggcagatccgacgccgtgtcgaccgaacggccattgaacttcaggatgatgtcgcccggctggatgcccgccttgtcggccggaccgcccggctcgacgctgctgacgagcgcgccctccgccttcggcagcccgatcgagtcggccacgtccttcgtcacttcgccgatcgccaccgcgatccggccgcgcgtgaccttgcccgtcgccttcagctggtcggccacgcgcatcgcctcgtcgatcggaatcgcgaacgagatgcccatgaagccgccggtacggctgtagatctgcgagttgatgccgatcacctcgccctgcatgttgatcagcgggccgcccgagttgccggggttcacggcgacgtcggtctggatgaacggcaggtagtcgcccgtgttgcggctcttcgagctgacgatgccggccgtcaccgtgttgtcgaggccgaacggcgaaccgatcgcgacgacccactcgccgacacgcaccttgttcgaatcgccgatcgcgacgaccggcaggttcgacgcctggatcttgacgaccgcgacgtccgtgcgatcgtcgacgccgatcagcttcgccttgaattcgcgcttgtcggtcagcgtcacgtagatggtgtccgcatcgtcgacgacgtgcgcattggtcatcacgtaaccgtcggccgacacgatgaaacccgagccgacgccgcgattctgttcggtgtcgggcggattgtccggcgccggcgcgttcttcggattgccgccgccgttgccgggcgcctgcggcagcggaatgccgaagaagcgccggaagaattccgacatgtcgccgttgtcgaagcccggcgggagcatcccgcgcgggccgctgctagtcggcacgttggcggtggtccggatgttcacgacggccggcccgaccttttcgaccagatcggcgaagtcaggcaggctggcagcgggagccgtcaccgcgaccgcggtatgtggcacgagcggcaggcaggcagacagcgccgccgccgcgagccatttgcgcagcgtgagtttcatcatgtcggaagccgtagcgttacttggaagccttgtattctatggcagacgcgaactgctgcaacgtagccggcggcacttcgccgagcacggtgatccagtagtcgccgcggcgcttcacgagaacgttcgttgcaccggtgctgcccgcgccttccttgcgcgtattcttttcggccggctcgatgaaaaccgaaatcgtcgcgagaccgtcagtgaagacggcctgatcgaccggaatcggcggctcacccgcgtcgcgcgcggccatcggccggcgcacttcgcgaatcttctggaaaccggcgacactcggtgcgagttgccagccctgcgcttccatgtcgaccgtcgcgaccggcggacgtacgactgtccagccgctcaggttgcgcatgccggccgcgatcgcggccttgtcgccgtttgcgccgcccgtctgcaattgcgagaacgcgatctgctcgagcacgtgatcgttcgcatcgagcgtctgcgaacgcagcagcagccccgtgcgcgcatcggcccacagcttgtacgtgaagcggtatgcgtccttcggcacgagctcgacgacctgcgcgtcgatccccgcgacacgatccttgccgagcgacttcgcgtcgtagacggacatcacgtgctcgccgctcgcgccgagcagcgcggggaacgagtcgcgcgtctgacggcgctcgaccacgcacagcttgcgctcgggtacgaacgtgtacagctcgtcgttgtggcgcagcagcttgcgcggcttgccgtcgagcgtctcgatgcgttcgaactcgccgtcgcgggacgcgacgtgcgcaatgcgcgacgactgcacatacccgccgcgctgatagacgaacgtgccttcgtagctctgctgctgcgccgcttgctggacgcggtcgagccagtccgcggcacccttgcgggtcgcgacgggatcgtccggttgctgggcgctggcaggaagggattgaacggacaacagggcggctgcgcaaagcaggagggccggcagccgcttccatccggagatggtttgattcaactgcaatgtccgcatcgggtttattggcctggcgtggtggtcacggcagcgcggatcagcggcatcgaacccgtgacgacgggctgctgcgcgaattgctggtgcgcttcaaggtattggtcgaggctggcgtcgcggatgatgttgacgtcctgcagccccggctgggccgatgcctgcgcaaccgtcacgcgctgcaggttgccgccttgcggcgcaccggccgacgcgacctggacggcgcccggggcaccggccgtctgcatttgcgggacgacgatccacgtcagcgtggccgccgcggcggcaaccgcgaacgcgggcacgacgcgccggcgcagcgacagcagcttgcgcgcgacgggcgcggccgccggcgcgagcaggtgcggctcgctttcgagcgcagccgacatgcgcgcggtgaacgcgacgctcagcgcgggcgacagcgccagttcgtccgagcgcagcgcatcgccgatcaggtggtaatgggcccacgcagcgcgatccgcgcggttgagctcagccagaaactgcccgttgtccgggccatcgaacatttcgccgtcgaccagcgcggaaggcgctcgccgcgcgagcacgcttgcgactgcgtattgaccgaccccatgatgctccccatcttgcacaccccgtcgtgacttcacgactctaaccgtaactagaccccgacccgcgtcgctccgcctgtcgcgcttaccagcgcttgccttcgggcgtatcgagcagcggacgcaatttggcagcgattgcctcgcgtgcacggaagatccgcgaccggaccgtcccgatcggacagcccatcatttccgcgatctcttcgtagctcaggccctcgatctcgcgcagcgtaattgcctggcgcagttcctcgggcagcagagccatggcagcgttgaccgtctcggcaatctgcttgctcatcaacatcgactcaggcgtgttgatatcccttagttggtctgcgtcggagaaagtttccgcttcctccgcatcggcctcggtcgaggtcggcgcccggcggccttgcgtcgcaaggtagttcttcgccgtgttgacggcaattcggtacaaccacgtatagaacgccgattcgccgcggaattgcggcagcgcacgatacgccttgatgaacgcgtcctgggccacatcctcgacctcggcgggatcccgcacgaggcgcgagatcagccgaatgatcttgcggtggtatttggagaccaggagttcgaacgccgccttgtcgcccttctgtacgcgttcgaccagagcctgatcgatttctttttcactcacctgacaaatccgttaactagggatgcaacgcggagcgtcattgtaacgttcccgcgccggacgctggttacggtacgtaaccgcgccgccgtcatgcccgccccgccgcgcccgccgtcttcgccagcacggaaagcgcgctgaacgatgcggcgtcgagcgcatcggccggaatcagcagcggccgggcccgccgggcaccctgcccgaccgacagcaccagcagcaggctgctccagtgcgcatgccccgtcacgcggccacgggccagcaggcgcccggtgcggccaaacgccgcaatttccccgaacgcgtcgatccgcagctcggccggcagccggcgggcacaggcccgtgcggcgcatacggccagcagcgcagccgtcacggctgacacgcatgcgcccgcagcagcgccgcgcgcggcgcccagaacaggtaggccgacgcggcagccgacgcgacgaacgcggccagcacgacatatgacacggccgaggcccgcaacgcaaagcgctgcggacgcccggccggcgcatcgaatggactcgtcaagtgactgcggcgtcagacgcgcttgaacaccagcgtgccgttggtaccgccgaagccgaagttgttcttcacggccacgtcgatcttcatgtcacgtgcggtgttcgcgcagtaatcgagatcgcactcggggtcctggttgaagatgttgatggtcggcggcgacacgttgttgtgcagcgcgagcaccgtgaacaccgactcgaggccgcccgcgccgcccagcaggtggcccgtcatcgacttcgtcgagttcacgacgatcttgtacgcatgctcgccgaaagccgccttcaccgcgtcggactcgttcttgtcgcccagcggcgtcgacgtgccatgcgcgttcaggtactggacctcgtccgcgttcacgccggcgtcgcgcagtgccgcgaccatgcagcggcgcgggccgtccatgttcggcgcggtcatgtggtacgcatcgcccgtcatgccgaagcccgagacttccgcgtagatcttcgcaccgcgcgccttcgccgcttcgtattcctccagcaccatcacgcccgcaccttcgcccagcacgaagccgtcgcggtccttgtcccacggtcgggacgcggtggccggatcgtcgttgcgggtcgacagcgcgcgcgctgccgcgaaaccgccgatgccgagcggcgacaccgtcgattcggcgccgcccgcgaccatcacgtcggcgtcgccggcctggatcaggcgcgccgcgaggccgatgctgtgcaggccggtcgtgcaggccgtgacggccgcgaggttcgggcccttcaggccgaacatgatgctcaggtgacccgagatcatgttgatgatcgaacccggcacgaagaacggcgaaatccggcgcgcgccgcgatcgacgtaggtctggtgcgtatcttcgatcatcggcaggccgccgatgccggaaccgaccagcacgccgatgcgttccgcattggtttcattcacttccagcccgctgtccttgatggcctggacgccggcggcgatgccgtaatggatgaacgtatccatgttccgggcttccttcgccgggatgtactcctcggcgctgaacccttcacttcgcccgcgaaatggacggcgaggttcgacgggtcgaacttcgtgacggtggcaatgccggacttgccggcgacgagattggcccagccgtcggcaacattattgccaacaggcgaaatcagccccaggcctgtaacaacaacacgacggcggctcacggtaacctcttttccattattggatgacaaaaacaaaagccacagtggccacaggaaccagccctgcgagccctgtggctgttagtccgtccggcgcgaggccggcaggatggcgcgtcaatcgcgaagatcgcggcgacgtggcggacaagcgcgaaaggcgcctgttacgccttgacgtttgcgcgagcgtagtcgatcgcttgctgaacggtcgtgatcttctctgcttcttcgtccgggatttccatgccgaactcgtcttcgagagccatcaccagttcgacggtgtcgagcgagtcggcgcccaggtcgttcacgaacgaagcttcgttcttgatctcggcttccgcgacgcccagttgttcagcgacgatcttcttgacacgttgttcgatgttgtccattacccctccgagggaaagttcagatttacaagtgcgcgcattttatcaggtttgctgacgccaaaacgcgcgttggcttgatggtcgatcaagcgccgatccgcctgaaaaacgggatacggcgcggatggtaaacgaaaatcgttacgacatgtacatgccgccgttcacgtgcagcgtcgtaccggtgatgtaaccggcctgcggcgatgcgaggaacgcgacggcatgggcaatgtcttccgggctgccgaggcggccgagcggaatctgggtcttgagcgcggcctgctgttcttccggcagcgtcttcgtcatgtcggtgtcgatgaagcccggcgccacacagttcacggtgatgccgcggctgccgatttcacgtgcgagcgcacgggtcatgcccgcgacgccggccttcgcagccgcgtagttgacctggcccgggttaccggccgagccgaccaccgacgtgatgttgatgatgcggccgccacgcgccttcatcatcgggcgcagcaccgcgcgcgacaggcggaacaccgacttcaggttggtgtcgatcaccgcgtcccagtcctcgtccttcatccgcatcgcgagctggtcctgcgtgatgcccgcgttgttgacgagcacgttcagcgcaccgaattccttcacggtcgcgtcgatcagcgcctcggcggctgccgcgtcgttgacgttcagcaccgcaccgcgacccgtgacgcccgcttccgcgaacgccgcggtgatcgctgcagcgcccgactcactcgtcgccgtgccgatcaccgtcgcgcccaggcgcgcgagttcgagcgcgatcgaacggccgatgccgcgcgatgcgccggtaacgatcgcaacctgtttatcgagagtcttgtccatgaatcgaatatccgtctcttgagaaaaggcgccgcgtcaggcggtcaccagcttgagcgcttcgtcgagcgacgccggatcgaacaccgacgcacccgtcaggttgccgtcgatgcgcttcgtcaggccggcgagcaccttgcccggaccgcattcgatcacgtgcgtgacgcccgtgcctgcgatgtgctgcacgcactcgacccagcgcaccgggcccgcggcctggcgcaccagcgcgtccttgatcgcggccggatcgctgaccacggcgacgtcgatgttgttgacgaccggaatctgcggcgccttcacgtcgacgttcgcgaggtagtcgcgcaactgatccgacgccggcttgagcagcgacgaatggaacggcgccgacaccggcagcggcagcgcgcgcttcgcgcccttcgccttcgcgatctcgcaggccttttcgaccgcggccttgttgcctgcgataacgacctgtgcgggtgcattgaagttcactgcttcgacgacgcccgcttccgcggcttccgcgcataccgcacgcaccgtgtcgtcatcgagccccaggatcgcggccatgccgccctggccgaccggcacggccgtctgcatcgcctgcgcgcgaaagcgcacgagcggcacggcatccttgaacgcgagcgcgccggcggcgacgagcgccgtgtattcgccgaggctgtggccggcgacgatcgacggcgccgggccgcccgcctgctgccacgcgcgatagcacgcataggccgcggtcaacatcacgggctgcgtgttggtggtgaggttcagctcttcggccgggccttcggcgatcagcttgccgagatcctgattgagtgcatcggacgcttcctggagcgtctcgcgcacgacggccagatcggcgaatgcgttgagcatgccgaccgcctgcgagccctgccccggaaatacgaatgcaaatttcatatcgtccccaattgaatcgattcggacggcgcgcgcgaatggcgcgccggtgggatccgcgcgcagcagtcgcgcgccgcggatcagtagcggaagaccgacgcgccccaggtgaagccgccgccgacgccttcgatcagcacgtgctggccacgctggatgcgaccgtcgcgtaccgcggtgtcgagcgccagcgggatcgacgcggccgacgtattgccgtgctggtcgaccgtcacgaccatgcgctcctgcggcaggccgagcttgcggcaggtgctggtcatgatgcggatgttggcctggtgcggaatcagccagtcgatctgctcgggcgcgagattcgccttcgcgagcgcctcgatcgcgaccttctcgagcacgttgaccgcgagcttgaacacggcctgcccgtccatgtacaggaacgcactgccttcgatcacgccgcggttgacgttgcccggcgtgcagaggatatgcgagtagctgccgtccgcgtgcagcgcgctgccgagcacgcccggctcttccgacgcggacaggatcaccgcgcccgcgccgtcgccgaacagcacgcaggtcgtgcggtccttgaagtcgagaatgcgcgagaacgtctccgcgcccaccacgagcgcggtgcggtgctggccgctgcggatgaagctgtcggccgtcgccatcgcgtacgcgaagcccgaacacacggcctgcacgtcgaaggccgcgccgccgttcttgatgccgagcttgttctgcagcaggcacgcggtgctcgggaacacgaaatcgggggtcgaagtcgcgacgatgatcaggtcgatcgactgcggatcgatgccggcggcctcgatcgcgcgacgcgacgcctcgagcgcgaggtcgctggtcgtgacgtccggtgcggcgaaatggcgcgcatggatgcccgtgcgcgcaacgatccattcatcgctcgtctcgatgccttccttcgcaagacgatcggtcaactgctggttcgtgacgcggtcaggcggcaggtagctgcccgtgccgagcacgcgggaatagagagtcgattgggccatttatgctttagaggattgcgcagcggaaggttcggcgtgatggcctgcggcggggcttgcatggcccgcgccgcccgcgttgtgttcgccgtcgccgagcgacaccgaattatccgccatcgcacgcgtgaggcgctccagcacgccgtttttgacggcatcatacccgcgtttgattgcccactcaaacgcgtaggcatcggccgaaccatggctcttgatcacgaggctcttcagccccagcagcgccgcgccgttgtactggcggtgatcgacgcgcttcttgaaacgcatcaggacaggcagcgcgagcagcgccatcagcttcgacatcagcgaacggccgaactcttcgcggatgatgtccgacagcatctgcgcgagccctcggacgtcttcagcgcgacgttgccgacgaagccgtcgcacacgatcacgtcgaccgtgcccttgtagatgtcgttgccttcgacgttgccacggaagttgagcgtgctggcgcgcagcagttcgcctgcgcgcttgatcgtctcgttgcccttgatcatctcttcgccgatgttcaagaggccgatcgtcggacgctccttgccttccagcgcagccacgagcgcgtgccccatttccgcgaactgcagcaggtgctgcggctcgcagtcgacgttcgcgccgaggtccagcatcatcgtgtagccggtcgggttcggcagcgcgaacgcgatcgcgggccgctcgatgccgggcagcgtcttgagtacgtaacgggaaacggccatcagcgcgccggtattgccggcggagatgcaggcctgcgccgcgccttccttgacgtggttgagtgcgacgcgcatcgaagaatccttcttcttgcgcagcgccacttcgacagggtcgtccatcgccacgacttcggtggcgggaacgatggtcagcgcgggatcgtcgaggactttcagctttttcagctgagcgcggatcgcgctttcgatgccgacgagcatcaggtgcgcatcgggatgcgcgcggacgaacttgactgccgcgggaacggtcacggacgggccgtggtcgcctcccatgcaatcgattgtgagctttacggtcatggaatgcgacgaatttcaggcacaaaaagcggcagttgaatgccgccttttgttgagccaggaaagtgtcaagcgaaccagttgtcacgcgaacggcaaacgtagcgcgcaacgcgtgacttgacgcttagtcgttcttcgtcttgacgactttcttgccgcggtagtagccgttcgggctgacatggtgacgcaggtgcacttcacccgtgctcggctcgactgccagcggcgctgccgtcaggaaatcgtgcgaacgatgcatgccgcgcttcgacggcgacttcttgttttgctggactgccatgactaactcctaaataattttccggattctaacacagcccgatccggcgcttaactaccctggcccaaagcctttacgccttcccgcgccacaactgcttagtgtttcttggtgccgtcaccgcccttcttcagcgcttccagcgccgcgaacggattcggccgtttgccttcgtccccggcttcgtcggactcctcgtccgtctcttccgcgggaccgctcgcaccgacacgaggctttcgtgaactgccgggcaaacctcgtgcttgggcacgagcggcaacgaaagcagcaattcctcttcgatcaagtcgacgagatcgaactggcgtgagcccacgatcacatcggcttcatcgtcgtcgagcggaaattcttcagcttcttcttcggtcgcgacgacccggtacgtcatgtcgacgtcgaacgtctggtcgtacggggtcatgcagcgctggcacgtgagccacgcatgaccgtgcaccgcgaggcgcagatacggctgctgcccgtcggcgccgtcgtcctgcaactccttctgggtgaacccttctgcctgccatgtgaagaccgtgtcgcgatctggcgcgtccgcgggcacttcgtttaacatgcgcggcagttgcgagaggtgcaccgcgcctgctgcctgccgcccgctgcgggcgaactcgaacaggtcgactgcatgcggatcaagtggcgccgcagcaggtttgccagaagaagtgttcatgtgcgctcctgcctacaggctgacttgcggatccggcttggtaccgctcgcgtacgggtgaccgtactttacttccgaagacccggcaggcgccaccacaacggaagcctgccgacgaaaagcgggaaagcatacctgttttaccttttgcagtcaatcacttaagcttgcgtccgcagcaacgctgcgcaacacccgacgactcaccaatcccaccgaccatgccggataccgtttgccgcccgccgcggctgattcttgcctccagttcacgctaccgccgcgcgctcctcgagcgcctcggcaccccttcgacgtcgtgtcgcccgacctcgacgaaaccccgcacgacggcgagacgccggccgcgaccgcactgcgccttgcgggcgcgaaagcgcgcgccgtcgctgcgacgatcgacgcgccggacggcgtgctcgtaatcgggtccgaccaggtcgcgaccttcgacgggctccagatcggcaaacccggcacgcatgagcgcgcgctcgcgcaactcgtgtcgatgcagggccgcgaagtcgaattccacagcgcgctctgcctgtatgacagccgcacgggcgaagcgcaggtcgaggacgtcgtcacgcgcgtgcgtttccgctcgctgcccgaggccgaactcgatgcgtacctgcgcgcggaaacgccgtacgacgtcgccggcagcgccaagtcggaagggctcggcatcgcgctgctcgacgcgatcgactcgaacgacccgacggcactcgtcggcctgccgctgatcgcgctcacgcggatgctgcgcgccgccgaatatccgctgtttgcaaccacccgtggagaccgcacatgacggccggcacgctctatctcgttccgaacacgctcggcgaaggcgacgaatcgatgctcgcggccgtcctgcccgcggccgtgcaggcacgcgccggcacgctcggctattacatcggcgagaacgcaaagacgacgcgcgcgtttctgaagaagatcggcacgacgcgcccgatccaggaaatcgagatcagcgaactgaacgtcaatacgccggccggccagatcgaccggctgctcgcgcccgtgctggccggtgcggacgccggcctcgtatccgaagccggctgcccggccgtcgccgatcccggcgcgttgctggtgcgccgcgcacatgagcgcggcgtgaaggtcgtgccgctcgtcgggccgagttcgatcctgctcgcgctgatggcatcgggcctgaacggccagagcttcgcgttcaacggctacctgccggtcgacgcggccgcgcgcgcgaaacgcctgcgcgaactcgagcagctgtcacgcaaggcgcgccagacgcagatcttcatcgaaacgccgtaccggaatcaggcgatgctcgacacgctcgtcgcgacctgcgcaccgtcgacgcagatctgcgtcgcggccgacctgaccctcgcgaccgagacgatcgcgagccgcaccgtgacggactggaaaaaggcgcctgcgccgaatctgcacaagcgccctgcgatcttcctgctgctggcgaactgaagccgcgaccggcggctgcccggcagccgatcggcgggccatcgcggcccgcccgcttccggtcagcgcaggctgaccgacgcgccgccggccgtcagcgccttcatcgcggcgccgccgacggctgcgccgaacttgcgcgcgacacggttcgtcaggctttccttcaccgtatagtcgacgagatcgggcgccttcagcacgtcgcgcgcgaccgtgtcggtcgtgccgaagccgtcggcgagcccgagctcgacgctcttctcgccggtccagaacaggcccgagaacatgtcgggcgtctcgtgcagccgcttgccgcggccatccttcaccgccttgatgaattgcgcgtgcacctggtcgagcaacgcctgcgcatgcgcgtccatcttcggcgtgtcgggcgagaacgggtcgtagaagcccttgttttcgcccgaggtatgcaggcgccgctcgacgccgagcttgcccatcaggccggtaaagccgaacccgtccatcagcacgccgatcgacccgacgatgctcgccttgtcgacgaagatcttgtcggccgcggccgcgatgtaatagccgcccgatgcacacatgtcggtcacgacgacgtacagcggcttgtccggatgcttcgcgcgcagccgccggatctcgtcgtagaccatcccggcctgcaccgggctgccgcccgggctgttgatccgcagcacgacgccggccgtaccgtcgtcgtcgaacgcggcgtcgagcgccgtgttgatgtcgtcggcgttcgcgttgacgccggcggcgatctcgccgtcgatcgtcacgagcgctgtatgccgcccgctcgccgagaacttcgcatcgctcgagaaatcgatcagcgcgaacgcaagcagcacgaacacgccgaggaacgcgaagcggaagaagatcttccagcgccgtgccgcgcgctgctcctgacggccgcgagcgcgatccgctcgagcgccgcacgctcccagttcggttcacggctgtcgggacgggaggaggaatccgggaattcggttggtcggccatgcggtgttgtcgtcagtcggtcgtggcggaaacggcgggacgcaggtcggcgtcgggcacccagaataccgcacgcccgtcggccgtgtcgcgctcgtcgacctcgaccggccgcagccggccgccgcggcacgggccgccgacgcacttgccggtgttcggctcgtagatcgcgccatgcgtcgcgcacatcaggtagaggcccgacgattcgaagaactgcccttcggcccagtcgagctccatcggcacatgcgcgcagcggttcaggtaaccgtatgcgcgcccctcgtagcgcacgaagaacacgacggcctgctcgccgcgcagcgtcgcgtcgacgcgcacgccggcaccgccgtcggcgagggcatccgatgcgcacacacgcatcgcgtccggcgccgcgctcatgcgtgctcccgcaaccacgcggccagcgcttcgacgtccggcgcgacgaagcgcggcgtgagcgcagccagcgcatcggccgtgtgcgcgccgtaagcgacaccgacgccggccgccccggcactcgcggccatctgcaggtcgtgcgtcgtgtcgccgatcatcacggtgcgagaaagatcctgccccagttcccgggacagctcgtgcagcatcgccggatggggtttggagaaagtctcgtccgcgcagcgcgtcgcatcgaacaggctcgtcagcttcgactggtcgagcacgcgattcagcccgacccggcccttgccggttgccaccgcgagcagataaccggtgtcgcgcagctcggcgagcagttcgcgcacgccggcgaacagctcgatgcgctggtcgtcgagcagatagtggtagcggtagcgctcggcgagccgcgaatagtcggacggatcgagggtcggagcggtaatctgcagcgcgtcgcgcaggccgaggccgatcacgtagcgcgacgcctcgtcggacggcgtgggcaggccgagatcgcggcatgcggcctggatgctgtgcgcgatgtgcgcagtcgaatccatcagcgtgccgtcccagtcgaagacgatcaggtcaaattgctgtcgagccatgcggttcaggttcaggcggtatcgcgcaatgcgctgagttgatcgaggaagcgccggcattcgtccggcagcggcgcatcgaactgcagcgcctcgccggtcagcgggtgggcgagccgcagccggtgcgcatgcaggaacatccgtttcaacgacggctgcgcattcgcgcgcgccagcgccttgttcagtgcgaaatcgccatacttggcgtcaccggcgatcggcaggccgagatgggcgagatgcacccggatctgatgggtccgacccgttttgagttccgcttcgacgagcgcgtagtccggccagcggtcgacgaggttgaacaccgtatgcgacggcagcccgtcgtcctgcacgcgcacgcggcgctccccttccggggtcgaatacttgaacagcggcgccttcaccgcgcgacggcggccccagtcgggctgccattcgccgtgcacgcacgcgaagtagcgcttgtccatccggttctcgcgaatctgctcgtgcaggcccaccagcgccgtgcgcttcttcgcgagcatcaggatcccggacgtctcgcggtcgagccggtgcacgagttcgaggaacttcgcacgcgggcgcgcctggcgcatctgctcgatcacgccgaacgcgacgccgctgccaccgtggaccgcgacccccgccggcttgtcgatgacgagcatcgcgtcgtcctcgtacagcacgtggaaattcgcgggcggcacgacgggcgtgtcggcgcgcgcgaggtccgccgccgccacgcgcacgggcggcacgcggacgatgtcgccaagggccagacggtactgcgcgtcgatccggcccttgttcacacgcacttcgccgctgcgcaggatccggtaaatatggcttttgggcacgcctttacagacgcgcaacaggaagttgtcgatccgctgaccggccgagttttcgtcgatctcgatcatcgatacctggccgcttgcgaccgaattctgggatattttgcctaactcattcatactgaatataattttgcccagcttgacgttgtgggtggcctgaccggccggccccgaccgaatcgggcaaggcgcaagcgcaaactgctattttacttgcgccggggtccgctgctcgcccctaatcaaagagatgcagcaagttgcacgcacggcaccgctcgccggcaaggatcgcgcccacaggcggattcggtcggcaaggtgccgcggtaacggaaagttggttgaaaagaatttgatcggcagccagacggcgcgaagtgcgtccgcaagctgccggttgcgaaaattacggcgttgcgcccgatttggttccgcgaagcgtgcgggacttggcgacgtcaaaccagggaagtacaccccaagcgggaaagtcgggctggattcgatactcccgctgcggcccaagccgcagcatctgccgcccgtcggcgcgcgcgacgcattgcgcgcgcccgtggcaatgcccggactcaggcttagcgcgcttgtgcagcgtgcggtgtgtgaacgccgtgctttgaagccgtattcgcaggtgccctacggccgccggccccgtctttcggggcccaagcgcctcttcaggcaattctccccgccatcgttcccgctccagcgtgcttgtgacaacacaacaaggtgcggcctgccgtcgttcccgccctcgcgactgacaaccgcgaggcgccggcagcggagccgcctggagccgttcatgaaacgcatgctgttcaatgcgacgcagcaggaggagctgcgcgtcgccatcgtcgatgggcagaagctcatcgacatcgacatcgaaaccgccgggcgcgaacagcgcaaaggcaatatctacaaaggtgtcatcacccgtatcgagccgtcgctcgaagcgtgcttcgtcaattacggcgaagaccgccacgggttcctgccgttcaaggaagtcgcccgccagtatttcaaggaaggcatcgacatgcgctccgcgcgcatccaggatgcgctgcgcgaaggccaggagctgatcgtccaggtcgagaaggaagagcgcggcaacaagggcgccgccctcaccaccttcatctcgctcgccggccgctacctggtgctgatgccgaacaacccgcgcggcggcggcgtgtcgcgccggatcgaaggcgacgagcgtcaggaactgcgcgaaacgatggcgcaactgcagattccggacggcatgagcatgatcgcccgtaccgcgggcatcggccgcagcgccgaggaactgcagtgggacctgaactacctgctgcaactgtggcgcgcgatcgaagcggcgtcgcaaagcggcaacgccggccagccgatgctgatctacctggaatcgagcctcgtgatccgcgcgatccgggactatttccagcccgatatcggcgaaatcctgatcgatacgaacgagatccacgatcaggcccgtgcattcatggatatcgtgatgccggacaacgtcgcgaaggtgaagcgctaccacgacgacgtgccgctgttctcccgcttccagatcgagcaccagatcgagaccgcgtactcgcgtacggtgccgctgccgtcgggcggtgcgatcgtgattgaccacaccgaagcgctcgtcgcgatcgacgtgaactcggcgcgcgcgaccaagggcgcggacatcgaggaaacggcgacccgcacgaacctcgaagcggccgacgaagtcgcccgccagctccgcctgcgcgacctcggcggcctgatcgtgatcgatttcatcgacatggaatcggcgaagagccagcgcgaagtcgagcagcgcctgaaagacgcactcaagcatgaccgcgcgcgcgtccagatgggcaagatctcccgtttcggcctgatggaactgtcgcgccagcgcctgcgtccggccttgtcggaaggcagccacgtgacctgcccgcgttgtaacggcaccggccacatccgcgataccgaatcgtccgcgctgcaggtcctgcggatcattcaggaagaagcgatgaaggaaaacaccgcggcgatccactgccaggtgccggtcgaggtgaccgccttcctgctcaacgaaaagcgtcaggaaatcaacaagatcgagtcgcgcttcaaggtcggcatcgtgctgatcccgaacaagcacctcgatacgccgcactacaagctcgagcgcctgcgccacgacgacgcgcgtctcgacgatccgcgcgcatcctggaagatggccgaggaagcggcccgcgaactcgagtcggaaaccggctacagcaagcgcgcggcggaagtgaagccgaagcaggaagccgcggtcaagggcatcacgcccgagcgtccggcgccgagcccggcacctcagcgtccggtcgaacccgttgccgcgcccgcgcccgtcgcgccggcaagcggcggtttcatcggctggctgaagggcctgttcggtgtggcgccggctccggcgcccgcaccggttgccccggcaccggcgaaggagcaggcagcccgcccggctcgcggcgaacgcgccgagaagtccgagcaacgcggcgaacgcggcggcgatcgcaaccgcaaccgtcgcggcggcgcccagcaggcacaaggcggacgcgaccaggcagcggcaggccgcggccagcagcaacgccaggaacgcgaaggcaaggaagtgcgtgaagcacgtgagccgcgcgagaaccgcgaaccgcgcgagggccgtgagccgcgtgaaggtcgcgagatccgcgaaggccgtgagggtcgcgaaggtcgcgagggccgtggcccgcgcgaaggccgcgagccgcgtgaaagccgtgaaccgcgtgagaaccgcgaaccgcgcgaacgtgccgagcagccggaaggcgtcgaagccgccggccgtggcgagcgccaggaacgtcgcgagcgcggcgagcgccgcaagccgacccagcatgcggctacgctcgaaacggtcaaccgtggcgaaacgcatccggaaccggacgccgacaaggccgtcgccgaggccctgcccggcgccgagctggcagccgacgcggaagccggcgcgcgtgatggcgaggaacgtcgccgtcgccgtcgcggccgccgcggcggtcgccgcgagcgcgaggaagacggcgcagtcgtcgaccacgccgagcaaggcgcagatggcgaagccgccgtgcaagccgtgacgccggaagcaccggctgctgccgaaccggcccacacggccgcaccggcagtcgtcgtggccgcggctgcggcaagcgccgtcgtcgccgaagcagcggtcgagcaccacgccgaaccggttgcgccggccgctgtcgagccgcagccggcaccggtacacgtcgaagcggctccggtcgaaccggcggttgttgcccacgcggcagaaccggctccggtcgcaccggccgtcgaaacggaagccggtccggctccggtcgcggtttcgccgacggacgcgttcgaagtgccggcagcgcctgccgcggtcgaagcaccgcagtccgcgcccgtcgagcaagccgcaccggccgtggcgatcgaagccgctccggcggctgtcgagccggcaccggtcgaagctgcgccggtcgaggccgtcgcagcaccagcaccagttcccgcacaaccggcagccgcgcccgcttcggcgagcctggatgtcgtgctggagcaggccggtctcgtctgggtgaacacggacgccgacaagttcgccgccgcgcaggaagccgcgtcgcgactccgcgtccggctcgcgtgccgcgcgaacgcaaggcactgccgccggtcgatacggccccgatgcagcaggtcgaaacgacgcatcactgaccggcacatcgcccgaccaggaaaagcccgcctccggcgggctttttcacgtccgcgctgcgggtttccgcccaccggcccggcccgccgcttgcggctaaaatagaggcctggttcgcacttctttcaacatgtcccgacgcatcattcctctcgccgacgtcagcgggatgccggacgtctccggcgtcgcgcacgccccggacggcacgctggccgacacgctcgccaggccgctgcgcgacctgcgcatttcggtgacggatcgctgcaacttccgctgcgtgtactgcatgccgcgcgccgtcttcgacaaggactacccgttcctgccgcacagcgcgctgctcacgcatgaggaaatcgaacgcgtggcgcgactctttgtcgcacacggcgtcgagaagatccgcatcacgggcggcgagccgctgctgcgcaagaatctcgaattcctgatcgagcgcctcgcccgcctgaccacgcatgacggacgcccgctcgacctgacgctcacgaccaacggttcgctgctcgcccgcaaggcgcgcgcgctgaaggacgccgggctcacgcgcgtgacggtcagcctcgacgcgctcgacgatacgctgttcaagcgcatgaacgatgccgagttcgcgagcgccgacgtgctcgacggcatcttcgccgcccaggccgcgggcctcgcgccggtcaaggtcaacatggtcgtgaagcgcggcaccaatgacagcgagatcctgccgatggcggagcgtttccgcggtaccggcgtgatcctgcgcttcatcgagtacatggacgtcggtacgtcgaacggctggaacatgaccgaggtgctgccgtcggcagacgtcatcgcacgcatcgccgaacacttcccgctcgtaccgctcgagccgcacacggcggcagaaaccgcgcagcgctggggctatgcggacggcagcggcgagctcggcgtgatttcgagcgtcacgcaggccttctgcggtgactgcacgcgcgcgcggctgtcgaccgaaggcaagctgtacctgtgcctgttcgcgtcgacgggccacgacctgcgcgcactcgtgcgcggcggcgcgagcgacgccgagatcgcgaccgcgatcgcccgcatctggcaggcccgcaccgaccgttattcgcagctgcgcggcagcgcgtctgccgacaccgtgcccgacggcgccggcaagcgtgtcgagatgtcgtatatcggcggctgacgcacgctgcccttcgccttctcgcgatgcccgcttccacctctcctcgatcgccggcctgctgctcgcaggcgggcgggccacgcgcatggacggcgtcgacaagggcctgcagttgctcgacggcacgccgctcgcgttgcacgtgctgcgccgtctctcgccacaggtcgacgaaacgctgatcagcgcgaatcgccatgacgatcgttatgccgaactcggtgcgccgttcgacgcgcgcatcgtcgcggacgaaacgcccgacttccccggcccgctcgcgggcctgctcgccggcatgcgggcggcacgcgcgccgctcgtcgcgtgctcgccatgcgatacgccctacctgcccgccgacctcgtcgcacggctgcacgcggcgctcgacgcgcagcaggccgacatcgccatggcggtgaccgtcgacgcgcagcacgcgcgctcgccgcagccgacgttcgcgctgctgcgcacgtcgctggccgacgatctcgccgcccggctcgcggccggcgaccgcaaggtgcgtgcgtggtacgcacgccacaagacggtcgaagtcgagtttcacgacgagcgtgcgttttacaatgccaactcctggcaggaactcgccgcgctggcccgccgctgacggcactcgcgcggttcccgcccgccgcacgcgaaacccgcgcccaggcaccctcctcgcgccaccggccacgaacccgatacgccttgcggcgcagtccgactgatgatcacgcaatcctcgcccgcctcccgaagcgcccccgattccgatgccccgctgtcgctcgccgacgcgcaggcactcgcgtgccgctttgcggtgcccgtcgcggcatgcgagacggtggcgctgcgcaatgcgctcgaccgcgtgctcgcggccgacgtgaacgcaccgttcgacattcccgcgtacgacaactcggcgatggacggctacgcgttcgacggcagcaccggcacgcacgcggcgccgcaagcggatgtcgcgctgacggtcgccggcaccgcgctcgccggccatccgttcgacggcaccgtggcggccggatcatgcgtgcgcatcatgacgggcgcgccgatgccggccggatgcgacacggtgattccgcaggaacgcgtgcgcgccgacggcgacacgattcgcttcgtcgcgcatgacatcgcgcgcggcgcgaactgccgcaaggccggcgaggatctcgcgcgcggcgcctgcgcgctcgccgcgggccgcatcctgcgaccgtccgatctcggcctgctcgcgtcgttcggcatcaccgaggtcacggtgcgccggcgcgtgcgcgtcgccgtgttctccaccggcgacgaactgcgcgagcccggcgagccgctcggccccggcgcactgtacgacagcaatcgcgggatgctgatcgcgatgctcgaacgactgcatgtcgacgcggtcgacctcgggatcgtccgcgacgagccggccgcgctcgaagccgcattgcgcgacgccgtcgccgcgcaggccgacgcggtgatcacgtccggcggcgtatcggtcggcgaagccgatttcacgcgtgacgtgatggcacggctcggcgacgtgacgttcgccagcctcgcgctgcgtcccggccggccgctcgcgtgcggcacgctcgcacgcgcgcccggtggcaccggtcacgcgctgttcttcggcctgcccggcaatccggtcgcgtccgccgtgacgttctacgcgatcgtgcgccccgcactgctgacgctggccggcgcgcaggcccagccgccggcgatgcatacggcactcagcacgcatgcgctgaagacgcgcccgggccgcaccgactatctgcgcggcatcgcgacacgcgccgccgacggccgctggcacgtcgcacctgccggctcgcagagttccgcgtcgctgagcagcctctcggccgccaattgtttcatcgtcctgggccacgataccgcggcagtcgacgcgggcaccccggtcgacatcctgccgttcgacggcctgatctgaattccactatcggtatatctctacgggggcaatccgcacatgaagaaacaaatttcgtcgatcgccgcggggcagaccgcaaaggcgctgatcctcgtctacctgacgttcagcgtgccgatcgtgctgctcggcattctcgtcgcctacgttcgttacgggatggtcgaactgagcacgatcctgagcgcgctgctgctgaacgccatcctgggcttcgtgttgctgtggatcgcgtgccacgcgtacaactgggttgcatcgcgcttcggcggcatcgagatcgtgctgtccgatccgccggaggaagcgtgagcggcacgccgctgatccgtgcggcgcaagcgagcgacgtcggtgcgatcctcgcgctgatgcgcgagctcgccgaattcgagaagctcacgcatctgttcgtcgcgaccgaggccgacctcgccgacgcactgttcggcgcgcggcctgccgccgaggcacgggtggcagaacacgacggcgcgatcgtcgcgtatgcgctgttcttccacaattactcgacgttcctcggccgccgcggcctctatctcgaggatctgtacgtgcagccgtcgcaacgcggcacgggcctcggcaccgcgatgctgcgtcacctcgcggccctggccgtcgagcgccgttgcgggcgcttcgaatggtcggttctcgactggaaccagcctgcgatcgatttctacgagaagatgggcgccaccgtgctgcccgactggcgcatcgttcgcgtgacgggcgacgcgctggacacgctcgccgggcattgagcgcatcgcggccgcaccggcagtcgctgcatgaaaaacgggcgccgcggcgccattttcgttccggccggtatcggcaacgcgcgtcacgcgtcgtccgcatcggcgccgtcgctaccttccgcaccgagcagcccggccgccgcgtcgcccggcagcgcctcgacctgcttcagcttgcggttcatcacgcgcgtacgctgctcggcggactcgatcgagcgcgtgaccgtttcgagctgcgccttcgtgcgtgcgagcacgtcgccgaacttgccgaattccgtttttaccgcgccgagcacctgccacacctcgctcgaccgttgctcgatcgcgagtgtgcggaaacccatctgcaggctgttcaacagtgcggtgagcgtcgtcgggccggccaccgtcacgcgatagtcgcgctgcaacaggtcggtcagccccgggcgacgcaggatctccgcatagagcccttcggtcggcaggaacaacagcgcgaaatcggtcgtgtgcggcggcgcgacgtacttctcggcgatcgtgcgcgcctcgagccgcacgcgcgcttcgagcgcgcgggccgcttcctcgaccgccgccgcatcggcgcgctcctgcgcgtcgatcagccgctcgtaatcctcgcgcgggaatttcgcgtcgatcggcagccacacgggcggcgcgtcgcgcgtaccggcatcgcgccccggcagccggatcgcgaactcgacgcgctcgctgctcttcggcaccgtcgcgacgttcttcgcgtattgctcgggcgtcagcatctgctcgagcagcgcctcgagctgcacttcgccccaggtgccgcgcgtcttcacgttggtcagcactttcttcagatcgccgacgcccgccgcgagcgtctgcatctcgccgagcccgcgatgcacctgctcgagccggtccgacacgagcttgaacgattcgccgagccgctgctcgagcgtcgcgtgcagtttctcgtcgacggtgcggcgcatctcctcgagcttcgccgcgttgttcgtctcgatttccttcagccgctgttcgagcgtcgcgcgcacttcgccgatccggcgatcgttcgcctcggtcagctgcgtgagctgccggttcaacgtgtcgccgaacagcctgagcgcgcccgtctgctcctcgcgcgcctgctgcgcctgacgctgcaaactctcgcgcatcgcgtcgaactgctgcgcattgccggcgacgagcttgccgagctgctgggcgaagccttcgacctggttgttctgcacggtcgccacgctcgtcagctgcgcggcgagcgtctgctgaagctgggcgaaactgccggccagctcggtgcgcgagccgcgcgcgttctcgacgatctcgccgcgcaattcgcgttcgagccgctcgaccgcgcgcgcctgcgcgtgcgcggcgtcctcgatctggtcgcccagtacagccgcatcgtcgtgacggccagtgccacgcatgagcgcgacgatcgccaccgcgagcgcgacggccagcacgacgaccgccgcaagcaacaacgtcatcgtcatgcgcgcggcttcccgatcacgtcagggttgatcggattcggcggccgccccgcgcgcggcccttcgcccagcgcggcgatcaggttgtcggcggcgaggttcgccatcgcgcggcgcgtttttcggtcgcgctcgcgatatgcggcgtcagcacgacgttcggcacctcgagcagtgccggatgcaccgtcggctcgccttcgtacacgtcgaggccggcggcggcgatcgtcccgtcgcgcagcgcgacggccagcgccgcgtcgtcgacgatcccgccgcgcgcgatgttggtcagcgtcgcggtgggcttcatcttcgcgagttcggccgcgccgatcgtatggtgattttcctgcgtgtacggcagcacgagcacgacgtgatcggcgcgcgcgagcagcgcatccttcgatacgtattcggcgttcagctcggcctcgatctcgggcgcgacacgcgaccggttgtgatagatcacctgcatcccgaagccgcgcgcgcgcgcgagcgcctggccgatgcgccccattccgatcacgccgagcgtcgagccgtagatgtcactgccgaggaacccgtcgtaagcccacttctgccagtggccggcgcgcagccagtgctcggattcggcgatccggcgagcggcggccatcatcagcgcccagccgaaatcggcggtggactcgttcagcacgtcgggcgtgttggtgccgagcacgttcgccgcgttgaacgcagccatgtcgaagttgttgtagccgaccgccatgttcgccacgacgcgcaggcgcggcgcggcggcgagctcggccgcgccgaccggatcgccggccgtcaacgcaccgtccttgtcggccagacgcgcggcgagcgcgccgggcgcgagtgcgtcgccgttgttccagtcgacgtcgaaatattgcttgagccgctcgatcacgtccggaaagatcggacgcgcgaccaggatcttctgcatcgccatctccgcatgccgcggacggatcgaagcgcgtcgtgcgccgccgggaccgcccgctcaaggttgaaaatcgtcagcttacgccgtgaagaaaagccacgacgtcagcaggaataccggtatcagtacgaccagcgcccagccgagatacgcgaagaagctcggcatcttcacgccccgcgattcggcgatcgccttcaccatgaagttgggtgcgtttccgatatagctgttcgcgcccatgaacaccgcgcccgcggaaatcgcggcgagcgtcgacgcgccggtcgtcatcagcgactgggcatcgccgcccgcgaggttgaagaacacgagataggtcggcgcgttgtcgaggaacgacgaaagaatgcccgtcgcccagaagtacatcgcgtcgatcggcttgccgtccggccccgtgacgaggtggacgatctgcgcgaacgcgccgtcggcgccggcgcgcaggatcacgatcaccggcgcgatcgtcacgaagatccccgcgaacagcttcgcgacttcctcgatcggcgcccagttgaacgcgttgccctcgcgcgcggagcgcggcgtcagcgcgagcgacgcgagcgtcacgcccacgagcgcgacatcgcgcacgaggttctgcagcgcgacgtgcgtgccccatacgtcgaacgcgatgcccggcttccagatgccgctcatcagcacgagcgcaaccacggccgcgagcagcacgaagttgatcttcccgtcgatcgacagcgccgcgccgtccggcgtcgggtcgagcacggccggccgctcctcgccgcccttccggtagaagtacgtatcgagcacgaagaacagcgtcagcagcaccgcgcagatgaacagcatcggcagcgcgaggtgcgtggtcgtccagaagaagctcacgccgttcaggaaaccgaggaacagcggcggatcgccgagcggcgacagcgagccgcccgcgttcgcgacgaggaagatgaagaagatcacgacgtgcacgacatgcttgcggttgtcgttggcgcgcagcagcggccggatcagcagcatcgcggcgcccgtcgtacccatcacgctcgcgagcagcgtgccgagcgcgaggatcgcggtattgagcttcggcgatccatgcagattgccgttcacgcagatgccgcccgcgaccgtatagagcgcggtgagcagcacgatgaacggaatgtattcctcgagcagcgcatgcacgagcgtgccgaacgcggtgcccgcgccgaacgcgattccgaacgggatcaggaacacgaccgcccacgcggcggcaatcttgccgaagtggtgatgccagaagacgggggcgacgagcgggaacagtgcgatggacagcaggatcccggcgaacgggataccccagagggcagacagcgcggcaccgtcgagcgttgcggccgatgcaagcgcgggaacggcgccaagcgcgatccccgacgccatgcccgcccaggcggcatgtcgtttcatgcagaacttccttgttcgaatggtggtagatgcagcgggcgcgtcatgcgccccgtacgacgatcacgtgaacgcggtacgggccgtgcgcgcccagtacgatggtctgctcgatatcgcccgtgcgcgacggacccgacacgaaattgaccgcgcgcggcaattcgccgcgctccgcgcggatcagcgcaaatgcgtcttcatgaccggcaacgatccgcgacgcggaacgatcgcgatgtgcgtttccggcagcaggcccgccgacgcataggtgtcggggccggacagcagcaccagcgagcctgtttcggcggtcgcgcaaaaacagccggtaaggccgaccagatcgccgtcgcgcggcttgcggaactcgaccgacaggcctgcgcccgcccagtcgaaatcggccagcgtgcgccatgcgacggcctgcgtcggcaggccatgagcggacaggtagcgggccgcggcggccggcacatcggcaagcgctgcgacttcgtcgaccgtcgtcgacagacgggccgcttcgtcgacgaatgccgcgacgaggtcggccggcgccggcgggcgcgggccctccggatgacgggcgagatagtcggcaacgccgtcgcgctcggccgcatcgggttcggccgcacgccctgcgccgcgcgaatgcgcgcgaggatctggcgacgggcagcggaagtgtccatgaacggtcctcgtgacgttggcgggcgataccgtcggattataccggccggccccgccgcgacgcagttttggccgttcggccgacgcttacttcgacgcgccttcctcgaccggctgcgcgatgccgaacacctggcgcaggtacgcgagatacgccttgtcgtcgcacatgctcttgcccggcgtatccgacagtttcgcgaccggctgcccgttgcagcgaaccatcttgatcacgatctgcagcggcacgtagccgaggtcgttcgtgaggttggtgccgacgccgaatgcgagcttgcagcggccgcggaaccgttcgtacaactgcatcaccttcgggatgtcgagcgcatccgagaacacgagcaccttggtgcgcgggtcgcagcggttcgcctcgtagtgacgcagcatgcgctcgccccactcgaacggatcgcccgaatcgtggcgcgcgccgtcgaacagcttgcagaagtacatgtcgaagtcgttcaggaacgcgtccatcccgtagacgtccgacagcgcgatcccgaggtcgccgcgatattccttcgcccacatctcgaaaccgtagatctgcgaatcgcgcagccgcgggccgagcgcctggcacgcctgcagatactcgtgcgccatcgtgccgagcggcgtgatgccgtgcttcatcgcgtacagcacgttgctcgtgccggcgaactgcgggccgagcccgtcgcgcagcgtgagggcgacttcctcgtgccacaccttcgagaagcgccggcgcgtgccgtagtcggcgatcttgcagtcggcgaactcgggcttcgcgccgagcagcttgatcttctcgcacagccgctcgcgaccttcgcgatagtcgggctcacgctgcgtgttgcggaaatagacttcgttgacgatcgcgagcaccgggatctcgaacaggatcgtgtgcagccacggcccctcgatcacgatgtcgatctcgccgttgcccttcggcgatggcgtgatcgagatgtatttctcgttcaggtggaacagcgcgaggaagtcgacgaaatcgctcttgatgaagcgcatgcgccgcaggtagtcgagttcgacgtcggtgaagcgcagcgaacacaggccgcgcacctcgtcgcggatctcgtcgatgtacggcacgagatcgacgccgggcgtacggcaccggaagcggtactcgacgtttgcggcaggaaagtgatgcaggacgacctgcatcatcgtgaacttgtagagatccgtgtcgagcagcgaagtgatgatcatgattacggcaccgccagtatcgtgacagggccccggcgcaccgcgcgccgcccggtctgccggccatgttacccgaatgcgggcccgaccatcgcgaaaccgcctgccgccctgcccggccgcgccgccgtacggcacacgcgccccgtcggcgagtcccttctgcgggccgccataaactaatcacgaaacgatataagccggatagccgaccacgccatgcgggttttgcgcttcagttacaatgccggttttggcgcaaacgccaccccatatataccgccaagcaggagcgttttaatgactcacgttgtgaccgaaggctgcatcaagtgcaaatacacggactgcgtggatgtgtgcccggtggattgcttccgtgaaggtcccaactttctcgccatcgatccggacgagtgcatcgactgcgccgtgtgcgtcgccgagtgcccgaccaatgcgatctatgccgaagaagacgttccgggcgaccagcagcagttcaccgcgctgaacgccgagctggcaaaggactggccgtcgatcacgaagaccaagccggcaccggccgacgcggacgagtggaaggacgtgcaggacaaactgcacctgctcgagcgctgatcgcgcagcggccgcaaaaattattgtgcgccgcggcccaaaagtgttgacaggttgatcaacgctccatacaatctcgtttctctgctgttgttgtttgttccccgatagctcagtcggtagagcgccggactgttaatccgtaggtccctggttcgagcccaggtcgggagccaaaaacgcaaaggcccgttgaaagtggacgggctttttgctggtagacaaacaagcagatgtaccgatttattccccgatagctcagtcggtagagcgccggactgttaatccgtaggtccctggttcgagcccaggtcggggagccaaatagcgaaaggcccgtcattcgacgggcctttgtttttccggcccgcctttcggctttcgtcgcccggtcgcgcgcatgctagagtctctgtcccgcattcgcatccggttccgtcgatgaagcaccgcctcctccgctcagcaccattcgccctcctgctttccgcatttgccgcggcaccgctcgcgcacgcggaggaagtcggcagcgtcaacacccatttccgcgtcacgggctccgatcgcgtggtcgtcgaggcgtatgacgatccggtcgtgaacggcgtgacctgctacgtgtcgcgcgcgcgcaccggcgggatcaagggcacgctcggcgtcgccgaggatccgagcgaagcgtcgatcgcgtgccggcaggtcggcccgatcagcttcaaggagccgctcaagcaacagaccgacgtgttcagcgagcgcatgtcgttcatcttcaagaccctgcacgtcgtgcgcgtggtcgacaccaagcgcaatacgatcgtctacctgacctacagcgaccgcatcgtcagcggcagcccgaagaacgccgtcaccgcggtgccgatgccggccggcacgacgattccggtcaagtaaagcccgcgcccgccgggcgcgcgagcgatacactgtcggttcgaccgccccgcgcccgatcatgtccgccacccgccttcccgactccgcacgctactggcgcacgccgctgctgcccgatgcggatctcgtcacggccacctatcgcgaccacacgttcgcgccccactggcacgacgcgtatacgatccccgtgattctcgaaggcgcggaacgcttcacctatcgcggcagcggccatgtcgcagaaaccggcaccgtgcccgtgatcaatcccggcgaagtgcatacgggctcgcgtgcggccgacgagggctggtgctatcgcgtcagctacatgccggtcgatttcatccgcgaactcaccagcgcgatcgccggccgcccgcaggacgcgccgtggtttgcgcccgacgtgattcgcgacgccgacctggcggcgcggctcacgctggcgcaccggatgatggaggccggcagcgagcacgcactgccctcgcaggcgcacgggcaagcagctgacgttccggcgacgggcgcaccacgcatctacgatccgctcgccgccgaaacggcgatgctcgatgcgttgtcgacgctgatcgtgcgccatgccgacgccctgccgcgaccagcgccgctcgcggcggacgaaccccgcgtcgatgcgatgcgcgaacggctcgccgccgatctgacgtgcacggtaacgctcgacgaagtcgcgcaggcggccggcctgtcgccgttccacgccgcgcgcctgttcacccgcacgaacggcatgccgccacatgcgtggcgcaaccagttgcgcctgcagcgcgcgctggcgccgctgcgcgcgggcgtgcccgtcgccgacgtcgccgcggccagcggcttcgtcgaccaaagccacttcacacgacatttcaaacgcatgttcggcgtaccgcccgggcgctggcaggcgagctgacgcgcggcgtccggcccgccagcgcgatgccgccggcgcctgcaagcaggcacccaagcgcaagaacatacaagccggctcgcccccgcccgctatcctcccgttcatggaggagcaccctttgaacccgacacccgcatcgcccgctcgccgcccgttcaacgaatggctcgacggcgcgcgcgacacgatcccgatgatgattggcgccgccccgttcggcgtgattttcggcacgctcgtcggcggcggcacgctcgtcggcggcggcacgctcgtcggcggcggcccgctcgccgcgtggcatggcacgctgatgtcgcttgccgtgttcgcgggctccgcgcagttcatcgcgctcggcctgatcgcgggtagcgcaagcttcgtcgtcgtgctcgcgaccacgctgatcgtgaacctgcgtcacctgctgtacagcgcgacgctcgcgccctatgtcgcgcacctgccgctgcgctggcgcgccacgctcggcgcgctgatgaccgacgaggtgttcgcggtcgcctatgcgcactaccggcatttcccgcccggcgcgatcggcccccactacttcttcggctcggggctcgcgatgtacctgaactggcaggtctggacgctcgcgggcatcggtttcggcgcggcgttcccgggcctgcagtcgctcggcctcgatttcgcgatggcggccaccttcattgcgatcgtcgtcccgcagctcggcaccctgcgctatttcgcggcggccgtgacggccggcacgctggcgtacttctggcagggctggccgtacaagctcggactgctcggcgccgtcgccgccggcgtcgcgatcggcgtcgcgctcacgctgctgcacgaacgatcgcgtgccggctcgcgcacggaggccgcatcgtgagctacgcgctgctgattctcgggatggccgtcatcacgtatgcgatccgctcgacgctgttcctgttcggcgaacggctggccttcccgccgctcgtgcggaccgcgctcggcttcgtgcccgtcaccgtgctgaccgcgatcatcgtgccgatggccgtctcgccgcacggcggcacggccgagctgacctggcgcaatccgcagctcgtcggcgcgctggcggccgtgctcgtgtcggcagcgacccgccgcccgctcgtgacgatcgcggcagggctcgcggtgttcttcttctggcaagggtcgtgctgccccactggctgcccgcctgagcacacgctcggtcacgcgcgctcaagtttccgcccggcaggccgatataggggatgaagacccgccaccggcctcggcgcgcaccggtcagtcgacgctgcgcccgccccggtgcgccgtgccggccgccggcttgcgcgggccgccatcgagacgattcatgggccagatcaccctttcctcaaggacgacacgctcgagtccctgcgcaaggactacgatgcgttcgtccgcgtgtcgctgaaactcgacccgcagttcgcgacgccgtcgttcgaggatttcctgcgcgccaaactgctcgacaacatggtgccgctgaccgagcacgcggtgcagcggatgctgcagggcggccagtacgcgtgggccaaacgcacgctcgacaaggaattcccggacgtcgtcgcgatcctgatgcgacaggccggcgaattcggcttcggcttcgcgtcccgctccgaatggaccccgacgaactcgcgaaggcttgccgcgactgggcgaaggcgatcgtcgccgaagcgcagggtgacccgtcgctgatcgacccgctcgcgtcgcagatcaagggagcggcgcaagacatccaggcactcgaggaactgatgcagacgccggcgtggcggctcgcagaatcgctgcggcaacgggtctacgaggccaagctcgcgtgcgagatgagcgtcggcagcaccgcgcgcgacaagctcggcgaactgcgcgggctgctgcggctcgggctcgcgcacggctcgttccagaaacaggaagcgcagcagatcatggaatacctgcggctgctgaagccggagatcttcgtcgaggagccgtacgacgtcttcgcacggctcgccgcgtggctgcgcagcgtattcacccggctgccgcgcggccggcacagggtccggacaagggcaaggacagcgccgcccgtaacggcaccccatgcgcatcgacacacgaaaacggcccggttcgcgcaatgcggaccgggccgttgatgaccgccgtcgcgacgcaccgtcagggacgagcgtcgcgcggcgccaggcaccgcttactgcgtggcgccctgggccgatgcaccgccctcagcaccgaccgatgcgccgccttcggtcgcttcgccggccttcgccttggccgaaccgacatggctcttggccgacttcgcggcatgcttcgtgtgcttcttggccgagtggacggccgacgacgccgtatccttcgcgccgtcggctgccgcgccgaccgcatcggttgcaccgccggcggcattgcccgacgcgttcgcgcccgcactgccctgcatgccggcaccgacacccgccgccggcgtctgcgcctgcacgccggcaccggccgtgccctgcaccgccgtgcccgtctgggcaaatgcggccgaagtagcgaacgccgtcagcgcggcaccgatcagcatcgtacgaatcttggacatggcaattctcctcaggaagttgtgagcccgaaccgcagcgatgcggcccgtcgcttcccctgccgcaacacgcagcaggtacgaaaaagacccgcggcgcgcccggccggttctcgaatctctcagactgttacccaccgtttcatttgctgacgaatcgctcacagtccttaacaactacatgccgcggcggcccgcgctcgcgtgccggcccgtggtgccgtatgatgcggagcgtttcctcccgcgccttgcgcaccttcttcgtcatgcccaacctggatttcacgctgaccggcgaatacgtcgagctgcacaaccttctcaagatcaccggcctcgcggacagcggcggcagcgcgaagctgatcgttgcgtccggcgcggtgaaagtcgacggcgcggtcgaactgcgcaagacctgcaagatccgcgcgggccaggtcgtcctgctcggcgacacgcgcattgcggtgcgcgaagcctagggccgacggttcccctgcctgcgacatggccatcggcgcgcgcgttcgacacggttcgaataaagccgtaagctagccgtctctcaaaataaatacatatagcgcgggcccgcacccgcgcgagcgcccattccatgtcgcattccggtcttacgcggacggccgccgcgccgccgtccctgtccagtcatgccgccgataccgcccgcctcgccgcgccgctcgcgatcgcgcagctctcgcagatggcgatgagcgtcaccgacacggtgctgctcggctcgctcggccccgattcgctcgccgccggcggctcggcgcgaacttcttcttcgtcatcgtgaccgtgctgcaaggcgtgctgtcgtcggtcagcgtcagcgtcgcgcacgcacgcggcgccaaggccgacgagcgcgtaccgcacatctactggaccggcttcgcgctgtccgtgctgctcgcgattccggccatcatcgcgctgtcgctgtccgaaccgatcctgctgatgttccacgagccgccgttgctcgcgcatcacgtcggcgaatacacgggcatcctgcgcttcgccgcgctcggcagcctgatcggtgtcgggctgatgcgtgcattccttccggcgatcggtgcggcgcggcggctgctgtgggtgtcgatcggcggcgtcggcgtcaacgccgtgctgaactacggcctgatccacggcgcgttcgggctgccacgcctcggcttcctcggttcggcggtcgcgacgacgatcacgatctggctcaccgcactcgccctgatctggctgctgcacggccggcagcgcttccgtcatttcgtcaccgccgcgcgcccgaagctgcccatgatgggcgagctgatcggcatcggctggccggtggcgatcacgtacggggtcgagtcgacgctgttcctcgcaaccggcctgaccatcggcgtgctcggcgcgacgtcgctggccgcgcaccagatcgcgctgaacgtcgcgtcggtggcgttcatggtgccgctcgcgatcggccaggccgccaacgtgcgcgtcggctactgggtcggcgcggggcaccgtcgccgcgcggcacgcgggtttcgtcgcactcggcctcggtgtcgcgttcatgacgctgtcgggcatcgtgctgatcgtcgcgccgcacgcgatcgtcggcctgtacctgaacctcgacgatccgtcgaacgcggccacggtgtcgctcgctgcgtcgctgctcggcatcgccgcggtgttccagatcgtcgacggcgcgcagaccgtcgcgtcgggcgcgctgcgcggcctgaaggacacgcgcatcccgatgctcgcggcgaccctcggctactggggcatcggttttccgaccggctactggttcgcgttccacgtgggcctcggcgcccgcggcctctggtggggtctcgcggccggccttgccagcgtggccgtgctgatggcgtggcgctttcatctgaagagcgcgtcgctcatgacgtcgccgcactgagctcgacacgacgcgaaatcccggccggcgctatgctagtcggctgagaagacctcgagacgccgcgccagcggcgcgactgcctcacgatacgtctggttatgcccgatgccgcgcgacgacgcgcggcctttcctttcctggaggagtggatcatgaacgaagcagttcggatggaacgcgatacgttcggcgagatcgccgtaccggccgaccggctctggggcgcgcagaccgagcgctcgctgcagaatttccggatctcgaccgagaagcagtcgcccgagctgatccacgcgctcgcgatcgtcaagcgcgccgcggcggccgtgaaccagtcgctcggcgtgctggccgacgacaaggcgcgcgccatcatcgacgcggccgacgagatcatcgccggcaagcatccgcgcgaattcccgctcgccgtgtggcagacgggctccggcacgcagaccaacatgaacctcaacgaggtgatcgcgaatcgcgcgagcgaactgatgggcggcgagcgcggcgaagcgcgcaaggttcatccgaacgacgacgtgaaccgcggccagtcgtcgaacgacgtgttcccgaccgccatgcacgtcgcggccgcgtacgcgatcgtcaaccacctgctgccggcgctgcgcacgctgcgcacgacgctcgacgcgaagtcgaaggccttcgccgacatcgtgaagatcggccgcacgcacctgcaggacgccacgccgctcacgctcggccaggagttttccggctatgtcgcacagctggaccagggcatccgtcacgtcgaatcggcattgccgcacctgtatgagctcgcgctcggcggcaccgcggtcggcacggggctgaacgcgcatccggagttcgcggtgcgtgtcgccgatgaaatcggccggctcgcgaagctgccgttcgtgacggcgccgagcaagttcgaggtgatggcggccgccgatgcgctggtgttcgcgcacggcgcactgaagacggtggctgccggcctgatgaagatcgcgaacgacgtccgctggctcgcgagcggccgcgctgcgggcttggcgaactgtcgattccggaaaacgagccgggcagctcgatcatgccgggcaaggtgaacccgacgcagtccgaagccgtgacgatgctgtgctgccaggtgttcggcaacgatgtcgcggtcaacgtcggcggcgcgagcggcaatttcgagctgaacgtgttccggccgatgatcgcgcacaacgtgctgcagtcggtgcggctgctcgccgacggcgcgcagagcttcaacgaccactgcgcggtgggcatcgagcccaaccgctcgcggatcgacctgctgctgaacgaatcgctgatgctcgtgacggcgctcaatccgcacatcggctacgacaagtcggcgcagatcgcaaagaaggcgcacaaggaaggcacgacgctgaaggcagccgcgctcgcgctcggctacctgaccgaggcggaattcgatgcgtgggtgcgccccgagcagatgatcgggtcgcgctgacggaacgacgaccggcggaatcgcgggcgcggcgcgatgcgcggcgcccgccgcggtcagaccgcgcctttcgcgacttcttccggcttcatctcgacgatcttgtcgagcgcggcccgcacgtcggccgcatatttcgcgagcaccttctgctcgtcggtctcgggcacgaacggcggcaccggcaccgggttgccgttctcgtcgaccgcgacgaacacgacgaggcaatcggtcgtctggcgcagcacgccgcccttcggatccccggcatggacggacacatggatgtgcatgctggtgcgacccgtcgcaacgacgcgcgccttcagctcgacgagattgccgaccaggatcggacgctggaaacggatgttgccgacgctgaccgtcacgcaatagcggctcgaccagacggccgcgcacgcatacgcgacttcgtcgatccacttcatcagcgcgccgccatgcaccttgccgccgaagttcacggacgacggttcggcgaggaagcggaatacggtttcggtgcggtcgagggcggccggtacggggacggttgggacatcgtgttggctccaggcggcaggggcgctgtaatcggccgattatacgttgcactgcggcaacgcgtcgcggggcgccccgtgtggcgcggctgtggggccgtgcccggcgtgcatgtggccggtgccggtcagcggcgcaccgtgatgccctgatcgatcgtcccgtacatctcgaggctgccgccgcgctcgccggccgcgcccgcaccgccctgcgcacaggccgcgcagacgagcgccgccgccagcaaacagaaaatcgtcttcatcgttgcgtcgtgtcacgtgcggcagcccgctgccgccgctttcggccattctacgcgcgggccgcacgcggccgcggccccgttcgccgcaccgacgccgccggcgcgtctgcatccgacatttcagccagaaccgaaacatcgaatgcgcgcgcccactacactggagaccatcccgcctgacgagacacgacgatgaccgaccaagacgaccaccactttccgggcctgagccgcatcggttcgctgatcgccgacccgggacgcgccgcgatgctgtgggtgctgatggacggcagcgcacgaccggcaggcgagctgacgatgatcgcggggctgtcgccctccgccgcaagcgcccacctctcgcgcttgaccgaaggcggcctgctcgcgctcgacgtgcgcggccggcaccgctactaccggatcgcatcggcagacatcgcggcatcgctcgaggcactcgcgaacgtcgcccgcgcggccgcgccgcatcgcgcggcgccgccgccgtcccgcacggtcccggccgaattgcgctatgcgcgcacctgctacgaccacatggccggcgaactcgcggtgcgcatcttcgacgggctcaccgcacgcggctggctccaggcggacggcgatgcgatcgagaccaccgaactcggcacccaggcgcttgcgcaatggggcatcgacgtcgcacagcagcgcacgcgccggcgccgcttcgcgtgcggatgcctcgactggagcgagcggcgttcacacctcggcggcgcgctcggcgcggcactgctcgagagcttctgcgcgcacggctggatcgagcgtgcggcacggccgcgcgtgctgcgcgtcaccgtgcccggacagcaggttttcgacgagtggcttacgtccgcttgacgcccgcattgcgtctgcacgacaacggcgcgcgatcgacaggttttgttacatcgcgtgccattcgacttacaaaacaccgagcattgaaacaggccgagcggatattgtgaactcaacggcacgaatcgacgcgccgcgacaatgacgaagacgctcaccatggccaccctgttcacgctcaagcgaaccgcccgctgcacgctgctcgcgttcgtcgcgcttgcggccctgcccccgcattcgcgcaatcggccgacgccctccgtatgcggccgcggcacggcaaccgggcggcgatccgcccagccgtgtcgcacggctcaattacctgtcgggcgccgtgacgaccgagccggccggcaccgatacgtggtcgtatgccgccgtgaaccggccgctgacgaccggcgaccagctctggaacgatgccggcgcgcgctcggaactgcacatcggctcgaccgcggtgcggctcggcgagtcgacgagcctgtcggtactgaacctcgacgacacgacgacccagctgaaagtggggctcggcaccgtatcgactcacgtgcgcgatctgccggccggcggatcgtacgaaatcgacacgccgaacctcgcgctcggcatcgcgggccccggcgactatcgcgtcgacgtcgcgccgaacggcgcgagcacgacggtcacggtgcgcagcggcagcgcgaccgtctacggcagcaacggccagtatccgctgtcaccgggacagcaggtcgtgttcacgggcaccgacctgcaggtcgcgcagcaagccgccgcccccggccccgatgcgctcgaccggtgggccgccagccgcgacgcggccgaggaacgctcggtgtcggcccgctatgtgtcccgtgacattcccggctaccaggatctcgacgcgaacggcacgtggcgcgacaccccgaattacggccaggtatgggtgccgaacgatacgccggcggactgggcgccgtatcacgacggccactggatctggcaggccccgtggggctggacgtgggtcgacgacgcgccatggggtttcgcgccgtatcactacggccgctgggcgtacgtggacgatagctgggcctgggtaccgggcccgctggccgtcagccagccgccggcctatgcaccggcactcgtcgcgttcgtcggcggtggcggcggccccgactggagcgtcgcgctcacggtgggcggcgtcgccgcggccggctgcgcgtggttcgcgctcggcccgggcgaaccgtggcatccgggctggggcggctggagcccgcactactacgaccgtgtgaaccgcaacatcgtggtgaacaacgtcaacgtgaacaagaccgtgaacgtgacgaacatcaccaatatcaccaacatcaacaagacctacgtcaacttccgtgcgccgcacgcgatcacggccgtaccggcttccgcgttcgtgcacggccagcctgtcgcacacttctcgcagcacgtcgacccgcagcaatggcgcaatgcgcatgtcacgccgggtacgccgggcattgcgccggtgcgccagagcttcaccggcgggctgcgcaatgcgagctaccgcccgccggcggcaattgcccagcatccgtacgtcgccacgcgcaatcccgccgtgccggccgcgtatcgcgaccaggccgccgcccacctcgcgcagcaaggcgggcgcgtgccgggtgccggcgcgcccgtcgtgaagacgaacgtgccggccgactatacggcgcgtccggtccgcgtaccgggcaaaccgggtggcggcgcatgggcgatgcacaacgtgcagctcgtgaatccgcacggccccgtcgtgcagccggctcgcgcgcctcgcgaaggccagccggccgccttgcaggccgggcggccgggaacaccgatgcccggcgtgccgaatgccacccggcccacgaacggcgaaaaccccggcgcaccgcacctcgccaacggcggcatgccgcaggcacccggcaacccggcgccgcatcaggcgttcgggcccggcaacggtgtccccatccgccggtagcgaacaaccgtccggccggcatcggcaatgcgcacgcggccgaggcgccgtcgcccgcgtggatgcagccgcacacccgatggagcgccagcgccctgctccgcccactgcactgcatgcggcgggacagaatgcgctgccgcccgtgcgcagcgcggcgatcccgcatccggagggcgcgccgacgctgcagggcgcgcagcccggcggccggaacgaaacgccgcgcgcactgccgcaaccacggctcgacaatacggcgcagattccgcagccgcgcccgcgccccgaattcccgacaccggcgcagcatgggcaaccgcaaccggagcgggcggcgcccgcgccgcagccgcaccccgaattcgcgcaaccggcgccgcaccacgaagtcgccccgccacgtgtgaacgagtaccggccgccggcccccgccgtgcatgacatgccgcgcccgcaaccgcaggcgccgcgcatggagccgagaccgcaaccggcgccacgcatggagccgcgcccgtcgatgcccgcaccgcgcatggaaccgcggccgcaaccggcgccgcacgtcgaggcgccacacccgagcaacccgcccccgcaaggcggccacgaagagcggcaccgccagtaagcgccgcaaacgtgaaacaaaatggcccgaccggtatcagccggtcgggccattttcctgcgggaagcgaatcgatgcctctgcgcggcccgggccgcgcgatcagacggccatcggtgcggtcagcggttcgtggtggcgatagccgacgagcgagaaatccgacggctcgatccggtccagccactcgggctcatagacgcccgtcttcgcgtaatccggcacacgctcggaaatctcgagccgcgggctgtcgtaaggctcgcgcgtgagctggcgctgcagcatgtcgagctggttctcgtagatgtgcgcgtcgccgatgaagtacgtgaaccagcgcggcgtgtagccagtcagccggccgacgagcgccagcagcgcggccccttccgtcaggttgaacggcgtgccgaggccgacgtcgttgctgcggatgtacaggcacagcgagatttcgcgcttcgtagcgttcggcaggaactggtacagcagatggcacgcgggcaacgcgatctggtcgagcacggccgggttccacgcgtgaaacaggatgcgacgatcggacgggttctccatgatcgtgtccaggcactggcgcaactggtcgatcgccttgtacagcagcaccttcggtgcgccgtcttcgtcgaagcgtgtaacgatccggaagccgcggcgcgtcgcatcggcgatctgcgcgtcggcgctcgcgtcgagcaccttgtagcccggccactggcgccattgcacgccgtacacgtcaccgagatcgtcgacgccctggcgatacgggttcgcaagccactgggcattctcgttcgcgttcgcgtcccacaccttgcagccgagcgcgcggaaatcggccgcgctgcgggaagcgcgcaggaaaccaaccagttcgccgatcgccgacttgaacgcgagcttcttggtcgtcacggccgggaagccttgctgcaggtcgaagcgcagcatcgcgcccggcatgctgatggtgcggatccccgtgcggttctcctgccaggtgccggtatcgagaatggtacgaacgagatcgagatactgtttcatgcgggttccttcggccgcgagggcggccgtacccgccaattttagcaagcgtgatgcggaagctcctgcaacggcgccgaaaaccctgtcagcgtgtcgcctcgatcgcgcatgccgtgcgcacacatcagccggtagagcgtgacgcgcgacacgccgagttcgcgcgcggcatcggcgaaacggccgcgatggcgcaacagcgcctgctcgatcgcctgccgttccgccgcctcacgcgcctccagcagcgacacgggtgcgagtgtcgcgaattcgttcagctcgagatcggcggcggtgatcatccgccctccgacatgacgatcgcgcggcgcacgcgattgatcagttcacgcacgttgcccggccacgaatagccgtacagcgacgcgaccgcatcaggcgaaaagccgcgcagacggcgatgcgcgtcgcccttgaaacgctcgagcatgtggcgcgcaagtatctcgatatccttgccgcgcgcagcggcggctcctcgatcttcagcacgcacaggcgatggaacaggtcctcgcggaaccgcccttcgcgcagcgctgcgtccatgtccacgtgcgtcgcacagatcacgcgcacgtcgacaggcaccgatacgtgggcaccgagccgctcgatcttgccttcctgcaggaagcgcagcaggcttgcctggctttcgagcggcaagtcgccgatctcgtcgagaaacagcgtgccgccgttggcggcctcgacgcggccgatcttgcgctggttcgcgccggtgaacgcgccgcgctcatagccgaacagctcggcctgcagcaacgtcgacgggatcgcgccgcaattgatcgcgatgaacggcgcgtgcgcccgcgacgagcgctcatgaatcgcgaccgccgtcagttccttgcccgtacccgattcgccggagatgaacaccggtgcgtcggtcgccgcgacgcggcgaatcgtcctgaagagcccgagcatcgcatcacaggtcccgaccatttcgccttcgctgcgtccggtgccgacgggcggtgcagcggtttcggtcagcgcgaccatgccgtgcgcatgaccgacggtctcgacgatccgcgacgtctcgtacggcatcgtcacgtagtcgaaacagtagtcacgaatgagatggcgcagcgtggcgtcctgcaactggccgcggcgcgtcgccgcgatccagccgatgtgctgaatgctcagacaggattcgagttcgcgcaggtccgagggcttgaagcccggcgaaaatccagcagcccggccgtcgcgacaccgtgctgcacgacgcgccgtacgtcccgcacggtctccgcgagatcgacacgccagccgcattcgtcgaaatggccgcgcaacgcgtcgttcggctcgcgcgaatagtagatcacatgccgctgatcgactcccatatgctcaccccgttcctcaaccgtctaacgattgccgtgcacgtcagtacgcgtgcgaaaggatcgaatcggggcagccgaaggcggctcgattcgccatgccgatgctcggcaacgacaaagcctcgcatgatggcgcttatctcgcgtccagttattttgatcaagatagcttagttataggcactgaatacgacaatccgatttcagtgccgtgggcgatacggccgaatcgctcaggaggtcgatgcatgtcaatcgtctgcacatagcacctgtgcagcgatgcatgcagtcatcgacacatgcgacgattttcatccttgaagcgtatcgattgaatccgcagtattcccgagccccctcgtttcaggcctgaaacattttcagccgttttccgacgcaactcgcaacgcttgcgcacgaatcgcagtctcgacaacggtcgcggcgcgatggcatgcatttcgctgaatagggaaaccgtcggagacagcgaccatgcgaaaacatcttttactttctttcgtgccgatgaccattgcggtcgcggccgccggcccgccctcgcccgtacacgcagacgaaagctcgaagccggatcacgccatgctgcttgcatcgaacgcgccgggcatgcagcacggtgtcggattcggcatcgtgaccgtgtcggcgccgcaaccgctgccggccggcaggacgtcggtgacactgtgggacgagatcccccgccgccccagttgccgatgccgctcccgataccgcagccaggcgacgtgcagcacgcgatggaaggcaccgcacaaggcagtacgcaccagtgaccgtcgaccgaaccatttgatcaggatgacgtattgatccgggcaggccggagagcatcgatcagaggctgcattcgcgatctctcgacacgaaacggttttgtgctccgtccccggcgggcacgcttttattcattccgtcgccgcgacgcgtggcttcgaccgtcgcggcgcacagcgccggaaggcggatgcgcgcacccggaaccggtgcgcgccgccgttccggtagaatcggcgccattccggttttcctctccccaccttcatgacgacgttgaccctgatcgtcgcgcgtgcccgcaacggcatcatcggccgcgacaaccagttgccctggaaacttcccgaggatctcgccttcttcaagcgcacgacgatgggcgcaccgatcgtgatgggccgcaagacccacgagtcgatcggccggccgctgccgggccgccgcaacatcgtcgtcacgcgcgatgcggcgcgacgcttcgacggctgcgacacggtcacgtcgctcgccgacgcgctggcactcgccgcgcgcgacggggtgcccgaggcgttcctgatcggtggcgcgcaactctacacggaaggtctcgcactcgccgacaagctggtcgtcaccgagatcgatgccgacttcgacggtgacgcgtcgttcccggcacccgacgccgagcactggcaggaagtgtcgcgcgatgcgcaccaggcggccgcgccgaacacgttcggctatgcgttcgtcgtctacgagcgcaagcgcggctgacgcatcgcgcgcaataaaaagcccgaccggctcactcacgccgtcgggctttttgtttgatggcggccgatgccgcgcgccgcttactgcccggcgatcgtcatctgctcgatcagcaccgagcccgtttccttcgtgccgcgcacgatcgaatcggcgccgatcgcgacgatatgccggaacatttcctgcaacgtactcgcgacggtgatttcctcgaccggatactggatcacaccgttctcgacccagaagcccgccgcgccgcgcgaatagtcacccgtcacgtagttcacgccctgccccatcagctcggtcagcaacaggcccgtgccgagcttcttcagcatcgcgtcgaaatcgtcgcccggctgcgtgttcgagctgcgcagcgcgaggttgtgcgagccgcctgcgttgccggtggtttgcgtgccgagcttgcgcgccgaataggtcgacaggaagtagccttcgaccacgccatccttgacgacgctgcgcgcacgcgtacgcacgccttcctcgtcgaacggcgcgctgcccatcgcgcgcggcacgtgcggatcctcgacgacctggatgtgcggcgcgaacaccggcttgccgagactgtcgaccaggaacgacgtcttgcggtacagcgcaccgccgctcaccgcctggacgaatgcgccgagcagaccggccgcgagcggcgcctcgaacagcacgggcaccttgcgggtgtcgagacggcgcgcgcccatccgcgcaagcgcacgctcggccgcataacggcccaccgcttcgggcgccgcaagatcggtcgcgctgcgctttgacgaataccagtcgtcgcgctgcatgtggcggccgctgcccgcgatcggcgcgcatgcgatgtagtggcgcgagtacgggtagccggacaggaagccacgcgacgtcgcgagcacgaactgcgaatgctgggccgacacgctcgcgccttccgaattgcggatctgcgggctgaccgcgaacgcggcatcttccgcgcggcgggcgagctcgacggcctcgtcggccgtcagtgcccacgggtggtacagatcgaggtcgcgcgggtcggtttcgagcagctcggcttcagcgaggccggcggcctcgtcctcggccgtgaagcgcgcgatgttgtaggcggcggcgacggtatccttgatcgcgcccggcgagaaatccgacgtgctcgcgttgccgcgcttcttgccgatgaacacggtcacgccgaccatcttgtcgcggttgtgctcgatcgtttcgacttcgccgcggcgcaccgacaccgacaggccgtcgccctcggagatttcggtcgcggcatccgtcgcgccgagggccttcgcatggcgaaggatgtccgaggcgatttccttgagctggtcctgcgtgtgcgggaaatagcgcgcttgtacgtcgagattggctgccatcgtcttgatatccggtggcgggcgggcgcccgcatgttcaaaatgttgcgtatcccgcgatcatagcaaggtccggggccggacaccgacaagcttggcgtatccgcggcgcgatacaatgccgtccatgacacgcaaaacccgaatccagccgatcgagcatgccgtcgaagacgacgacaatggctacgatcgccccagcaaatcccagttgaaacgcgaaatgcacgcgctgcaggagctcggccaggcgctcgtcgacctgccgaaggacgccctcaagcgcatgccgatgcccgaagatctcgcggacgccgtgcgcgaagcccgccggatcaccgatcacgaaggcaagcgccgccagctccagtacgtcggccgcgtgatgcgctcgctgaccgacgacgagacggccgcgctgcgcaccgcgctcgacgcgcagcgcggcgtgaacaaagccgcgacggcccgccttcactggatcgaacgcacgcgcgaacaactgctcgcgaacgacgatgcgctgaccgaattcctgcgccagcaccctgaagccgatatccaggaaggccgcacgctgatccgcaacgcacgcaaggaagcgcagcagggcaagccgccgcgctatttccgcgagctgttccagtggatcaaggccgccggcggcacgtccgatgcggacgacgaagcggcggacgacgccggagacgaccatgacgacgaagcgtaaccacccggacgagctcgtcgtcggcctcgtgtcgatcagcgaccgcgcaagcacgggcgtctacgaagacaagggcattcctgcgttgcaggagtggctcgccggcgcgctcacgtcgccgtggcgcgccgaaacgcgcctgatccaggacgatgcgcccacgatctccgccacgctcgccgagctcgtcgacgtcgcggggtgcgacctcgtgctgacgaccggcggcacgggccccgcgcgccgcgacgtgacgcccgaggccacgctggccgtggcgacgaaggaagtgcccgggttcggcgaacagatgcggcagatcagcctgaatttcgtgccgaccgcgatcctgtcgcggcaggtcgcggtgatccgcgaaacgacccaggccgaccatgcggcgctgatcatcaacctgccgggccagccgaaatcgatccgggaaacgctcgaagggctgcgcgatgccgacggcaagtcgaccgtgcccggcatcttcgccgcggtgccctactgcatcgacctgatcggcggcccgtatatcgagaccgacgccgcggtggtcgcggcgttccggccgaaaagcgcgcggcgctgagcctgtgcccggcgccgggcgcgtgccggcccgctcaggcggccggcgcggactcgcctgccggagccgacgcggccggaatcaggaaatgctcgcggtagtacttcaactcgtcgatcgactcgtggatgtccgcgagcgccgtgtgcatcgcccgcttctggaaccccttgtagatcgccggctgccagcggcggcacagctccttgagcgtgctgacgtcgaggttgcggtagtggaagaaccgctcgaattcgggcatccagcgcgccatgaagcggcggtcctggcagatcgagttgccgcacatcggcgacttgccgggcgacacgtactgcgcgaggaaggcctgcagctgcgcggcggcgtccgcctcggtcacggtcgacgcgcgcacgcggtcgatcaggcccgagcggccgtgcgtcgacttgttccagtcgtccatcttcgcgagcgtttcgtcgctctggtggatcgcgaacacgggaccttcgacggcgacgtcgagcgtggaattggtcacgacgaccgcgatctcgatgatgcggtcgttatccgggtcgaggcccgtcatctccatgtcgagccagacgaggttcaactcgttgcgcacgagcgcgggctggctggtggaagcggcggtatcggtcatgagtcatcctggaaaatggcgggcagcgcgcggcgccgcccgggcggccggcatcgcatcagcgggcccggtccgcaagaacatataattctcgcatagaaccctttggcgccttcgatgtcacccttttcgttcaccctgctgttcgcgctcgccgtgctcgcgatggtcgtcaccaagctgtggctcgcgtcgcggcagatccgcttcgtcgccgcgcaccgcaacggcgtccccgcgcagttcagcgcgaccatcccgctgaccgcccaccagcgcgcggccgactatacggtcgagcgcacccggctgacgatgctcgagatcgtcgtcagcgcggccgtgctggtcggcctcacgctgctcggcggcgtcggcgcgctcgacacgctgctcaccggctggctcggccgcggctacgggcagcaggtcgcgctcgtcgccgcggtgctcgtgatcacgagcgcgatcgacgtcccgttcgagtattaccgccagttcggaatcgaacagcgcttcggcttcaaccggatgaccaagcggctgttcttcaccgacatgctgaaaaactcgctgcttggcgccgcgctcggcctgccgctgctgttcgtcgtgctgtggctgatgaaccaggccggcagcctgtggtggctgtggacctggatcgtctgggtcgcgttccagatgctcgtgctgctgatctacccgaccttcatcgcaccgatcttcaacaagttcgaaccgctcaaggacgacgcgctgcgcgcgcgcatcgagtcgctgatgaagcgctgcggcttcgcggcgaagggcctgttcgtgatggacggcagccgccgctccgcgcacggcaacgcgtacttcactggcttcggcgcctcgaagcggatcgtgttcttcgacacgctgctcgcgcggctgtccggccaggaaatcgaggccgtgctcgcgcacgaactcggccacttcaagcgccgccacgtgatgaagcgaatgctcgtgtcgttcgtcctgagcctcgtgctgctcgcgctgctcggctggcttgcgcagcgcacgtggttctacacggggctcggcgtcacgccgtcgctcgacacgagcaacgcgggcgccgcgctcgtgctgttcttcctcgcgattcccgtgttcctgttcttcgcgacgccgttcggcagcctcacgtcgcgcaagcacgaattcgaggccgacgcattcgcggccagccagaccgacgcgcaggatctcgtcagcgcgctcgtgaagctctatgaggacaatgcgtcgacgctgacgcccgaccctgtctacacggccttctactactcgcatccgcccgcctcgcagcggatcgaccgcctgctgcagcacgcatgagccggccgacctcccgcaagccggccccgcgcgcgtcgggcgcgcagcgtgccgaaggccgcgtgatcgcggcgcacgggcgtcactacatcgtcgcgcccgacgatggcggcccgatgctgcagtgcttcccgcgcggcaagaagagcgatatcgcggtcggcgaccgtgtcgcgtacgaactcgcctcggccgaccagggcgtcatcgtcgagatcggcgaacggcgcaacctgctgtaccgttccgaccagttcaagtcaaagctgttcgcggccaacctcgaccagttgctgatcgtgctcgcgaccgagccctatttcagcgaggacttgctcggccgcgcgctgattgccgccgaggcgaacgagctgaaaccgctcgtcgtgctgaacaagatcgacgtcgaggccgcgctgccggtcgcgcgcgagcgcctcgcgccctaccgcgcactcggctacgacgtgctcgagctgtcggtgaaaggctcgcccgacgacgcgcgcgcgcaactgatgccgcacctcgccgggcattcgacgatcctgctcggccagtccgggatgggcaagtcgacgctcgtgaacctgctcgttcccgacgccgaagccgccacgcgcgagatttcggccgcgctcaacagcggccgtcacacgacgacgttcacgcgcctctacccgctggaaggcggcggcgccctgatcgattcgccgggcttccaggaattcggcctctaccacctgacggaaggccgtctcgagcgtgcgtttccggagttccggccgctgctcgcggactgccgtttctataattgccatcatctgcacgaacccggctgcgcgattctcgaagccgtcgccgacggccgcatcgcgccgacacggcatgcgctgtatgcgcagctcgtgcacgaggcaagccagatcgtccgctgatcgcgcggcggccagccggtgccatgcggggccggcccttaccgacaggagccgcgatgcgtttcaaggcacccgatctcgcgacggcgcagcattgggccaacgtgctccaggtggccggcatcggttgcgagctgcataactgctacgcgaccggcgcactcggcggcctgcctgccgacgcgtgcacgcccgagctgtggctcgacgacgaacgcgacgacgcgctcgcgcgccggctcctcgatgccgcttcgcacggcccgttggccggcgccgcgccgtggcgctgccggcagtgcgggaggcgctcgaggcccagttcacggcctgctggcaatgcggcgccgtgcgcgacccgcgcgacgattgacccgcacagcaaaaggccggcatcaagccggccttttgtctttcatcgggcaacgcactgccccgtcacgacacccagacggcgagcgtcagcatcagcagcagaatcatccacaggatcaccgcgcgccagacaaggccaaccgcggattgcagcgtacgcggcgtgcaatcgtcgccgaccgtcaacggaccgctgtcaccgaccgccagcgcatcgaggctcgacggttccgcgagcggccccgcgaggcgcgcgccgagcgcgccgctaccggctgccagcaggacgccgtcgttcggatcgggccactggcgcgtatggttgcgccacgcgtagatcgcgtcctcgaagttaccgacgattgcaaagccgagcgcggtcagtcgcgagggaatccagtcgatcacgaagaacgcgctgcgcgaacgtcgagaaggctgccgtgcggtcgtcgcccggcgtcgaccagctgcgcgcgaggtattcggaaatccggtacagcacggcaccggccgggccgatcggcagcacgtaccagaagaacacgccgaacacgtgacgatgcgatgcgacaacggcgtgaatcagcgtatggcggacgatttcgccgaccggcatgtcgaccgtgtcgatacccgtccactcgtgcaggatttcgcgcgcacgcggcacgtcatcgttgttgagcgcgaggtggatgtcggtgaagtagtggctgaactggcggaagccgagcgtgaaatacacgacgacgacgttccagatgaacgcgagcacgaagctcaccttgtacagcaggaaatagatcagcgcgacgatcagcacccacggcagcacgaccgcaagccatgcgaggatgccgtgcttctgcttgcctgcgtcgagaccatgcgcgacggtttccgcatgaaactggaacagcgcgaacaccggattgttcggcgacaacgcgcggacctgttcgatgatgagggcgaggagaaccgaaaagaaagtcatgcgtggcgccgtcttcggagttatgtcatttttgcataacgatagcacagcgtaagcaccggatggctgccggcgcggtcgtgcggcagccggccgcgcgcgccagccgccgtgtgcgcctagccggcggccaagaagcggtacagattgcgcaacatgccggcagttgcgccccagatgaagtaatggccgccgggttcgccattcggataaggcatcgcaaaaacgacgctcgccgccttcccagcgaaacaccctgacctgatggttcgcgggattcatcaggaacgcgagcggcacttcgaaaatctcggccacttcgaacgtgtcggcctgcacggtgaacggcggatgcacgaggccgaccaccggcgtcacgcagaagcccgtgccagtcaggtagtcaggcaacgcgccgaggatctcgacacgctcgtccgccagcccgatctcttccttcgcctcgcgcaacgcggttgcggtcgcgtcgcggtcgaacggttcgcggcgaccgccgggaagctgatctgtccggcgtggtcgttcaggtggtcggcgcgctgggtcagcaacatggtgaggccggactcgcgaacgacgagcgggacgaggacggccgcgctacgcggatcgacgccctcctgcagtctcgcctcgtcgggctcgacgctccactcgagcgtgcgcgcgaaacggtcgcgcaggccggacggtgtcatcaggcgggaatcgatggccggcaagccggcgccggtgccttcgaccggcaggacttcgggatcgatgatggggcggcgattcaatggggctctcgtgtttgtgtcgtatcgagcatattgtcgcgccagaatgaaaaagcacccgggtgggtgctttttccttacagctcttactcttgggaagctgctgcggcgcgatccttcgacaccagcttttccttgatacgagccgacttgcccgaacgctcgcgcaggtagtacagcttcgcacgacgcacatcaccgcggcgcttcacgacgatgcttgccagcagcggcgagtacgtctggaacgtacgctcgacgccttcgcccgacgagatcttgcggacgatgaaattcgagttcaggccacggttgcgaatagcgatcacgacgccttcgtaggcctgaacgcgcttgcggttaccttcaaccacgttcacgttcacgatcaccgtgtcgcccggggcgaattcggggatcgtcttgccggcgagcgcgcgctcgatttcttcctgctcaagttttgcgatcagattcattactgactccttatgccatcgtgtcggcgttggtacccgcctgcttccaggcctggccccgatagaggatggattcacatcaggcaccgcacacgcatgcacggcaccgccaattcccgcccgcgacaccgcctcaggaggcgtctttcgcttcgcgtgcgaggttcgcaagccacgcctcgtcggcccggctcagcaacttctcgcggcgcgcccggacgatcaggtccggccgcttccgcaacgtattcctcaatgcttcctggcgccgccaccgctcgatctcggcatgatgcccgccgagcagtacgtccggcacgcgcatgccatcgtattcctcggggcgcgtgtagtgcggacaatcgagcaggccgtcggcgaaactgtcctgcacggccgacagcgaatcgttcagcacgccgggcaacaaccgcaccacggcatccatcatcgccatcgccggcagttcgccgcccgacaatacgaaatcgccgaggctgatttcctcgtcgacgcaacgatcgagcaggcgctggtcgatcgcttcatagcggccgcacagcacgacgacaccgggttcctgcgccatccgcaccgcgcgatcgtgcgtgagcggtgcaccttgcggcgacatcatcacgacgcgcgtgctcgcgataccctgttccgcctgcgccgctttcgcggcatcgatcgcggcttcgagcggcctggccagcatcaccatgcccggaccgccgccgtacggacgatcgtcgaccgtgcggtagttgtccgtcgtgaaatcacgcgggttccaggtgcgcaacccgaagcgcccttgcttgacggcccggctggtgatccccagtcggtcagtgcacggaacatctcgggaaagagcgtgacgacgtcgaactgcaccgcgctctcggtaacctggttcatttcagtaatcggcttcccagtcgacgacgatgcgacgcgccgcctgatccaccgttttgacgtatacgccgacgaacggaatcaaccgctcgtcggtggtcggctgaccgtctttgccggtcgccggatactcgacacgcatgatcgaatgcacgccgttgtcgatcatcccgctcacctttccgagcgccaccgattgctcgttgacgacatcgagaccgatcaggtcgacccaatagaattcgtccgcggccaatgccgggaaatcttcccggcgcacgaacacgcgaaaaccgcgcatggccagcgcggcatcgcggtcgctcacgcccgcgggttgcgcaacgacagtgtcgctgtgcgtcttcgactgcaggatgcggacggaaagccgctccgcaccgcgttccagccaccagcggcgtgccttgagcagcgcatcgccaccgcgaccggcgtcggcatgcgtcgccaccttgacccaacccttcaggccataggcgtcgacgactgccccgacctcgatggcatcgtcgggccaggcttgcgccacttcgagactgccctgctcggcagcctgaccggcgttcgcgacaacgtcgcgctcgaccggcttgcggacgaatgcgccaaacgacgcacgcccgcgccttgcattaccggaatcgtgacccgccatcaatgcacctcacagccggcacgaccggcacaccgtgccatgttaggcagccggttgcgcctttgcgcttccttcacgagacgctggacggtcggcgacagttgcgcgccaacgccttgccagtacgtcaggcgatcctgagcgatacgcagcgattcgcccttcgtggcgaccgggttgtagaagccgacgcgctcgatgaagcggccgtcacgacggttgcgcgaatcggtagcaacgatgttgtagaacgggcgcttcttcgagccgccacgagccagacggatgataaccatatgatgtccttcgggaaaaccgggttcgaaactactgaaacacgcgattatagccgaaaaccagaggtacaacaaacacttacgcgcaaaaatccgcgggcggcctgtccgccgggcatagaatcgtcgtgtccgggacgttccacaccgtcatgccgccccttcgcgccgcctcgatgcgccgcgcgcagcaccgtttcgcggcgctgcttgccggccttgcctgcctcgtatccgcaatggcgtcagccgcgccgctgccggtaggcgaactcgtcgtgccgcccggtttccacgtcgaagtgctggccgacgcggtaccgaccgcgcgcgaaatggcgtggtcgccacgcggcatcctgtatgtcggcacgcgggaaggccgcgtgcacgcgttcgtgatgcacgagggccggatcagcgcgcgctacgtgatcgcttccgggctcgacatgcccgtcggtgtcgcctaccgtgacggcgcactctatatatcagccgtatcgcgcatcctgcggctcgatcgcatcgacgaccggctcgccacgccacccgcacccgccgtcgtcaccgacgcgctgccgaccgaacaccatcacggctggaaattcatcgcgttcggccccgacggcaagctgtacgtgccgaccggcgcaccgtgcaacgtctgtctcgcggatcgcagccgctacgcgatcatcgcgcgcatgaaggcggacggcagcgggagcgaggttgtcgcccgcggcatacgcaatacggtcggcttcgcgtggcaccccgattcgggcgagctgtggtttaccgacaacgggcgcgacatgatgggcgacgacgtgcccgacgacaagctgaaccgcgcaccgcgcgcgggcctcgacttcggcttcccgtactgccatggcggcgacacgcccgaccccgaattcggcagccccgacgtttgccgccgctacgtgccgcccgtattgaaactcggtgcacacgtcgcggccctcggcatgcgcttctatacagggccgatgtttccggcgtcgtaccgcaacaacgtgttcatcgccgaacacggctcgtggaaccgcagcacgaaggtcggctaccgcgtgatgcgtgttgtggtctcggcagacggcagccacgcgcgccagactccgttcgtcacgggctggctgcggcccgacggcacggtatggggacgccctgccgacgtgctgccgctgccggacggctcgctgctcgtcagcgacgactacgcgggcgcaatctatcgcgtgacctatgcggcaccttgacgcagtacagggtgaccggccccgaccgggcatcgtagaatgcgtgccgggccgcgcgcccgcgccggcccgccggccgcccatgccaacgacaatacgccgccatccatgtccagcagcaccgcaccgtcccgccgcttccgctccaagacgctcaccgccgccctcgcgttcctgttcggttcgctcggcgcgcaccgcttctatctgtatggctttcgcgacgtgtacggctgggcgcacctgctcgcgacgatcgtcggcatcccgggcttcctcttgctcgccgcgacccagcgcagcgccggcctcggctggtggcttgcggtacccggcgcaatctcgctgctggccgccttcctcgccgcgctcgtctacgggctgcgtcccgacgaaaaatgggacgcgcaattcaacgcggagacgggcaggcacagcaagtcgggctggaccgtgatcttcgtggtgatcttctcgctgctgatcggcgcgttcctgctgatgaccgcgctcgcactgtcgttccagacgtatttcgagtcgcaggtcgaagcagccaagcagatttcgcagtaagcgcaacgaacgcgacgcaccggcaccccgcgccggcttggcgcgccgatcagaacaggttcaattgcatgtcgtcgcgcgcctgcgtcgatcgcgtgccggctgaacgaacagcaacacgcagcaccggcgctgcggcggccggcgtgccgcgaaactgcgacagatcgagaatgccgttcgtgcgctcgttcagcccgagccgcttgacggcctggcggaagcgctgccgcagcaggtcggcccagattccctcgcccttcatccgtttcgagaaatccgagtcgtagtctttcccgccgcgcatgtcgcgcacgcggttcatcacgcgctccgcgcggtcgggaaaatgcgcggccagccagttcttgaacagcggcgcgacttcccacggcaacctcaggatgatgtagctcgcatgcgtcgcgccggcttccgcgcacgcctcgagcacacgctccatgtcgggctcggtgacgaacggaatcaccggcgcaatgctcacaccgaccggcacgcccgcctcgctcagcgcacgaatcgtacgcaaccgtcgcgccggcgtcgccgcgcgcggctcgagcgtgcgcgcaagatcggcgtccagcgtcgtgatcgtgaccgccgccatcacctgcttgcgctcggccatcggcgcgagcaagtcgagatcgcgctcgatcagcgacgacttcgtgatcgccgcgaacggcaacccgcgatcgtgcatcacctgaatcacgctgcgcgtgatgcgcaagtcgcgctcgaccggctggtaggcgtcggtgttgacgccgagcgcgatcggctccggcacgtagcgcttgcgagaaatctcgcgctcgagcaactcggccgcattgaccttcgcatagatgcggctttcgaaatcgagccccggcgacaagccgagataactgtgtgtcggacgcgcaaagcagtagatgcacccgtgctcgcagccgcgatacggattgagcgatacgctgaatggaatatcgggcgactggttgtgcgtcaggatgctcttcgcccgctcctcgaatacctgcgtgcgcagcggcgcggggaaatcggcatcgtccgactcgtgtgtccagccgtcgtcgaccgcttcacgctgggcgatctcgtatcgcccctgcaggttgtcgaccgcaccgcgccttgcggggcacgggcggcgctatcggaaattcgttgtcggatcgatcgtccatatgcccacccattcgcctgcgcccaatactgtacatttatacagtattgggcgcagcgtgccaagggcgggataaagggtccggcggcctgccgccggtacgtcagtcgcccaccgcgatcgtcagcgtctccttgatttcttccatcacgacatagctcttcgactgcacggcgccgggcaactgcagcaggatgtcgccgagcagcttgcggtagtcggccatttcgccgatccgcgccttgatcaggtagtcgaaatcgccggacacgagatgacactcgagcacctcgtcgatcttcatcacttcccggcggaattgctcgaacatgttgccgcccttgtggccgagcgtgatctcgacgaacaccagcagcgcggcatccagctggtggggatcgacacgcgcgtgataaccggtgatcacgccgtcccgctccatgcgccgcacacgctcgatacacggcgtgacggtcagtccgacctgttccgcgaggtccttcatcgccatccggccgtcgtcctggagcagtttcaggatgcgccggtcgagcttgtcgagcgagcgtacgggctgacgttgcgttctcatttgtttatgctgaaaacctgaaaaatacgataacaaaacctacacattcgacaataccatagcgcaaaaactagatcagctagaggttacacggagccgcaggtgcgcccggcctcgatctggtcccttccatctggagcagctatgcgagtcgtcattctgggcagcggtgtggtgggcgtggcaagcgcgtattacctcgcgcgcgccggtcatgaagtcacggtgatcgaccgggaggccggcccggcgctcgagacgagcttcgcgaacgctggccagatctccccggctatgccgcgccgtgggccgctcccggcgtgccgctgaaggccgtcaaatggatgttcgagaagcacgcgccgctcgcgatccgcctcgacggcacgcgcttccagctccagtggatgtaccagatgctgcgcaactgcacggccgagcgctatgccgtcaacaagggccgcatggttcgcctcgccgaatacagccgcgactgcctgcaggcgctgcgcgccgataccggcatccagtacgaaggccgcacgggcggcacgctgcaactgttccgcacgcagcagcaactcgacggtgcagcgaaggacatcgccgtccttcaggaagcgaacgtgccgttcgaactgctgtcgccggccgacctgaagaatgccgaaccggccctcgccgccgtttcgcacaagctgacgggcggcctgcgtctgccgggcgacgaaacgggcgactgccagctgttcacgacgcgtctcgcggcactcgcggaatcgctcggcgtgaagttccgctacaacacgccgatcgatgcgctcgcgatcgcgggcggcaagatcgccggcgtgcagtgcggcagcgagacggtgcgtgcggacgcgtacgtcgtcgcgctcggctcgtactcgaccagcttcatctcgaacctgatgaagatccccgtctatccgctgaagggctattcgatcaccgcgccgatcgtcaacgaagcggccgcgcccgtgtcgaccgtgctcgacgaaacctacaagatcgcgatcacgcgtttcgaccagcgcatccgcgtcggcggcatggcggaaatcgtcggcttcgacaagaagctgcgcgccgcgcgccgcgagacgctcgaaatgtgcgtgaacgacctgttcccgggcggcggcgatacgtcgaaggcaacgttctggacgggcctgcgcccgatgacgccggacggcacgccgatcgtcggccgcacgccggtgtcgaacctgttcctgaacaccggccacggcacgctcggctggacgatgtcgtgcggttcgggccaactgctcgcggacctgatctcgggcaagatgcctgcgatccaggctgacgacctgtcggtacaccgttacctgaaggacgtggcaggccagacgcgcccggcctacgcataagccgcagccgcccgcggcaatgcgggcctgctggccggcatcaagagaaaggcgcccgggggcgcctttttcatgacgtcgagtgtcccgcgaagaatcagaactggtcttccgtcaacgcgagcacgccctcgttgcccttcgtgccgacaatcgacgcttcgagcgcgcctgcctgcaccagcacctgctccgcatagagctgcgcgatcgcgatcttcgcaccgaagaacgccgggtcgctcgcgcggttcgcctgcgctgccaccagcgcacgcgccatctgccatccgcacagcaccacgcccgccagcttcaggtacggcacgctgcccgcgaacaccgcgttcgggtcctgcttcgcgttcgccagcacgtaatccaccaccgacgacagcgccttcgcgcccttctccagctgcaccttcatcgacgcggccgctgcaccgtccagcttgcccagcgccgcgacagtctctccgatttcggcgatcagcgccttcgccaccgcgccgccgtcgcgcagcgtcttgcggcccaccaggtcgttcgcctggatcgccgtcgtgccttcgtagatcgccaggatccgcgcatcgcggtaatactgcgccgcgccggtttcctcgatgaaacccatcccgccgtgcacctgcacgcccaggctcgccacgtcgttcaccatctccgtgctccagcccttcacgaccggcaccagatattcgtagattgcctgatgacgcgcccgcgtcgcctcgtccgaatggcggtgggcaatgtcgctgtgcgccgcggccacgtatgccagcgagcgtgcgccttcggtcagcgcgcgcatcgtgccgagcatccggcgcacgtccgggtgatggatgatcgtcaccgactgcttggccgacccgtccaccgggcggctctgcacgcgctccttcgcgaattccgcggccttctggtacgcgcggtcggccacgccgatcccctgcatcccgacgccgaagcgcgccgcgttcatcatgatgaacatgtattcgaggccgcggttctcttcgccgatcaggtagccgatcgcgccgccgttatcaccatattgcagcaccgccgtcgggctcgccttgatcccgagcttgtgctcgatcgatacgcaatgcacgtcgttgcgttcaccgagcgagccgtcctcgttcaccaggaacttcggcacgatgaacagcgagatgcccttcacgccttccggcgcgttcggcgtgcgtgccagcaccaggtggacgatgttgtccgccatgtcgtgctcgccccacgtgatgaagatcttcgtgccgaacaccttgtacgtgccgtcgccctgcggttcggcgcgcgaacgcaccagcgcaagatccgagcccgcctgcggctcggtcaggttcatcgtgccggtccattcgcccgagatcagcttcggcacgtagcgctgcttctgctcatcggtgccggccgtcagcagcgcctcgatcgcgccgtcggtcagcagcgggcacagcgcgaacgacaggttcgccgcgttcagcatctcgatgcacggcgtcgcgatcagcttcggcagcccctggccgtcgtattcggacgggtgctgcagccctgccagccgccttcgacgaactggcggaacgcttcgccgaagcccggcgtcgcggtcacgacaccgggcttccagctgctcggattgcggtcgccttcgacgttcagcggcgccagcacctcgccgcagaacttcgcggactcgtcgagcacggcctgcgccgtgtcgtaaccggcgtcctcgaaacccggcagttgcgcaacggcgtcgatgcccgcgagttccttcagcacgaacagcatgtccttgacgggggcgttatagctcatggtgtgtctcctcttctctcttctgtcgatggcgaaaaagggacgctcgtcgcgcccctcttctcgtgtgcttaccgcctgagcgtcacactgcgtcagccgagctcgttcacgagctccggcacgagcgcgaacagatcgccgacgaggccgtagtcggccacgctgaagatcggcgcttccggatccttgttgatcgcgacgatcaccttcgaatccttcatcccggccagatgctggatcgcacccgagatgcccaccgcgatgtacagctgcggtgcgacgatcttgccggtctggccgacctggtagtcgttcggcacgtagccggcgtcgactgccgcgcgcgatgcgccgagcgctgccgacagcttgtccgccagcggctccagcaccttcgtgtagttctcgccgctgcccagaccacggccgcccgacacgatgatcttcgcgctggtgagctccggacggtccagcttcgtcacttcacggctcacgaactgtgacttgccggcgtctgccgccgcttcgatcttctcgaccgacgcgctgccgccttccgctgccaccggatcgaaaccggtcgcacgcaccgtgatgaccttgatcgggtcgctcgactgcaccgtcgcgatcgcgttgcccgcgtagatcgggcgctcgaacgtgtcggcactgtcaaccgccgtgatgtccgagatctgcgcgacgtccagcttcgcggcgatacgcggcgcgatgttcttgccgtaagcagtcgccggcgcgaggatgtgcgaatagtccttcgcaatgttcagcgcggtcgcttcgacgttttccgcgagacctgcttcgagttgcggcgcgtcggccagcagcaccttcgatacacccgcgatctttgctgccgcgtcggctgcgccttgcgcattgtggcctgcgaccagcacgtgaatgtcaccgccgatcttcgctgccgccgccaccgtgttcagcgtcgcggccttgatcgacgcgttgtcgtgttctgcaatcaccagaatcgtcatttctttccgctccctcttacagcaccttggcttcggtcttcagcttctcgaccagcgtcttcacgtccggcaccttcacgccggctgcgcgcttcggcggctcggtcaccttcagcgtcttcagacgcggcgcgacgtccacgccgaggtcttccggcttcaccgtttccagcggcttcttcttcgccttcatgatgttcggcagcgtcacgtagcgcggctcgttcaggcgcaggtcggtcgtcacgaccgccggcagcgtcagcgacagcgtttccgcgccgccgtcgacttcgcgtgcaaccgttgccttgccgtccgcgatcgtcaccttcgatgcgaacgtcgcttgcgggagaccagccagcgcggccagcatctggcccgtctggttcgagtcgtcgtcgatcgcctgcttgccgaggatcaccagttgcggctgttccttgtcgaccagcgccttcaggatcttcgcgacggccagcggctcgacgctgtcgttcgattcgacgaggatcgcgcgatccgcgccgatcgccagcgccgtgcgcagcgtttcctgcgcttgcgtgacgcccaccgacaccgcgatcacttcggtcgcgacgcccgcttccttcaggcgcaccgcttcttccaccgcgatttcgtcgaacgggttcatcgacatcttcacgttcgcgatgtcgacgcccgtgttgtccgacttcacgcggaccttcacgttgtaatcgaccactcttttcactggcaccaggattttcatgcacacgctccaaagttacgaatacgaccagaggccattctatagcgaggcctcatgactgcgcggccaagcggacccaaccatcatggttgtcgaggataccgcttcttgacgacgcgccaatgatagcgaacgatcgttctattttaaagagaaaaacccggacgcaaagcccgggttttcgatcatcgactctaatctctccgggcgtcccgttgttcgcccgttaccaggcggcaatgaccgctccgccgaacttgccttcgatgaactgcttcacatcggccgaatgataggccgcgatcagtttcgccacccacggcttgttccggtccgcctcgcggatcgccaagacgttcgcgtacgggccgctcggcccttcgatcgcgatcgcgtcctgtttcggtttcaaccccgcttccatcgcgtagttggtattgatcgcggccgcgtcgacgtcgccgagcgaacgcggaatctgtgctgcatcgagctcgacgatcttcagcttgcgcggattgtcgacgatatcgagcggcgtcgccttcagccccgcgtccgcacgcagcttcaacaggccctgcttctgcagcaacagcaacgcacggccgccgttggtcggatcgttcggaaccgcgatgcgcgcgcccggcttcagctcggccagcgacttcacgcgcttcgagtagatgcccatcgggaacgtgacggtatccgcgaccttgatcagcttgtagccgcgatccttcacctgcgcctgcagatacgggtcgtgctggtagctgttcgcatcgaggtcgcccgacgcgagcgcggcgttcggctgcacgtaatcggagaattcgacgatgcggatgtcgaggccgctcttcgccgcgaccttcttcaccgcctccatgatctgcgcgtgcggcccacccgtcacgcccaccttgatggtttcggcctgtgcgtgcgcgcccgcgaacagtgcggctgcgccgagtgccaccgcgaacttcagcatgaagcgtcgttgcatcgtctctctccctaacggatcaatttcgtcttatttgtggctcagccggcggacgagccagtcgccgaacgactgcacgatctgcacgaacacgatcaggatcgcgacgaccgtccacatcacttccggcagatagcgctggtagccatagcggatcccgagatcgccgagcccgccgccgccgatcgcgcccgccatcgccgaatagccgaccagcgacacgaacgtgatcgtcaggcccgcgacgacacccggcagcgattcgggcaacagcaccttgaagacgatctgcgacgtggtcgcgcccatcgattgcgcggcctcgatcagcccgcggtcgacttcgcgcagcgccgtctcgacgagacgcgcgatgaacggcgcggccgcgagcgtcagcggcacgaccgccgcggccgtgccgatcgacgaacccgtgacgagtcgcgtaaacggaatcaccgcgaccagcaggatgatgaacggcgtcgagcggacggcattcacgatgccgccgagcacgcgattcaccgcgaggttctgcagcacgccctggcggtcggtcaggtagagcagcacgccgagcggcaggccgacgagcgcgccgaccgccccggagatgccgaccatgatcagcgtctcccagaacgactgcacgaacatatcgaacatctcactcaacatacgaaagctcctctaccaccacaccttgttcgcgcaggaacgcgagcgcctgcccgaccttgcccggctcgccgcccgcgagcaccgcgagcgaaccgaatgcctgaccctggatctcgtcgatctggccatgcaggatgttgaaatcgagttcgtaccgacggatcgtttccgacaggatcggctggtcgacgcccgagcccgtaaacgccagccgcagcagatgcccgctgccggtcttcagccgctcggccacgcgcgccttcagcgcgggcggcaactcctgcgcgatcacgtcgccgatcagcgcgcgcgtcacttcgtgatgcggctgcaggaacacgtcgatcacgcggccttcctcgaccacgcgccccgcatcgagcaccgcgacgcgatcgcacacctgcttgatcacttccatctggtgcgtgatcagcacgatcgtcaggccgagttcgcggttgatgcgcttcagcaggtcgaggatcgagcgcgtggtctcgggatcgagcgcggacgtcgcttcgtccgacagcagcaccttcggctggctcgcgagcgctcgtgcgatgccgacgcgctgcttctgcccgccgctgatctgcgacggatagcgatccttctgcgcggacagcccgacgaggtcgagcagcggcagcaccgcggcctcgatgtcggcacggcttgcgccggccagctcgagcggcagcgcgacgttgtcgaacaccgtgcgcgacgacagcaggttgaagtgctggaagatcatgccgatctcgcgtcgcgcctcgcgcagcgcgccagccgacagcagcgtgagatcgagcccgccgacgacgacattgccttcggtcggccgcgtgagcaggttgatggtgcgcacgagcgtgctcttgccggcgccgcttcggccgatgatgccgaacacctcgccctgcggaatcgtcaggttgatgttgcgcagcgcctcgacccagccgcccggcccgggaaatcgctgcgaaagattgcgtaattcgatcatgtaaacaaaacggcggccggccggcgagttggcccgccagtcggccgccgatgcatctggaataactgtcgattttaccgcaaacccctcattccccttaataatcgatttcgatcttttcataaccacacgaaattagagggacgccgctggcgcgccacgacgatgccgcgactatgatccggaacaccgaccaaccgacaggggacacgccagatgaccgccaccaccacgccgggcgccgcacctgccaccgccggaccggcgccatcgtccccacccacgccgacgatgggccgcctgcgtaccgccgacgggctcgaactggcgtcgtaccgctggccggctggcgacggcaccgagccgccgcgcgcgacgatcgcgctcgtacatggccttgccgaacatgcgggtcgttatgccgcgctcgccggccggctgaatgcggccggcatcgaggtgctcgcgatcgacctgcgcgggcacggccagtcacccggcaaacgcgcctgggtcgagcgcttcgacggctatctgaacgatgcggatgcgctggtcgccgaagccgcacgcggcaattcgccgctgttcctgatggggcacagcatgggcggggcggtcgcggcgctgtacgcgatcgaacgcgcgccggcacgcggccacgcgctggccggcctcgtgctgtcgagcccggcgctcgcgccgggacgtgacgtgccgcgctggatgcttgctgtgagccgcgtcatcagccgcatatggccgaccttcccgcaatcaggatcgatgccgcgctgctgtcgcgcgatccggccatcgtcgcagccaatcgcgccgatccgctcgtccatcatggcccggtgcccgcgcgcaccggcgcggagattctcgacgcgatggcacgcatcgaaagcggtcgcggcgggctgcgcgttccggtgctcgtctatcacggcaccgaggacaagctgaccgaacccgacggcagccgtgcgttcggtgcgtgcgtcggctcgcccgatcgcacgttgacactgtacgaaggcggctttcacgaaacgatgaacgatctcgaacgcgatcgcgtgatcgacgcgctgatcgcgtggattcatgcgcgcgtgccggcgcgctgagcgcgcccggcccggccggtcacgcgatcgtcagatgccggccagtacgcgcaggtgcgcgacgacgctgcgcccgagcgcggacaggttgtagccgccttcgaggcagctcacgatgcgcccctgcgcatgccggcgcgccacctcgacgatctgcgcggtcaaccattcgaaatcggcttcgacgaggccgagattgccgatgtcgtcctcgcgatgcgcatcgaaacccgcggacacgaacagcatctgcggcttgaacgcatcgaggcgcggcagccagaacatgtcgacggcttcgcggatcgccatcccgttgctgcgcgcgggcatcggcaggttgaccatgttcggcgcctggtgatcgacgcccgagaacgggtacagcggatgctggaagaagctgcacatcagcacccgctcgtcgttcgcgaacgccgcctcggtgccgttgccgtgatgcacgtcgaaatcgatgatcgcgacacgctccagaccgtgtacgtcgagcgcatgtcgcgcggcgatcgcgacgttgttgaagaagcagaaacccatcgcacgcgcaggctccgcatggtggccgggcggacgcacgccacagaacgcattcgcatagcggccttcgatcaccgcgtcggtcgccgcgatcgcggcgccggccgcacgcaacgccgcgcgccacgtatcgcggttcatcagcgtatcgggatcgatctcgacgtagccgtcgaccggcgtcatgctccggatgtagtcgatgtgcgcctgcgtatgcacccggcccagcgccacctcgctcgcgaacggcgcggtttcgtgcacgatcagatcgtcgatgcggctcgcgatcagttgatcctggatcgccgacaggcgggccggacattccggatgccattccccatctcgtgcagcatgcagtcggggtgcgtatagaaagcggttgccataagctgtcatccgcggcgcacggtgcgccgcaggtctccatcaatgatgtccatcgtctgccgcgaattcgccgctaacttaccacaacggggcctgccacgccccggcgcgccggatccgtcgggtatctgcgccgaacccaatcgccctgtccgcccgcttcgacatgaattccagcaagcctgccgcccttctctccgcgctgttccgtgttcgcgttccgctcgtcgcggccgctgtcgtcgcggccctcggcgccgcgcccgccggcgcgcagacgcaacccgcgaagcccgcgggcacgctcgtcgcacaggcccagccgcaacagccgacgccgcaaggccagaccttcgaagaggaaatcgttccgcagcgttacgcgaacaacgcgaaggtcgacgcgttcatcgacgagatggtcagccgcaacggcttcgactccgcgagcctgcatgcgctgttctcgcgcatcagctattcggcgacagcggtcaagctcgtgaaaccggccccgtcgccgacggtcaagaactggcgcgtctatcgctcgcgcttcatcgagccgatccgcatcaacgcgggcgtgaaattctggaaggcgaaccaggcaacgctgcagcgtgcatccgagcaattcggcgtgccgcccgaggtgatcgtcggcatcatcggtgtcgagacgatctatggccgctacatgggcaatttccgcgtgctcgacgcgctgacgacgctcacgttcgactatccggacacgccgaatcgtgacagccgccaggcgacgttccgcaagaacctcgaggatttcctggtctggacccgcgacaaccagctcgacccgacgaccgtgctcggttcgtatacgggcgcgatcgggattccgcagttcctgccgagcagcatccgcgaatatgcggtcgacttcgacggcacgggccatgtcgacctgcgcagcagtcctgtcgatgcgatcggcagcgtcgcgaactacctgaagcagcacggctgggaaaccgaccgcccggtggtctggcagatcacgcccgacacgggcagcctggggatcgcacaggccgccgccgacggccagcccgaaccgcactgggcactgtcgcaactgctgcgcgcgggcatgacgctgaacgagccgacggtcaacatcacgaccgaagccggcacgcccgtgacggtggtcgacctgccgtcgccgggccgcgcgaccgaatacatgctcgggctcaagaatttctacgtgctgacgcgctacaaccgcagcttcttctacgcgcttaccgtgtaccagcttggcgaggccgtcaaggcgcagatggaagcgagcggcgcacttcagccgagtaccaccgatacacagtcgcagtaagcaccgcccgcccaatgaaaaagcgccgcacaagcggcgctttctttcgtacgcgcgcaacgcgcatctgctcgcgttcaggcaggaaacacgcccgtcgacaggtagcggtcgccgcgatcgcagacgatgaacacgatcgtcgcattctcgacctgacgcgcgatgcgcatcgcgacttcgcatgcgccgcccgacgaaatgcccgcgaagatgccttcgacggccgcgaggcggcgcgccatcgtttccgacgcagcctggctcacgctctcgacgcggtcgacacggctgcgatcgaagatcgtcggcatataggcttccggccacttgcggatgcccggaatgcgcgaaccgtcttccggctgcgcaccgacgatctcgatcgccggattctgctccttcagatagcgcgacgtgcccatgatcgtgcccgtcgtgcccattgccgacacgaagtgcgtgacgcgtccttcggtatcgcgccagatttccgggcccgtcgcttcatagtgcgcaatcggattgtctgggttcgcgaactggtcgaggatcacgcccttgccttcgcgctgcatctcgtccgcgagatcacgcgccagttccatcccgcccttcaccggcgtcaggatgatttcggcaccgtaggcggccatgctctggcggcgctcgaccgacaggtcctccggcatgatcagcaccatcttgtagccgcggatcgccgctgccatcgcgagtgcgataccggtgttgccgctggtcgcctcgatcagcgtgtcgcccggcttgatgcgcccgcgcgcctcggccttgctgatcatcgacaacgccgggcgatccttcacggaaccggccggattgttgccttcgagcttcgcgagcaccacgttgttgcgcgcgcgaatctcgtcgtccggcaagcggaccagttggacgagcggcgtattgccgatcgtgtcttcgatagttttgtaagccatggatataccgtgagtacgaggccgatcaatcgatcgattgtaaaccagcaccgctgctcgcgccggcaaccccattgcggcgatggaatacgcatgccgtgcaacgcgtggacgccgcatgcgccgtgcccacgcaaaaacccgcggcatgccgcgggaagccgtcgcaacgacggcgactgaaggagcttgttgtcggctgcgcgcgacgcgttacttctgcgtggtggtgcgggcaggtgcggccgcaggcttgccggcggccggcttgcccggggccggctgcgcggcacccgtgccggccgcaccgatcgtcaggccttcctgctgaagccgctcgacggtatggccgcccatgcctttcacgcgtgcggcgagatcctccgcattcctgaacggaccgcgtgcgccgcgttcgtcgagaatcgcctttgcccgcgccgggccgatacccttgatgccgacgagcgcatcctcgttggcggtgttgacgtcgacggccgcccaggccgaggcaatcgtgccgagcattgccgctgcggccaaccattttctgatcatgtgctggatctccgatgaatacggccggcggctgccgaccgtgagacccagtctatcgacgcaacgcttccgtttaaacctggccggatagccaacgcacgtagcggtcgacgccttcctgcacggtcaggaacggtgcgtcgtaaccggccgcgcgcagtttcgtctggtcggcctgcgtgaagcactggtacttgccgcgcagcgcatcggggaacggcacgtattcgatcagcccttgctcgacctgctgtgcaagcgtcagcggcggcaggttgtcgagcgcgcgcaacgtattcacgaccgtcgacgcgatatcgttgaacggctgcgcacggccggttccgaggttgaagatgcccgacttctccggatgatcgaagaagaacaggttcaccttggtcacgtcctcgatcgacacgaagtcacgcgtctgctcgcccggtgcgtagccgttgtactcgccgaacagcttcaccttgccttccgcacggaactggttgaagttgtggaacgcgaccgacgccatgcggcccttgtgcgtctcgcgcgggccgtacacgttgaaatagcggaagccggcgatctggctctgcgcggtcggcagcacacgacggaccacctggtcgaacaggaacttcgaatagccgtagacattcagcggcgcctcgacgtcgcgctcctcgacgaatcgcgtcgagccgccgtaggtcgccgccgacgacgcgtacaggaactgcgtgccctgtgcgaggcaggtgtcgagcaacgcgcggctgtagcggaagttgttgtccatcatgtagcggccgtcggtttccatcgtgtccgagcacgcaccttcgtggaacaccgcgcgcaccttgccgaaatcgccgcgcgcgaaacgttcgacgaattccgacttgtccagatagtcgtcgatctcgcaatcgacgagattccggaacttgtccgcgcgcgtcaggttgtcgaccgcgatgatgcgcgtctcgccgcgctcgttgagcgccttgacgatgttcgcgccgataaaaccggctgcgccggtgacgatgagggtcatgatcgtcctgcctgaaaagtgcgagccatgcgtgcggcgcgctcatcgcgccgcacgcatgcgctcaatgaaacagttcgtcgtagtccaccgtggccgtgccgagcttgccgaccacgatgcctgccgcgcgattcgcgagcacgacggcgtcgacgagcggcacgcctgcgccgagcatcgtcgcgaccgtcgcgatcacggtatcgcccgcgcccgacacgtcgaacacctcgcgggcgagcgccggtgcgtgcagttcgccggtggcggaaaacagcgtcatgccttcttccgaacgcgtgagcagcagcgcgtcgatgtcgagttccgcgcgcagcttcgcgacacgtgcgcgcagatcgtcttccgatttccactgcccgaccacttcgcgcaattccgcgcgattcggcgtgatcagcgacgcaccgcgatagcgcgcccagtcgtcgcccttcgggtcgacgaggacggacttgccggccgcgcgcgccttctcgatcatcgtcgtgacgtgcgtcaggccgcctttcgcgtaatccgacatcagcacgacgtcgtgctgcggcagcagcgcatcgaagcgcgcgagccccgcgagcagcacctcgtgcgtcggcatggcctcgaagtcgacgcgcagcagttgctgctggcgcgcgagcacgcgcagcttgatcgtggtcggcagcgccgggtcgcgttcgagatgcggcgtcacgccgctgctgccgagcagttcgacgatgcgctcgccgggttcgtcgcacccgacgacgcacagcaacccggcctggccgccgagcgtcacggcgttgcgcgcgacgttggccgcaccgccgagccgctcttcctggcgctgcacgtgcacgaccggcacgggcgcctcgggcgaaatgcggtcgacgttgccgaaccagtaacggtcgagcatcacgtcgccgacgacaagcacgcgcgagcgcgcgagttgcgcacgcggcaccggaacgacctcgcggagagtattcatcgtgtgatcagccacgggaggacgactggggatcgacatacggccggccgatcgcgtagtagtcgatgccgagttcggccatcgcatccggctcgtacaggttgcgcccgtcgaagatcaccggcgccttcagctcagccttcaggcgcgtgaaatcagggctccggaattccttccactcggtcacgatcacgagcgcgtccgcgcccgtcacggcgatgtcctgcgtgtcgacgagatgcagccgcgccagcgcgtccggatcggtaccgaaatcgagcgcaaacacgcgccgcgcctcgtcgaccgcgaccggatcgtacgcacgcacggtcgcgccgcgttcgaggagcgcggcgatcaggcggcggctcggcgcctcgcgcatgtcatcggtattcggcttgaacgccaggccccagaccgcgaactcgcggccggtcaggtcggcaccgaagcgctgctcgatcttgccgatcagcacgtccttctgcgcatggttggccgcctcgacagcttccaggatgcgcaacggctggccgttctcgccggccgtgcgaatcagcgcctggacgtccttcgggaagcacgagccgccgtagccgacgccggcgtacaggaagtgatagccgatgcgcggatcggagccgatcccgcggcgcacggcctcgatgtcggcgccgaccttgtcggcgagattcgacatctcgttcatgaacgagatacgcgttgcaagcatcgcattcgccgcatatttcgcgaattccgccgaacgcacgtccatgtagatcgtgcgctcatggttgcggttgaacggcgcgtagagcttcttcatcttctcgcgcgcgatcgtgcccgtctcgtcgccgtcgacgccgatgatgatccggtccggacgcatgaagtcctcgaccgcggcgccttccttcaggaactccgggttcgacacgaccgagaagcgatgcgcgacgctgcccgccagcccgcgggcggcaagcgcttcgtcgaccacgccgcgcacgcgttgtgcggtaccgaccggcaccgtcgacttgtcgacgatcaccttgaagcccgtcatgtggcggccgatgttgcgcgcggcttcgagcacgtactgcaggtcggccgagccgtcctcgtcgggcggcgtgccgacggcgatgaactggatctcgccgtgcgcgacgcttgcctcgatgtcggtcgagaagcgcaggcgccccgctgcgcggttgcgcgcgatgatgtccagcagcccaggttcgtgaatcggcatcccgccgttgttcaggatgtcgatcttgcgcggatcgacgtcgaggcagaatacgtcgtggccgatctccgccaggcaggcgcccgtgacgagaccgacatagccggtgccgatgatggtgattttcatagatgttccggtacttcccggtaattgactaacttggccgccgggacgaacccggcggcaaccgcagcgcgttggctccgcgtgccgggatcaacccggcatcgcaggatcgacgcgacgcggcgcataggtttcccagccgctgcagcccggacactgccagtagaaattgcgtgcccggaaaccgcaattctggcacgtataccgtggcaaattcttggtgcgctgcttgatcagcgcacgcatcatttcaagttccttacggcgcggctcgtcggccgccgcgatctgcgcatcgagcaggtgcagcatccccgacaggttcggcgacttctccatctgcgtgcgcgcgagcgtgtgcgccgcgtcctggccgcgcaagcccgcgatgtgctggtatgcgatgtcgagcaggtcgttcgacggatagcggtcgacatagcccatcagcagctcggcgccctcggcgttcttgccgagctcgacgtacgccttcatcagcttgtcggcgacgagcggcagatacgccggattctgcgcctcgacgcgcttccagtgctcgatcgcggccgcatggttgccctcggccgccgcggcgtcgccggagaggatcgtcgcgcgaacgttctgcgggttcacggtcaacgcgaggcgcaactgttcggcagccgctgccgcgttcttgcgctgcagcgcatcctgcgcaagttcgcagtgaaactgcgcaatttcgacgccgagtggtttgtcgctcatcgactcgatgcgcttcgccgtatcgatcgacttgttccagtccttctcgatctcgtagatcgtcagcagcgcccgctgcgcgccgagtgcgtaatcgccgtcggcgagtttgtggaacgcctcctcggcgcgatcgagcaggccggccttcaggaaatcctggccgagttcgtacagtgcgtggtcgcgctcgttgaccggcaggtccgtgcggctcagcaggttctggtgcacgcggatcgcgcggtcggtttcgccgcggcggcgaaacaggttgccgagcgcgaagtgcagctcgaccgtctcgggatccagcttggcgacctcgatgaacgcatcgatcgccttgtcgggttgttcgttcaacagaaaattcaggccgcggaaatacgagcgcggcaggttggcactctccgacaggagattcttaaggtcatagcgtgacgccgcccaaccgagcgcgaacgcgaccggaatcgcgagcaaccaccagaaatccagatccatgcgaaatatcgaagcagagacgaaaaccgcgcgatgatcgcgcggcgtccgtgttaaatgacgggcggcatcggcggctggtcgatgacggccggcgtttcgcgcgccgcgcgcagatcgcgcttcaggcgcccgttctcgagacgcaggcggaagatcgaaggcagcgcggacagcaagccagccagcagccccacggcgaagaacgcgaggccgatcaggatcagcggcgcctgccatgaatagccggccacgaaattcagcgtcgcggtttgcgtattggccagcgcaagcaccagcagcagtacgaacaccaatacccggatcagccagacgataaacttcatgaagccctctctttgttgaggtttgccgcggcgcgcgactcccttcgtcgcgccgaatcgacccgtattgtaaaggaagcgtttccgcggctgcgcacatcctgcacgcacccgttgcgtcgcaatcgccggaaatgaaaaagcgcccgcaaggggcgcttttctttcagccttcgccggatgggttccgggcaatccgggtgacgctcaacgctcgtcgtccggatcatcagccttcagcggctcaccggcgcgaccgtcgacgcgttctcgcaattccttgccaggcttgaagtgcggcacgaacttctcgggcacctgcactttctccctgacttcgggttgcgtccgacgcgcgccgggcgacggttgaggccaaagctgccgaaacccgaatttcgatacgatgccctttcgccagagcgtcagacatcgcatcgagcatcgttttcaccgcgaaatccgcatccttgaggacaagttgcggaaatcgcgatgccagctgcgcgaccaactcggatttggtcatacttcagcagacctcgtgaggcttactggttctggccgtcgagcttcgccttcagcagcgcgccgaggttggtcgtaccggtcgcagcagcgctggtgtccgactgcaggccgcggatcgcttcctgttgttcagccgaatccttcgccttgatcgacaggttgatgccgcgcgacttgcgatcgatgttgatcaccatcgcgttgaccttgtcgccttccttcagcacgttgcgtgcgtcttcgacgcgatcctgcgagatttccgacgcacgcaggtagccttcgatgtcgcccgtcagcgtgacgaccgcacccttcgcatcgaccgtcttcacgacgccgtcgacgatcgagcccttgtcgttcattgcaacgtagttgctgaacgggtcgccttcgagctgcttgatgccgagcgaaatacgctccttctcgacgtcgataccgagcacgatcgcttcgacttcgtcgcccttcttgtacttgcgaacggcttcttcgccggcttcgctccacgacaggtccgacaggtggaccaggccgtcgatgccacccggcagaccgatgaacacgccgaagtcggtgatcgacttgattgcgcccgtgatcttgtcgcccttcttgaagttgcggctgaagtcatcccacggattcggcttgcactgcttcatgccgaggctgatacgacgacggtcttcgtcgatctcgaggaccatgacttcgacttcgtcgcccagctggacaaccttcgacggagcaacgttcttgttggtccagtccatttccgacacgtggacgaggccttcgatgcccgattccacttcgacgaatgcgccgtagtcggtgatgttcgtgaccttgccgaacaggcgcgtgcccgacgggtaacggcgcgagatgccttcccacggatcgtcgcccagttgcttgatgcccagcgagacgcggttcttctcttggtcgaacttgaggatcttcgcggtgacttcctggccaaccgacaggacttcgctcgggtgacgcacacgacgccatgcgatgtcggtgatgtgcagcaggccgtcgataccgccgaggtcgacgaacgcgccgtagtcggtgatgttcttgaccacgccgttgacgatcgcgccttccttcagcgtctcgagcagcttcgcgcgctcttcgccttgggttgcttcgatcactgcgcgacgcgacagcacgacgttgttacgcttgcgatcgagcttgatcacgcggaactcgagcgtcttgccttcgtacggggtcgtgtccttgaccggacgcgtgtcgaccagcgaacccggcaggaacgcacggatgccgttgaccatcacggtcatgccgcccttcaccttgccggtgatcgtgccggtaacgagttcgttgttgtcgagagccttttccagcgacagccacgatgcaaggcgcttcgccttgtcgcgcgacaggatcgtgtcgccgtagccgttttcgagtgcgtcgatcgcgacggacacgaaatcgcccgactgcacctcaacctcgccctgatcgttcaggaattcctcgatcggaatgtaagcctcggacttcaggcctgcattgacgaccacgaagttgtggtcgacgcgcacgacttcggcggaaatcacttcgccggcgcgcatgtcttggcgggtcagcgactcttcgaacagagccgcgaaagattcagtattcggggtggaggtttgcaggtcggacataaaaatctgattgtgcatggatcgctgtgccacgccggccggaatggcaggctgaaagggccagatcgacgaccacacggggttaagggttcgaaacacgctccgcgcttgcgacgcggaacacctactgctacccgccttctcaggcgggctggccgagcgcccggtaccactgcagcacctgatcgaccgcttcatcgaccgaaagcgccgacgtatcgagcagcttggcatctgccgcaggcttcagcggcgcggccgcgcgattgctgtcgcgcgcgtcacgttcacgaagatcccggagcaagtcatctatattagcagaaaacctttttgcatcaattgcttatgccgtctggtcgcgcgcgcctcggcgctggccgtcaggaacaccttcaacacggcgtccgggaagatcacggtacccatgtcgcgcccgtctgcaacgaggcccggcgtcttgcggaacgcgcgctgacgcgcgacgagcgcggtgcgcaccggcccatgcacggcaatcgccgatgcgcggttgccgaccgcttcggcacggatgtcgttcgacacatcgacgccgtcgagctgcgcgcagccctcccggaacgtgatgtggagatcgtcgatcagcttcaccagcgcgtcgatgtcctctgccgcgatgccgtagcgcacgctcgcgagcgcggcgaggcggtacagcgcgccgctgtcgagcaggtgaaagccaagatgcgcggcgacgagcgcggcgacggtgcccttgccggaagcagtgggaccgtcgatcgtgatgacgggagtcgggtgaaagggtcgggtcgatttcatcggaacagtcgggtcaggctttggcgagcgcggcgaagcggtcgaaatagtcggggaacgtcttgccgacgcacttcggatcgttgatccgcacgggcacaccgcccaggctgacgagcgagaagcacatcgccatccggtgatcgtcgtacgtgtcgatcgccgcgttcggcgtgagcttttccggcggcgtgacgacgagatagtcagggccttcctcgacgatcgcgccgaccttgcgcagttcggccgccatcgccgcgatgcggtcggtttccttcacgcgccagcttgcgatgttgcgcagcgtgctcgggccggcggcgaacagcgccgcgaccgcgatcgtcatcgccgcatcgggaatcaggttgaagtccatgtcgatcggctcgagcttgccgtggtcgtggccgatgccgcgcacttcgatccagtcgtcgcccatcgtcacgttcgcgcccatctgcatcagcgcgttcgcgaagccgacgtcgccctggatgctcgcgcgccccacgccctcgacacgcagcggcccgccgccgagcgcgccggccgcgaggaaatacgacgccgacgacgcgtcgccctcgaccatgatctgccccggcgatttgtagcgaaccccggccggcacgacgaagcgctgccagccgtcgcgctcgacggtcacgccgaagcgctccatcagccggatcgtgatgtcgatgtacggcttcgagatcagctcgccgtcgatctcgacgacgatccggccatctttcgccttcacgagcggcagcgtcatcaggagcgccgtgaggaactggctcgatacgtcgccgcgcacgcggatcggcgcatcgaccgagatcgtcgcgggtttgatccgcagcggcgggaagccttcgttcagctcgtagtcgatctgcgcgccgatctggcgcaggccgtcgacgagatcgccgatcggccgctcgtgcatgcgcggcacgccgtgcacgcgatagtcgccgccgttcaccgcgagcgcggcggtcagcggccgcacggccgtgcccgcgttgccgaggaacaggtcggccgtcttcgcggtgaatgcgccgcgcgtgcccgtgacgacacaggtatcgccgtcgcgcgcgagcttcacgccgagcttgccgagtgcgtcgagcatcacgcgcgtgtcgtcggagtcgagcaggttggtgatcgtcgtttcgccttcggccagcgccgcgagcagcagcacgcggttcgaaatgctcttcgagccgggcaggcgcacggtgcccgatgcgctggagtacgggccgagatcgagatagtccatgggaatcgtcctgttatttcttgaccggttcggcagcgggcgcgccgccgcgctcctgccatgccttgcgcgcggcgcgcgaacgcgtgaacacggcttcgagcgccgcgccgtcgccggcgtcgatcgccgcgcgcagccgcgtgagcacgcgcgtatagccgtcgagctcgtcgagcagcgccgcgcgattcgcgacgcacacgtcgcgccacatctccgggctcgacgccgcgatgcgcgtgaaatcgcggaaaccgcccgccgcgtacgagaatttgagttccgcgtcggcctcgccgaggatctgctcgacgagcgcgaacgaaagcacgtgcggcaaatggctgatcgacgcaaacacgcgatcgtgctgctccgtgctcatcgtgcgcacgtcggcgccggtcgcgcgccacatcgcgtcgatccgcgcgacggattcgggcgcattctccggcagcgggcacagcaccacgttgcgaccgacgtacagatccggcaacgcggcctcgacgccgctcgactcgcgaccggcgatcggatgccccggcacgaactgcgcgatgcgtgcgccgagcgcgtcgcgcgcggccgcgacgacatcggacttggtgctgcccgcatcggtgacgatcgtcgccgcttcaagccacggcgcgatgcgcttgagcaacgggcccgtttgcgcaacgggtgccgccagcagtacgagatcggcgccggccagcgcgtcgcgcaattgcgcgtcatcgtcgagtgccgccgcgcgatcgatcacgccgagcgcaagcgcgcgctcgaccgacgcacgcgaacggcccacgccgacgacctcgcccgcaccgcccggcgcgcgttcgcgcagcgcgcgggccagcgatccgccgatcaggccgacgccgaaaatgaccagtttgttgaatgcaaagcctgacacgacaagagccaagttacgcgcgcggaacgacgccccgcatgcggaattccagattcgggcaacgggcccgcacccggcgcaacctgcgccggacgcgggccgaacccgccttcggcagcgccaaccggcctgccctgcccgcctcgccgcaacgcctgcccgagcaggcgacgggccgccgcgcatcagcgtgcgcgcggatacgaaccgagtatcttcaggaacgcggccttctggccgagttccgcgagcgcggccgccaccgccgcatcgtcccggtgcccttcgatatcgatgtagaagtagtactcccacgtgccgacgcgcgccgggcgcgactcgaagcgcgtcatcgacacgccgtgccgcgcgagcggctcgagcagcttgaacacggcgcccggctcgttcttcaccgacacgatcagcgacgtctggtcgtgaccgctttgcccggccggctgcttgccgacgatgacgaagcgcgtgcggttatgcggatcgtcctggatcagcgagaacgcgatctgcaatccgtagtgcgcggccgcacggtcgcccgcgatcgccgcgacggtcggatcggccgccgcgagacgcgcggcctccgcgttgctcgccacggcctgccgctcgagctgcggcgcattcgccgcgagccactgctggcattgcgcaagcgcctgcgcatgcgcgcagacgcgcttcacgccgtcgagcgtgccgccctgcgtcagcaggttgtgatggatcggcagcgcgagctcaccgctgatcagcagttgcgtctgcagcagcaggtcgagcgtgcgcgacacggcgccttcggttgaattctcgaccggtgcgatgccgtatgcggcagccccggcctcgaccgagcggaatacttcgtcgatcgacgggcacggcagcccttcgatcgactggccgaaatactcgagcatcgcctgctcgctgtacgtgccgaccggcccgaggaacgcgacgtggatcgtctgctcgagcgcgcggctcgcggccatgatctcgcgccagatggcgctgatgtgctcgctcgcgagcggccccgcgctcatgtcctgcaaccgcgcgatcacctgcagctcgcgctccggccggaacaccggcgcgttgaaatgcttcttgacctcgcccacctccagcgccaccgcggcgcgctggttcaggagcgcgatcagctgcgcatcgatcgcgtcgatgcgatcgcgcagcggtttcaggcgggaattcagttcgtcgtccatgcgttttgccgtgctgtttgaacagcgccgccgtcaggcgccgcgctgctcgaagtccttcatgtactcgacgagcgctttcacgccctcgagcggcaccgcgttgtagatcgacgcccgcatgccgccgacggacttgtggcccttcagctgcagcagcccgcgcgcctttgcgccggcaaggaagtcttcgttgcgcgtttcgtcggccaggaaaaacggcacgttcattcgcgaacgtgctgccggctcgaccttgttcagatagaaactgctcgcatcgatcgtgtcgtagagcagcttcgcctttcgatattgcgggcctcgatcgcctcgagaccgccctgccgcttcagccactggaataccagacccgcgatgtagatcgcgtaggtgggcggcgtgttgtacagcgagttgttcgcggcgatggtcttccattcgaacgcggacgggcagatcgacagcgagcggtcgagcaggtcctcgcgcacgatcacgagcgtcacaccggccatcccgatgttcttctgcgcaccgccgaacagcacaccgtacttcgcgacgtccatcggacgcgacaggatgtgcgacgagacatccgcgaccagcggcacgtcgccgagatcgggaatctcgaacgtctcgacgccgtcgatcgtctcgttggtgcacagatgcacgtaggccggatcgtccgacagttgccattcggcgcgcgcgggcgcacgcgtgaagccgttttccgtcttgccggttgcggcgagatgcggcgtgccgtatttcttcgcttcgctgaacgatttctgcgaccacgagcccgtcacgacgaagtcggccgtcttgcgcgatccgagcaggttcatcggcacgatcgcgttttcggcgataccgccgccctgcaggaacaggatccggtggcttgccggcacgccgagcaggtcgcgcaggtcggtcagcgcggcctcgtggatcgacatgaactccttgccgcgatggctcatctccatcacgctcataccgctgccgtgccagtcgagcatttcgtcggcggcttgccgcagcacttcctcgggcatcgccgcagggccggcggagaaattaaagacgcgcatcgtgaaaacctcggagggacgcgaccggctcgccgccggcagaacgcgccagaaagaaatggccgcttgcgctcgcgcgcaaacggccattatcgcactgtcgtcaggctcccgccaaacccggccgaacggccggtggcgtgcccggacggctttacttgcccggcttgactgctgcgacttccttgtcagcctgcgtacgcgttgcctggatcgcttgcggcatgtacttctgcatcaggccgttgaccacgtcgcgaccgacctgatcctgaacctggatgaacttgcggcccgtcgggctcttgtagaacgtcgtcagatccttgatctccgacgtgctgtagtacttcgcgtaggcgtcgtactgagccgacatcgcgtcgttctggaactgttgcgtaccgaacaccttgcctgcgccgtcgaccagcttcggcaccgcgttcttctgcagcgtcgggacggcagcttgcttctgcttgtcgttcagcgtcttgttttccgacagcgcgtccgacaggattgccggcacgagttgcttggcctgcatttcggcgctgttgccgattgccgacacgagcttcggcgcgtcgatcgcgtcgagcagatccttgatcgcagccttcttgtcggcgtcgatcggcgcagctgccgcggcaggcgccggtgcggaattcgacagcgcttgcgccatcgcgaacgtcggcaccagtgcagccagcaggaccagttgcttgaattgcttttgcatcatcactccctttggaaatatgaatggttgctcgccggccgcggcgcttcacgcccgcggcggccagagtctcatccgttcttcaggcttcgccgtccgacgcctcgtcggcctcgccatcgccctcttcagcctccgcgatctgctgcaggccggagagcttggtaccctcatcgagactgatgagtgtaacaccttgcgtggcacgccccatctcgcgaatctccgagacacgggtgcgaatcaacacgccggccgtcgtgatcagcatgatctgatcttcggcgtcgacgagcgtggcagccacgaccttgccgttacgctccgacgtctggatcgcgatcatacccttcgtgccgcggccgtgacgcgtgtactcggtgatcggcgtgcgcttgccgtagccgttctcggtcgcggtgagcaccgtctgctcctcgctgccggcaaccagcatcgcgatgacctgctgcccgtcctcgagctgcatgccgcgcacgcctcgcgcctcgcgccccatcggacgcacgtcgttctcgtcgaagcgcacggccttgccggaatcggagaacagcatcacgtcgtgcgcaccgtcggtgatcgacgcgccgatcaggtaatcgccctcgtcgaggccgaccgcgatgatgcccttcttcatcggacggctgaatgcctcgagcggcgtcttcttcacggtgccgagcgacgtcgccatgaagatgaacttgtcggccgagaactccttgaccggcagcacgacgttgatcttctcgccttcctgcagcgggaacatgttgacgatggggcggccgcgcgagttgcgcgacccctgcggcacttcatagaccttgacccagtacacgcggccgcggttcgagaagcacaggatgtagtcgtgcgtgttcgcgatgaacagcgtctcgatccagtcgtcttccttcatctgcgtcgcctgcttgccgcggccgccgcgcttctgcgcgcggtactcggacagcggctgcgacttcacgtagcccgcgtgcgacatcgtgacgaccatgtcctgcggcgtgatcagatcctcggtgttcagctcggtcgcgttcagctcgatcttcgagcggcgcgcgtcgccgaattcggccttcaccgaggtcagctcctcgccgatcatcgtcgtgatccgctcggggcgtgcgaggatgtccagcaggtcggcgatctgcgccatcacttcgcggtactcgccgatgatcttgtcctgctcgaggccggtcaggcgctgcaggcgcatctgcaggatttcctgggcctgcgtgtcggacaggcggtacagcccgtcgctctgcatgccgaacgccgggttcaggccttccgggcggtacgcggagcggccgccggccgccgcgttctcgctctcggcgcgcgtgagcatctcgcgcacgagcgacgaatcccacggcttcgccatcaactccgccttcgcgatcggcggcgtcggcgctgccttgatgatcgcgatgaactcgtcgatgttggcgagcgcgaccgcgagaccttcgagcacatggccacgttcacgggccttgcgcagttcgtagatcgtgcggcgcgtcagcacttcgcgtcggtgcgacaggaagcactgcaggatttccttcaggttcagcagcttcggctggccgtcgaccagcgcgaccatgttcatgccgaacgtatcctggagctgcgtcgccttgtacaggttgttcagcaccacttccggcacttcaccgcgcttgagctcgatcacgacgcgcatgccgctcttgtcggactcgtcgcggatgtcggagatgccttcgagcttcttctcgttgacgagttcggcgatccgctcgagcagcgagcgtttgttcacctggtacggcagctcgtcgacgatgatcgccatccgctggccgcggtcgatctcctcgaagtgcgtggccgcgcgcatcacgacgcgaccgcgcccggtgcggtagccgtcgcgcacgccggcgacgccgtagatgatgccggccgtcgggaaatccggcgccgggatgatctcgatcagctcgtcgatcgtcgcttccgggttacccagcaggtgctggcacgcgtcgacgacttcgttcaggttgtgcggcgggatgttggtcgccatgccgaccgcgatgcccgacgagccgttgatcagcaggttcgggatgcgcgacggcaggaccgacggctgcatttcgttgccgtcgtagttcggctcgaaatcgaccgtttccttgtcgatgtcggcgagcagctcgtgaccgatcttcgccatgcgaatttcggtgtaacgcatcgctgcggcattgtcgccgtcgatcgagccgaagttgccctgcccgtcgatcagcatgtagcgcagcgagaagtcctgcgccatccgcacgatcgtgtcgtacaccgcggtgtcgccgtgaggatggtacttaccgatcacgtcaccgacgatacgcgccgacttcttgtacgcgcggttccagtcgttgttcagttcgtgcatcgcgaacaacacgcgccgatgcacgggcttcaagccatcgcggacatccgggagggcacgtccgacgatcacgctcatcgcgtaatcgagatacgaacggcgcatttcctcctctagggaggtgggcagggtctctttggcgaattgatccatgtatccgtatcgtttcggagcgaagacggcgaacgcctttcgcgtgggcgctgcatgcgcaacgcaacgcgagattctaacatgcgcccatcagccgccaattcgccgcccctctatatataaatagcgaaaatcgcggccacgtcgattcgaccgaaatcgcacgcgactcgacgccgccggcgatcccctcacacttgtttcatgcgcacgagtaaacaaccacgcacattcgcgcaatttcgccgacacactcttgacaatctctaaaagttgcggcagggcggtgttgcgcatgcaccacaaagttgaagcgatcttagggtggggaggatttttttcgtaggaagggaacgatatggcaaaatgccaacgcactgaaagttagacgctgctcgaagtctacacagagcggtgccgcgtttttgtgccgcaccaatgttatacttcgagcaatgtatgacttgtcaccgtcaacaggctcgcagtaaacctgcggtaatctcaatttcgagaggagaaatatgaataaactttcaaagctcgcgttcattgcagctaccgcagttatggctgcatccgcttcggcacagtcggtgccggcgtcgcgtcaagccgtcaatgacaactgggtgaacggcacgggcgaatgggtgtggatgaacggcacgaacgagctctgctggcgtgatgcgttctggacgccggccaccgccaacgcgaagtgcgatggcgcactggtcgcccaggcaccgcagccgccggtcgctccggtcgctccggctatctcgagccagaagatcacgtatcaagctgacgcactgttcgacttcgacaaggcaacgctcaagccgctgggcaagcaaagctggacgaactggcttcgaagatcgaaggcatgaacacggaagtggtcgtcgcaacgggctacacggaccgcatcggttcggacaagtacaacgaccgtctgtcgctgcgccgtgcgcaagccgtgaagtcgtacctggtcagcaagggtgtgccggccaacaagatctacacggaaggcaagggcaagcgcaacccggtcacgacgggctgcaaccagaagaaccgcaagcaactcatcgcctgcctcgcaccggatcgccgcgtggaagtcgaagtggttggtacgcaagaagtccagaagacgaccgttccggcaaactaagccgcggttttcgactgcttcaaagccccgccccggcggggctttttctttgacgcccgtccaggcgcctgccgcttcgccgctcgtccgcttcttatatactcggggctgacgaatcgcagtaccgccctcctctcgtagcccgtttgccgacatgaccaacgccgatccgcacgaactccagaaattcagcgacctcgcccatcggtggtgggatccgaacgccgaattcaagccgctgcacgacctgaacccggtccgcctcggctggatcgatgcgcatgcgcacctcgccggcaagcgtgcactcgacgtcggctgcggcggcggcatcctgtccgaatcgatggccggactcggcgcacaggtgaaaggtatcgacctgtcgaccgaagcgctcggcgtcgccgacctgcacagcctcgaaagcggcatcactgtcggctatgaagccatcgcagcggaagcgatcgccgcgcgtgaaccgggcacctatgatgtcgtcacgtgcatggagatgctagagcacgtgccgtctcccggcgatgtcgtcgccgcgtgcgcgacgctcgtgaagccgggtggctgggtgttcttctcgacgctgaaccgcaacctgaaggcctacctgttcgccgtgatcggcgcggagtacatcgcgcaaatgctgccgaagggcacgcacgactacgcgcgcttcatccgcccgtcggaactggccggcttcgtgcgtgcgacggatctgcacatcgtggagatcaagggcatcacgtatcacccgatcggcaagcgcttcgcgctgtcgaacgacaccgacatcaactacctcgtcgcgtgccgccgcggcgcatgaccctccaccctgcatgacgactccctctcgaccgcgcgggctgcactcgacgaaccgcgcctgctgcactgcgatgccgtgctgttcgacctggacggcacgctcgccgacacagcccccgatctcgcggcggccgtcaacaagatgcaacgcgtgcgcgacctgcccgaaacaccgctcgacgtgctgcggccgctggcctcggccggcgcgcgaggcctgctcggcggcgcgttcggcatcgatccgcacacacccggatacgaagcgatgcgcgacgagttcctggccaactatgcgacggatctgtgtgtgcatacgacgctgttccccggcatcggcgacgtgctcgacgaactcgatgcacgcggtgtgcgctggggatcgtcacgaacaaggtgatgcggctcacggcgccactcgtcgagttgctcggtctcgcgccacgcgcggcctgcgtcgtcgggggcgacacaacgccgcacccgaagccgcatccggccccgctgctgcatgcggccgaccagttgacgctcacgcccgcacgcatcgtctacgtcggcgacgatctgcgcgacattcaggccggcagcgccgccggcatggcgacgatcgcggccgcgtacggctactgcggcgacggcgtcgcaccggccgactggcaagcgcaacatctcgtcgacacgacactgcaactgcgcgaactgctgcgcgatgttgggctataatggtcgatcttatccgcgggggcgacctggtttcgacaggggttgtgaagcggctagggcatgtcgaggacccgtcacctcgttaatcaatgggaaaatcgtaactgcaaacgacgatacgttcgcactggcagcctaagggccgccgtcctctgcctagttcactgacgggctagtgtcgcaagaccggtagcaataccgccagaggtcatttacgtcagttaagccctgtcggcgtcgcgacgccagggtcgaaaacctagcgaatcgccgtagtgcagcgtgttcgtccgcgtcgctgcggttaaatcaaatgactgaactaaacatgtagaactagtcgtggagcgcttctggacgcgggttcgattcccgccgcctccaccaaattccgcgctcgtcgcacgaaccccgcatgacgcaagtctgcggggtttttgttgccaaacgcatgcacccttccccttccgaaaaagcgcccagccacggacgggccgggcggaatgccaccggtattccggcgacaggaggtgacggatgtcctgccgcgcccgcacaatcatcgatcgcgccaggcggcggccggcccgggtgccgcagtgccggacgcgtcgtcgcaccagcactcacgcacaccgggcgatgtgcggcttagctgccgcgatacagcgacttcatttcttcagcggtggccgggcgcacgcccattgcacgcgaacccgatgccgacgcaccctgcgcctgtgcaccgtaaccgctggcgtcggcgccttgcgcttgcgccatcgcgctgcgctgttgctcggcaacacgcgccgttgcagcctggatcgcttccggataatgcggatcttcgccgcgagcggagttgtaacctgcctgctgcaactggaccagttcggcgcgaacctgcgcgcgggtgatcgtcgaacccgactgggcaaacgacacgaccggggcaacgagagcggcagcaacgacaacagcttgaacgagcgacttcatgatgacctacctccagatttgtctgtgttagcggtgaacaccttgttcatcgctgacaacccgaagtttatgtaggcggatgcttaagaataaggcaggtttctggaagacatccttcctgatttacgggttaaccctaaatccccaccaggccgacgatgcgcgcatgccggcatcgcccgacaccgaatcgcatgaagattccgccggaaagcaaaagccccgcgaagcggcaacacttcgcggggctcggacagaaccggaattccacgggactccggcagtcgccggtcaaccggccaggccagtacgtggacgcaacgcccgtcaagcgaaccggcgccgcatgacccttgcggacgtactccgtccgcccggttactggctatccatcggacacttcaggttgcagccgttcggatcgcccaagtcgcccttgcggcgcaaggccgacttcttgccgctctggtatttctgcgacggcgtcgacgctgcgaacggcatctgcggatgctcgttcaggcgaaactgttcgctcaggataccgccaggcacaccggggaattctgcgcgagcgcaaacggcgaaacagcgaccagcagccccgcggtcaacgctgccgcggcgaggggaacggaaaatttcatggcgggatgacgcttgaacggcgtacttgttggaacgttggtcaagcggcaagcgtagcgcaaatccccgctgctgcagcgcggttcgatcgcgcgcgcgttaccgcgaattgccgcccggcacgctcgcgccgtcgccgccggccagccccgtcgcgatgctcgtcaacgttccgcacgcagccggatcgtagccgtcgagatgcgcgacgcgctcgacgaagcgcgcgtcgcgcagcagcgccagtacgccggcaagcggccgcgcgtcgagccgcgcgcgttcgcacgcgaagtaatagtcctcgtcgacgaccgggatgaaatcgagcccgaaatgatgggcggcaggttcgacgccgaagccgagatcggccatcccgctcgcgacgaacgccgcgatagccgaatgcgtgagctcggccgatgcgtagccgtcgatgcgctcgggatcaatgccgatcgcgcgcagcgcgaggtccagaagcatgcgcgtgcccgaccccggctggcggttgacgaagcggatgtcattacgcgcgagatccgcgaggccgcgaacctgcttcgggttgccgcgcgggacgaacagcctgctggcgccgagtcaggtggatcagcacatggcgcgtatcgtcgagccacggccggtagatttgcgcgcactgcgcacgaaacgcaccgcgcggcagatggaagcccgccaggtcgcactcgccacgggcaagcgcctgcacggcctcgacgctctcgcgatacttgatgtcgacagccgcctgcgcatcgacgagcgcggatacgagcgtcgcgaccgcgtagccgtgcgacgcatgaatgcgcacggcgccgtcgcgctgcgcgagccgccggttcaggtcgctcgccacctcggccgccagcgtccgcaggttaccgtcgagccggctgcgcgcgaggcgttgcgcatcgacgaccgcctgcccgagcgccgacagcgtcgagcccttgccgcgcgcggtttcgatcagttccccgccgatgcacgcctccagcgcgcgcagcatgccccacgcgtgccggtaggacagccctttcgcgtgcgcggcctgcgcgatgctgcccgtgtcggccacgagttccagcaacggcgcgacatccgacaggctggccgcacggccttccgtgtcgcgtacggtcagatacgcgtcgcattcgattcgaaccaattatgcactccgatttcctattgcgaccgccaaatcttccgcttatcgttgttcaaaatcaatcagaacgaagtcgaagtgcgcactatatgaattcagagcgcatatgagattttggaggagcacaaccgatgtccccgaattccgaagcgcccgacgcgctcgtcgagcgccatgcgcgcgccggccagtcgctcgtggcgatcctgcacgcgatccaggacgacgcgggctacgtgccgccgggctgcgtcgcgccgctcgccagggcgctcaacctgtcgcgcgcggaagtgcacggcgtactgacttactaccaccacttccgcaccgcgccgcccgcccgcgtgacgatccagatgtgccgtgccgaagcgtgccgcagcatgggctgcgaagcgctggccgcgcatgcggaagcccgcacgggttgccggttcgacgcggcgcacggcgatgtcgcgaacgcgcacgcgcccggcgacgtcgcgctcgaatcggtctactgcctcggactgtgtgcgcaatcgccgtcgctgacggtcaacggcgtgctgcacgcgaaggtcacgccggagaaattcgacgcgctgcttgccgaggcggtcgcccacaccccggaggcagcatgacgacccgcatctacgttccgcgcgattcgtccgcactggcactcggcgccgacgcgctcgccgccgccctcacggcggaagcgcagcggcgcggcgtcgccgtcgagctggtccgcaacggttcgcgcgggctgctgtggctcgagccgctcgtcgaggtcggcacggccgccggccgcgtcggttatgcgaacctgtcggccgccgacgtgccggccctgttcgacgcgaactggctcgacggcggcacgcatccgagcggtgtcggcctcgtcgacgcattgccctatctcgcgcgccagcaacgcctcacgttcgcccgcatcggcctgaccgatccgctgtcgatcgacgactacctgcaatacgaaggcctcgccggcctgaagaacgcgctcgcgctcgacggcgacgccgcgtgcgaaacgctgatcgaatcggggttgcgcggccgcggtggtgccgcgttcccggccggcatcaaatggcgcacggtccggcaagccagcgccacgcagaaatacatcgtctgcaacgcagacgaaggcgattcgggcacgttctccgaccgcctgctgatggagtgcgatccgtactgcctgatcgaagggatgatcatcgcgggcatcgcgaccggcgcgacggtcggctacatctacgtgcgcagcgaatacccgcatgcaatcgccacgctcgaagccgcgatcgtccgtgcacgcgaagccggctggctcggcgagcacgtgctcggctccgcgcatgcgttcgagctgcacgtcgcgaaaggcgcgggctcgtacgtgtgcggcgaggaaacggcgctgctcgaatcgctcgaaggcaagcgcggcgtcgtgcgggcgaaaccgccgctgcccgcgctcgcgggcctgtacggccagccgaccgtcatcaacaacgtgatcacgctcgcgacggcgcccgtgatcttcgcgcgcggcgccgcgttctatcgcgactacgggatgggccgctcacgcggcacgctgccgttccagctcgcgggcaacatccgccacggcggcctcgtcgagttcgcgttcggcgtcacgctgcgcgagctgctgttcgacttcggcggcggcacggcaagcggccggcccgcgcgcgccgcccaggtcggcggcccgctcggcacctacctgcccgaccaccagtgggacgtgccgctcgactacgaagcgtacacggcgatcggcgcggtcgtcgggcacggcggcatcgtgctccacgacgatacgtcgaacctcgccgagctggccgaatacgcgatgaagttctgcgcgatcgagtcgtgcggcaagtgcacgccgtgccggatcggttcgacacgtggcgtcgagacgatcgcgcgcatccgccacggcgacacgtcggagcggcaggtcacgctgctgcgcgacctgtgcgacacgatgctggccggttcgctgtgcgcaatgggcggcatgacaccctacccggtgctgtccgcgctcgaccatttccccgaagatttcgggctcgccgccggcaaggacgccgcgtcgggtccggtcaaggctgcggcctgacccagaaggagccctgcatgtccctcgacacgaacaacgtccgccaaggcggctgcggctcgggccaatgcgcgtgcaagagcgccgcgcaagcgcgtgcccgcgacccgttcgacgataccgactacggcacgccgcaacggcatgccgataccgacgtcacgctcgaaatcgacggccagccggtcaccgtgccggccggcacgtcggtgatgcgcgcggcgatcgaagccggcgtcaacgtcccgaagctctgcgcgaccgattcgctcgaaccgttcggctcgtgccgtctgtgcctcgtcgagatcgaaggccggcgaggttatcccgcctcgtgcacgacgcctgccgaagcgggcatgaaggtgcgcacgcagtcggaccggctgcagtcgctgcgtcgcaacgtgatggagctgtacatctccgaccatccgctcgactgcctcacctgccccgccaacggcgactgcgagttgcaggacatggcgggcgtcgtcgggctgcgcgaagtgcgctacggcttcgacggcgcgaatcacctgaaagaccgcaaggacgagtcgaacccgtacttcacgtacgacccgtcgaagtgcatcgtctgcaaccgctgcgtgcgcgcctgcgaggaaacgcaaggcacgttcgcgctgacgatcgccgcacgcggcttcgaatcgcgcgtcgccgccggcgaaagcgaatcgttcatggcgtcggaatgcgtatcgtgcggcgcatgcgtcgccgcctgcccgaccgccacgctgcaggaaaaacggtcgtgcaactcgggcaggcggaacactccgtcgtcacgacctgcgcgtactgcggcgtcggctgctcgttcaaggccgagatgaagggcacgcaggtcgtgcgcatgacgccgcacaagaacggcctcgccaacgaaggccatgcgtgcgtgaagggacgcttcgcgtggggctacgcgacgcacaaggaccgcatcacgaaaccgatgatccgcgagaagatcaccgacccgtggcgcgaagtcagctgggacgaagcgctcacctacgcggcaacgcaattccgcaagctgcagcagaagtacggccgcgactcgatcggcggcatcacgtcgtcgcgctgcacgaacgaggaaacctacctcgtgcagaaactggtgcgcgccgcattcggcaacaacaacgtcgacacctgcgcacgcgtgtgccactcgccgacgggctacggcctcaagacgacgctcggcgaatcggccggcacgcagacgttcgcgtcggtcggccaggccgacgtgatcgtcgtgatgggcgcgaacccgaccgacgggcacccggtgttcggctcgcggctgaagcggcgcgtgcgcgaaggtgcgaagctgatcgtgatcgacccgcgccgcatcgacgtcgtcgacggcccgcacgtgaaggccacccaccatctgcagctgcgccccggcaccaacgtcgcaatcgtcaacgcactcgcgcacgtgatcgtcaccgaggggctcgtcgacgacgcgttcgtcgccgagcgctgcgagacgcgcgcattcgagcagtggcgcgaattcgtatcgcgtgccgacaactctcccgaggcgaccgccgacgtgacgggcgtgccggcggaacgggtccgtgaagccgcgcgcctctatgcgacgggcggcaatgccgcgatctactacgggctgggcgtgaccgagcacgcgcagggctcgacgacggtgatgggcatcgcgaacctcgcgatggcgaccggcaacgtcggccgcgaaggcgtcggcgtcaatccgctgcgcggccagaacaacgtgcagggttcgtgcgacatgggctcgttcccgcacgagctgcccggctaccggcacatcagcgacacgatcgtgcgcacgcagttcgaacaggcgtggtcggccacgctgcaacccgaaccggggctgcgcatcccgaacatgttcgacgcggcgctcgacggcagcttcaaggggctctactgccagggcgaggacatcgtccagtcggacccgaatacgcagcacgtcgcggccgcactgtcggccatggagtgcatcgtcgtgcaggacatcttcctgaacgagaccgcgaaatacgcgcacgtgctgctgcccggctcgtcgttcctcgagaaggacggcacgttcacgaacgcggaacgccgcatctcgcgcgtgcgcaggtgatgccgccgctcgcgggctacgcggactgggaagtcaccctgatgctgtcgcgcgcgctcggctacgagatggactatgcgcatccgtcggaaatcatggacgagatcgcgcgactcacgccgacgttctcgggcgtgtcgtacgcgaagctcgacgcgctcggcagcatccagtggccgtgcaacgagcacgcaccggaaggcacgccgacgatgcacatcgacgcattcgtgcgcggcaagggcaagttcgtgatcacgcagttcatcgcgtcgccggagaaggtcacgcagcgttatccgctgatcctgacgacgggtcgcatcctgtcgcaatacaacgtcggcgcgcagacgcgccgcaccgagaacgtccgctggcacgaggaggatcgcctcgagatccatccgcacgacgcgcaggatcgcgggatccgcagcggcgactgggtcggcatcgagtcgcgcgcggggcagacggtgctgcgcgcgctcgtgaccgaacgcatgcagccgggcgtcgtctatacgacgttccacttcccgaatcgggtgcgaacgtgatcacgacggacagctcggactgggcgacgaactgccccgagtacaaggtgacggccgtccaggtgctacccgtcgcgcagccgtccgactggcagaaagcctacgcacgcttcaacgccgagcagctcgatctgctcgagcgccgtgcggccgcgaccgccggcgtgaccacgggcaagtgaggaagcgatggacaacggacacctgatcgacatggccaaccagatcggcgcattcttcgaatcgatgcccgatcgcgacgaagcgctggccggtatcgccgaccatatccggcgcttctgggagccgcggatgcgccgcgcgcttctcgcggcgctcgacgatccgtcatgcgaggccgcgcaacgcgcggcaccggtcgtgcgcgacgcgatcgccgcgcaccgcgcgtccctcgtgcctgccgcggcaaaggcctgaccgccccgctacgcgggccgcgacatgcccgcgaaccagctttcgcagtggcgcagcaacgcgttcgcgtcggtcgccgtgcgcccgcgcgcggccacgtaaccatcgggccggagcaggtaaaacgacggccgcgagcggccgtagtcctgcgcgagcccggcatccccgccttcggcatcggtgacgcgccagacgcgcaccgcgtccggcatgatccgttcgagcccctgcacaagcacctgcgcatcggccggtatcggcggcaacgcgccggtgtcggcatccggcggctcttccagcagcagcaacgtgaagctcgcgggatcgtgcaggtcgtatagccgcgccgtgccgggcgcctgaccgagcggcccgtcgaccacgcgcacgtacgcatcgggtgcccgctcaccggcgcgcggcccgccgtcgagcacgcgctccagcgtgagcgggctcttccggtactgcacgccgagttcgctgaccgtacgccgcacggcgtcgcgcatcggcccgaacgacgccagcagcggcacgacatgatcgcgcagcagcttcatcgcgccgcgctcggcttcgacgacctgcgtgacgaaaccggtctgccgcaacacgtcgcgctcgatcggatgacgttccgcgtgatacgtgtcgagaagccgctcgggtgtacccgcgccgagcacgcgcgcgagcttccagccaagattgaacgcttcctggatgccggtgttcatgccctgcgccccggccgggctgtggacgtgcgcggcgtcgcccgcgaagaacacgcggccgtgacgcagccggtcgaccatccggctgtgcaggtgaaaataggacgaccacgcgagatcgctcggcgagatcgacgcaccggcacgggcacgcacgatcgcgtcgcaatccgcgagcgacgggaccggcgcatcggacgacgcgtcgctgccgggcggccggtcggccacgagccggtaacggccgccgcccatcggaaacaggccggccatgccttcgggcgtcgcgaacaggtgaatctcttcgtccggccagtcgggtatcgccgcgaaatcggcgagcaggaacgtctgctcgaacgcctgcccggtgaagcccaggccgagcagatgcctgaccgtgctgtgcgcgccgtcggcggcgatcaggtacgacggcgcgaacgattcgtcacgaccgtcggcgcggcggatcgtcacgtcgagcgacgcgccgcccgcatcgcatgcggtcagcgccgcgccgcgctcgaccgtcacgccgagccgggccagatgctcggcgagcaggcgctcggtgacggtctggtcgagaaacagcaggtacggatagcgcgtgtgcagcggatcgaaatcgagccgcgcgatcacgcggccgtcggcatggagcgcggccgcatgcgcacgatggccgagcgcgagaaacggttcgaccgcgcgatgctgctccagcagttcgagcgtgcgcgcctggatgccgatcgcgcgcgaatacggcgcgggcgcgacaagccgatcgatgatgcgcaccggcacgcgggctcgcgcgaggctcatcgccgcggcaaggccggtcggccccgcaccgacgatcagcacgggccggatatcgggcagtgtgtcagccatgagaacctcgatgacacgcgatcctgcaagtctacgccgctccacgtgacggggccatatgccgatcggtcgacgcgcggcgccgccgcgcggtgtgggaaaatacgccctttccgtcagttttcgcgtcatggataccgcattcgaccgagcgtatgccgcacaccgcgcgggccgcctcgccgaggccgagcacggctatcgcaacgcgctcgcctccgatcccgccaacgccgacgcgctgcatctgttcggcgtgctgcggcaccagcagggccagcacgccgaggcggccgacctcgtcggccgcgccgtcgcgctgcgtccggacgatgccgcgctgcagctcaatctcggcaacgcgctgaaggcgctcggccggctcgacgaagcggtcgaccgctttcgcaacgcgctgacgctcgcgcccgaatttccgctcgcgcactacaacctcggcaacgcatatgcggcgctgcagcgccacgacgatgcgatcgacgcattcggccgcgcgctgcggctcacgcccgacgatgcatcgatccacaacaatctcggcaacgcgctgaacgcgctcggccgccacgacgacgcgctcgccgcgttccatcgcgcgctcgagttgcggccggggcatgctggggcgcacaacaacctcgcgatggcgctgaacgcgatgggccgcgccgacgatgcgatcgcgcacttccaggccgcgatcgccgcgcagccgcgcttcgtcgccgcgcacttcaatctcggcaacacgttcgacgcggtcggccggcatgccgaggcggccgccgcgttcgaagccgcgctcgcgctgcatccgccgtttccgctcgcgctgttcgggctcgcgaacgcactgagcgcgcaggcgcgccaccgcgacgcgctgcccttctacgagcgagcggtcggtctcgatccgtcgttcagcctggcctggctgaacctcggcaacgcacatcacgcgctcggtgcgcacgagatggcacttcgcgcgttcgaccaggcgctgcgtgtcgcccccgatctcacgctggcacggctgcaccgcgcggtcacgctgctgacgctcggcgacttcacgcgcggcctgcccgcctatgaagcgcgccacgacacgccgggcgcgacgccgctcggcacgctgccgcgctggcaaggcgaaccgattgcgtcgcgcacgctgctgatccgcgcggaacagggcttcggcgacacgctgcagttcgtccgcttcgtgccgctcgcccgcgcgcgctgcgcgcgcgtcgtgctcgaagtccagccagaactcgttacgctgctggcgccggcggccgcgcgctggcgcgtgaccctcgtcgcacagggcaccgcgaaaccgcccgccgcggatgtcgcctgcacgctgatgagcttgccgttcctgctcgggcttcaggcggaggacatcgtcgcgggctcgcgctacctcgatgcccccgacggcgccggcaggcgttttcgcggctcgctcggcgggcagtcgaagcgcaagttcggccttgcatggtcggggcgccggcaggcgcaggaaaaccgctcgatgccgttcgacgcgctcgcgccgctgctcgcgctgccggatatcgactggatcgtgctgcaacccgcactcgacgaggacgaacgcgcgcgcgtcgacgcgcatccgcgcgtgcaccggttcgacggccggttgaacgactttgccgacacggccgcgctgatcgagcggctcgacggcgtcgtcacgatcgataccgcggtcgcgcacctcgccggcgcgctcggcaagccactgtgggtcatgctgccgttcgcgcccgactggcggtggttcaccggcgacgactgcccgtggtatccgcaggccaggctcgcccgccagcccgcaccggggcaatggctcgacgtggcggcagcagtcgccggcatgctgcgcgaagcctgaacgcggacgaaaaagggagcgccgttcacccgggctccctttgtccatgcgacgcgcgcggccggcgccgcgcgacatgtgcttgcccgtcaggccgccttgtactggttgcgagcctcgggcgtgcgatacagcacgagtgtcgcgatcagcccgcaaatcgcggcaacgctcagccacagccccggcgcggccttgttcccggtctgatgaatcagcagcgtcgagatcgcgggcgtgaagccgccgatcgtcgtcgccaggctgtatgccagcgagaaaccggccgtgcgcacgtcggccggcatcacttcggtcagcgcgacgaccattgcgccgttatacgacgcatacaggaatgacagccacagctcgaccgcgagcagccgcaggaacgacggatcgccgacgagccacagcacggccgggtaagccgacagcagcgtcagcacggtaaacgcaatcagcaccgggcggcgaccgatgcggtcggacaacgcaccggacagcggcagccacacgagattggaaatccccacgcagacggtcacgacgagcgcgtcgagcgacgacaggtgcagcacttccttgccgaacgtcggcgtataggcggtgatcatgtagaacgacaccgtcgtcatgatcaccatccccatgcccgccaccacgacgccccagttgtcgagcatcgaacgcatgatctcgcccatcgtcggacgatgacgcttcgcgaggaactcgtcggtctccttcagcgaacgccggatcaggaacaggaacggcacgatcaggcagccgatcaggaacggaatgcgccaaccccacgcggtcatctcctcgaccggcagcgcacggttgagcagcacgccgacgaacgcggcgaacaccacggccacctgctggctgcccgattgccacgacgtatagaaccccttgtggcccttcgtcgcgatctccgacaggtagaccgacacgccgccgagttcgacgcccgccgaaaagccctgcagcagccggccgagcagcacgagcaccggcgcgagcacgccgatcgtcgcgtagccgggtatcgcggccaccgtgagcgtgccgagcgccatcagcccgagtgtcaggatcagccccttgcgccggccgtggtggtcgatgtacgcaccgagcacgatcgcaccgaccgggcgcatcaggaagcccgcaccgaacaccgacagcgacagcatcagcgacgcgaatgcgttgccgctcggaaagtaggttttcgcgatggccgacgcgtaatagccgtagaccatgaagtcgtacatttccaggaagttgccgctgacgacgcggaacacggtgcggaatttcgattcctgcgtgatggcgtgtgacgctgtggacatgtttttctcgctcagctcggatggcgcgaatccgcgccgcatggatccgacgacgcacgcggcgccgggccggcgcgcacgggcatcgctgcccgccggcggcgcgccgcgcgacgacgcgcgcaccggcatggttcgcgcatcatgccacgccaacccgacatttgccttgtgccgccgcgaccgttgccattgccgtcgcggcactcttctcgtacgagtcgcccagaatcgggagcaaaatcggattgatctgatcgacctgctctcgccacctgaccacaatgtcacgatttgcgacgacatttccgcgccgcggccggcaaggttgcccgtgtcgcacggcgtaccgccctcatgaccccatcgccactcgtccccgtcgaaggcgcactcgcccgccctcgcgtcaagccgctcgatatcgctccgtcgttcggccgcgaatggacctttcgcggcgcgcccggtgcacggcccgacaggcactgtctcgccacgctgacgacatcctgcatcgacgtcgaccggccgcacagcacatgccgctggcagccgcggtccgtggcgttatcgatgccggtttcggctggcgcgccggtcgtgccggccggcgttaccggcgcgcgcatccgccgttctcacgaccggcgtgcgcggtatgcgatctgctggagcatcggcgcgctcggcatcatcggctggctgatcgccgcatatgaaccgcctgcgggcttcgggcccacatacgcgattcaagcggccggcagcgtgccggatcacgctacgtcgtggtccggcaccgtgcaggtcgcgacggtacagccgggtacgtcgacgagcacgccaccgcagcacacgatggccgcgcctgtcgcgacaacggccgaagcgccgcaggtcatgcaccacgtcacgcgtcgtccggcaccgcttcgtcccgacgcaacgtccaacgtgccgcccgcggccgttgcatcgtcaccccattcgaacgacaaacgcggcgcgacggcagcaccggcccggcccgcgaccccgtcgcggctggccgcgcgcccaccggtccgaagcagcacggttgccccacgcgcacatgatcagttcgcccccgcgtcgcccgcaatcgccgaaccacgcgactcgctcgacgatccgctcacgctgatcgcaatggcaagcgcgctgcgcgctacccaacccgagcgcccatcgcacacgcccgccgccggtttcgactggacggcacaactgtcccaccgccgcctgaccgatacgccggacgcgttcgcgcgctgacggccgcaccatgaaaaacccggcgaagcgcgcttcgccgggttttgcccgtctctctccgtccgtctgacgaatcgttacttgtgtgccggcagccccgtctcggtctgcttctcgagttgccgcacctgctcctgcagatcacgcaactgcatctgcgcggcccgcttctcgacctgcagcgcctgtgcctgctcctgcgccgaacgctgccgttgcgcgacttcggcctgctggctacgcgcaacgctcaggtcggcctgcaactgctgcgcacggttcgcctgcagcgcgatcacgcgctcgagaaacgctttctgcgcctccagctcggtacgacggatctcgatatcggcgagttgtacggtctgctgaacgaagttcgcgtacaccatctccgcgcggctcttctcctgcgaccggatcacacgccacaggtgcttgtcctggaacagcgcgacgtagtacgtcatctcgcgcggatcgaacatcaggctcgcaccgtagctgccgttgtacgtcgtgcgcatttcgacgatccggccatcgtgcagcatctgcgtcagctcggcgacgttgccttgcgcggatgcatccgtcgccaccgtggcggacgccgccgcgtcgccgcgcaggctcgtgaccgccgggcgcgtaccggcggccggcgcggtcgcgtcggcggaccaggccgtgcctgcttgcgtgcaggcagccagcgcaacgatccacgttgcgcatcgtgcagggaaaaatttcggaaaaccaacgtcggactccggcgaacgaatcggaactcgcgattatcgttcaaaacgaaatggccgcatctcgaatttatcgggatgcggccggccttcgtacgacgcgaagaaagtggctggctacaggcgggtttcgcgcgccgcgcgcaggaacgcatcgagcagcggcgtgcagtcgagcagctccgagccgccggcgcgatggaactcggggtgccactgcacgccgacgacgaacggcgaacgccgatgacgaatgccttcgatgatcccgtcgcccgccgacacggcctcgatgttcagatcgcggccaagatcgcggatcgcctgatggtgaatcgagttgacgatcgcctcgctgcgcccggggaacatgctcgcgagcgtcgacgaatcgggaaagcggatcgcgtgtcgatgctggtcgtaatgctcgctcacgtgcgcattcgcggtgggcacgtcggtggcgatgtcctggtacagcgatccgccgaacgcgacgttgatcagttggcagccgcggcacacgccgaggacgggtttgccggattcgacgaactcgtgcagcagctcgagttcgtacatgtcgcgcacgcgatcgcccggccattcggggcgggcgtcggacgctgcgtaggtttgcggcgatacatcggcgccgccctgcagcagcagcccgtcgagatgcttcgcgtagtcgcgcaggcggatgttgctcgggtgaatcatgccctggtggccgacggtcggaatcatgaacacgagcacgtcgcgcgacatcacccagtgcgcgatcgattcctcgagatactgcagcgtcttgccccgcagccccttcgctcccggttccggatggaagatccgcgccgacacgccgatgcgcagcgtgcgctgcgtgatgcgctggccggcgcggtcgaacagccggcgcgcgcgcggccacgatccggccgaacaccgaccacggcgtgtcgctctgcttcaggtaggccggcggcgcattctgcgcgctcgccggcggcgggcgcggcgtgtcgaagtcgggctgcgcgccgaaccccggcggcggcgcgccatgcttcggcggcgcggcagcagcgccatcgacggcggcgcccgttgcaccgggcgcacccggctcggacgccgccgtgaccggcgacgcgccgtccgcggcgacgttctgcgcggcggcctgggctgccggcgcatcgggcgctttcgccggatcggtacggggaatcggaagaaacggaggaggtgccgggcagaccggccggggaaggcgtgttttcgctcatgacgatggtctggtacgtcgctcacgcgtatggataaacgaggattcattatgcgtcagcgcacgatcgcgcggcaaacctgcaacatcctgtcgatattgttgcaagtcggcggcaaactgcgccggcaagcgccccgtccctcgcgccggcaagccggtgcaccgccgccggtactggacaccagtgatatatcacaataatatccagccatcgtccacgcttcccgatcgcccgcgccatgatcgcgccccgtccggccgccgcgccgcacaccgcatgaatgccctgaccgacgtcacccgcgaccgccccgccgcaccggcggccagcctcgccgaccgcgcttatgcgctgatccagcgcgacatcatcacgatgcgcctgaagcccggcgccgcactcaacgaagccgacctcgtcgcccgcaccgggatcggccgcacgccggtgcaccaggccgtgcatcggctcgtgctcgaagggctgctgtccgtgatgccgcgcaagggattgatggtgcagccgctgtcgctcgacgacatcgtcgcggtgatcgacgtgcggcgcatcaacgaagcgcactgcgcggaactcgccgcgcgccatgcgacgcccgacgatctcgcgcgcctggccgcgctgctcgacgaaggacaggcatgcgtcgacacgcacgacgtcgagggcatgatggaactcgaccgcgcgttccaccaggcgatcgccgcggccgcgcgcaatgcggttctcgccgagatcctgcgcgcgctgcacgaacgctcgctgcgcttctggttcgtcacgctgtccgaaccccaccatctcgccgacgtccagcacgagcatcgcgaactgttcgaccggctgtccgcgcgcgatgccgccggcgcacgcgcggccgtcgaaaaccatatcgactcgttccgctccacgcttcttcaacatcttcgcccctgagccgccatgaccactttcacgccctttccccgctcgcccagctcgccgccgatctcgccgccggccggaccacgagccgcgcgctcgtcgacaccgcgctcgaccggatcgccgatccgtcgggccagggcgcggtcgtcttcaccgaagtcgatgccgacaacgcgcgtgccgccgccgacgcgcacgaccggctgcgcgccgcgggcaccgtgctgtcgccgctcgcgggcattcccgtgtcggtcaaggacctgttcgacgtcgcgggccaggtgacgcgcgcgggttcgcgcgtgctcgacggcgcgccggccgcgcgcaccgatgcggtcgccgtcgcccggctcaagcgggcgggcgcggtgctggtcggccgcaccaacatgagcgagttcgcgttctcggggctcgggctgaatcctcacttcggccacccgcgctcgccgtaccaccgcgacgtgccgggcgacgcacggatttccggcggctcgtcgtccggcgcggctgcgtccgtcgccgacggatggccgccgtcgcgctcggcaccgacacgggcggctcgatccgcattccggccgcgctgtgcgggctgacgggattcaagccgaccgcgagccgggtcccgacacaaggcggcgtaccgctgtcgacgacgctcgactcgttcggcccgatcggcctgacggtcgcctgctgcgcgctcgtcgaccggatgctcgcgggcctcgaaccgcacgtaccggccgcccggccgctcgagggcgtacggctcggcgtgctgacgaactacgtgacggacggcgtcgacgccgacgtcgcggccgcgctcgacgccgcgctcaagcatctcgaagccgccggcgcgatcgtcacggaagtgcgcttcccggcgctcgaccggctgccagacgtcaaccgcttcggcttctcgccgatcgaggcctacgcatggcatcgcccgctgctcgctcggcaccgcgaccagtacgatccgcgcgtgctcacacgcatcctgaagggcgaacccgcgagcgcggccgattatctcgacctgctcgccgcgcgcacggcgatgctcgatgaagccgcgcacacggtctgggcgcgcttcgatgcgctcgtcgcgccgacggtgccggtcgtgccgccgcgcatcgccgacctcgaaacggacgacgccgcgttcacgcgcaccaacgcgctgatcctgcgcaacccgagcgcgttcaacttcctcgacgcgtgcgcgctgtcgctgccgtgccatccgcgcgacgcggcgccggtcggcctgatgctcgcggccgcaccgcatcgcgacgacgcgctgctcgcgatcggccaggccgtcgaggccgtgctcaatacgatccgctgaacgcagccagccgagcgccggcggacagggcgcgcggtgcggcaggttgccgcacgcgcgctgtcagtttcgtgccagaccgttcgcgctaaaatcgcgcgattgttttccggaccgaccccacgaggaaccccgccgacatgaacgactacacgctcgcaatccgccgcgaacgccgcctgctgatgctgctcggctgggtgtgcatcgccctgctggccggtgcgctctacctgcagtacgtgaagaacgaagatccctgcccgctgtgcatcatccagcgctacttcttctgcgcgatcgggatcttcgcgttcctggccgccgggatccgcaactggcgcgtcatctgggtgctcgagctgctgatcgcgatcgccgcggccggcggcgtcggcacggccgcccggcatctgtcgatccagatgaatcctggcttcagctgcggcttcgacacgctgcagccgatcgtcgacagcctgccgcccgcgcagtggttccccggcatgttcaaggtcgccgggctgtgcgagaccgtctacccgccgatcttcggcatcctgctgcccggctgggcgctgatcggcttcgccgcgatcctggttgccgtcgtcgcgagcctctggcgccatcgccgcaagctcgcggcctgaccggccggtttcgcaccggcctgctcacccgggccgcacgccgccggccggcaagccccgcaccggagcactcgccgaaccggcccggccggtcgcccctgaccggccgtacccgggcggccccgcgtaaacacctacctcgccgccgcccggatagccgggcgaacgcgcatcgcgcgacttccgctcccagccccgccacgcctgcgttttggcccgatgtgcacgcatcggcgccccgatcccgggcggcgggcctatgatcgacatgatcgcctcctgatagcccggatcaccgccccgcgatgttcccgccgccgtgcggtgctatcttcgggactggatggcgatctacgtgcgcgaggccaggcggtctcaccacccctgcgtaacgcgcgcccgatccgcaatgtcgactggattcatcatgacaacgcaaaccatccgcatccgtcaccctcatggcgtccgcgcatccggcggtgccgtccgcgcgcactgtcgccgcgccgccgcaccgcattcgccgtgcggccggcccgccccgtccccgtccgtcatcgttgccgccacgctcgccagcccgtgccgcgtcgtttcgcaagggtgtgctgatggaagcctggctcggcgatctgcaacaactgctcgcgcacggcgaagccgccgtgctcgtgacggtcgcgcacaccgacggctccgcgccgcgcgaagccggcaccaagatgctcgtcacgcgcgacacggcccgccatacgatcggcggcggtcatctggaatggaaggcgatcgagatcgcgcggcatctgctgaaggacggcgcgcacgtgccgcacgcgcgccggctcgaacggctcgcgctcggcccgagcctcggccagtgctgcggcggcgccgtggtgctcgcgttcgagcggctcgacgtcggcgatctcggctggatcatgtcgctcgcgaagcgtgtcgcggccggcgccgcgaccgtgcgtagcgtatcattcggccctcgccgggcgcgccgctgttgagcgagcccgaatcggaagccgcgcgtgccgactgcctgctgtgggaaaccggcggcgtgtcgctgatgaccgaaacgatcgcgccgtatgcgttccccgtcgtgctattcggcgccgggcacatcggcaccgcgctcgtgaaggtgctggcgacgctgccgtgccaggtgcgctggatcgacgggcccgatgcggtgttcccgccggccgacgcgctcgccggcatcggcaacctcgcgatcgaggcggccgctgccccggccgacgccgtcgacacggcgccgccgcagtcctacttcgtcgtgatgacgcacgaccacgcactcgatttcgtgctggccgagcgcatcctgcgacgcggcgactatgcatacttcgggatgaccggctcgcacgccaaacgcgtgcagttcgatcatcgcctcgcggcgatcggcatcgacccggcccaggtcgcgcggatgcgctgcccgatcggtgtcgaaggcatcatcgacaaggcgcccgaagtgatcgcgatctcggtggctgcgcaattgctgcaggccgtcgaagcgaacgcggccgcgcaggcttccctacctactgaccgaccaagaacgacgccatgaccccgacattcaaggacaagattgcccgcgcgccgaaagcggagctgcacatccacatcgaaggctcgctcgagcccgagctgatcttcgcgctcgcgcagcgcaacggcgtgaagctcgcgtacgactcgatcgacgcgctgcgcgccgcctacgcgttcaccgacctgcagtcgttcctcgacatctattacgccggcgcgagcgtgctgctgaccgagcaggatttctacgacatgacggccgcgtactgcgaacgcgcgctcgccgacaacgtcgtccacaccgaactgttcttcgatccgcaaacgcacaccgaacgcggcgtgccgatcgagacggtagtcgcgggcatcgagcgcgcactcgccgattacgagcagcgcgggctgtcgagcaagctgattctgtgcttcctgcgccacctgtccgaagaggacgcgctcgcgacgttcgaatccgcgctgccgctgttcgagcgctatcgccatcgcctgatcggcgtgggcctcgactcgtccgaactcggccatccgccgacgaagttcgcgcgcgtgttcgacaaggcacgcgcgctcgggctgaagctcgtcgcacatgcgggcgaggaaggcccgcccgcctacatctacgaggcgctcgacgtgctgaaggtcgaccggatcgaccacggcgtgcgcagcatcgaggacgcggccctggtcgagcgtctcgccaggacgcgcacggcactgaccgtctgcccgctgtcgaacctcaagctgtgcgtgttcgacgacatggcgaaacacacgctgaaggcgctgctcgatcgcggcgtcgcggtgacgatcaactccgacgatccggcctatttcggcggctacgtcaatgaaaactacttcgcgacggccgaagggctgcaactcacggatgccgaagtccatgcggtgatccgcaacggcttcgaggcatcgttcatcgaaccggcgcaacgcgacgcactgtacgcgcgcctcgacgcgtactggcaggccgcctaacggcccgcatcgaggaacgccagacagatgaaacacggcaacggcatccgcttcgcaaccaccggcccggcatcgcgccggaacggtcgcgtgcgtgcctgcgcggcgagcgcgccattcgtcgtcgcccgcccgtgcttgccgtcgcggttcgccgctgcgttcgccgccgctccggtcgcgaacgcagcggctgcgaggcccgccggcaaccactcaccggcggcttcggccgccacgttcgcccgcgcaattgcctccggtcgtgccgcacgcagcatgccgctaccgctcgcgaaacgccgtcccgccgccctccggcgtcgatcgctttcttctgttcgccttaccttgatgcaggaccattcgtcatgacgcaaaccgctttccgttcccagctgctgactttcaacggcgacccggcgcaatcgagccaggccgcgaactacgagaccgacggcctcctgatcgtcgacgacggcaaagtcgtcgcggccggcccgtacgcgcagctcgccgcgacgctcgcgcgcgacgcgatcgtccacgacctgcgcgacaagctgatcgtgcccggcttcatcgacacgcacatccactatccgcagacggacatgatcgcgtcgccggcgccgggcctgctgccgtggctggacaagtacacgttcccgaccgagcgccagttcggcgatcccgagcatgcgcgcgaggtggccgacttcttcgtcgacgaactgctcgcctgcggcacgacgagcgcgctcgtctactgcacggtgcacaagcagtcggccgatgcgctgttcgcggcgagcgacgcgcgcgacctgcggatgatcgcgggcaaggtgctgatggatcgcaactgccccgaattcctgcgcgataccgcgcaatccggttacgacgacagcgccgagctgatcggccgctggcatggcaagggccgccagatgtacgcgctcacgccgcgtttcgcgccgacgtcgaccgaagcgcagctcgaggcgtgcagcgaactcgcgcgccgccatccggacgtgttcgtacagagccacgtcgcggagaacgtcgacgaggtgaaatgggtggccgagctgttccccggccatcgcagctatctcgacatctacgaccgctacgggctgctgcgccgcgcgcggtgtacggccactgcatccacctcgacgacgaagaccgccgccggatggccgagacgcgcaccgtcgtcgcgcactgcccgacgtcgaacttcttcctcggcagcgggctgttcgatttcgacaaggccggtgaatacgacgtgccggtcacgctcgcgaccgacgtcggcggcggcacgtcgttctcgatgctgcagacgatgaacgaagcgcacaaggtcgcgcggctgtcgggccaccacctgaccgcgacgcggatgttctggctcgcgacggccggcgccgcgcaggcgctcgacctcgccgacacggtcggcacgctcaagccgcgcaccgaggccgacttcgtcgtgctcgatccgcaggccacgccgctgctcgcgcgccgcacgaagcgcgcggattcgctcgaggaactgctgttcgcgttcgcgctgctcggcgacgaccgcgcggtgtaccgcacctatgcggccggcgaactcgtccacgagcgcggggcggcgcgccgccccgccgcgtaacggcgctccggggtgtcacggcaggcgcgggcgttcgccgccgcgtctgcctgcggccgctacccgcctgccgggcctgctgtacggccggagcttgccgaacgccaatccccgccccgacaccaggcaccgcaccgctcgaccgctttcccgcgcgcgacacgccgtgctagaattcgccgctcattggggagtagccgctccgctcgatgtcccgcaccccggcgcgcatcgtgacggaggcgtccgtcaacagacttggccttgcggccatggcgggcgcagccacctaggcctggcgagaccgatggttcacagtgcgccgcatcagggcccggcgcgccgtggatcgtcgctcgcacgcacaacaccggcccgtggaaccccatacgtgtctcaagccttcctgatctccaccggcgccgtcgccctcgctgaaatcggcgacaagacccagttgctttccctcgtcctggccgcgcgctatcgcaagccggtgccgatcattctcggcgtgctcgtcgcgacgctcgtgaaccacggtttcgccggcgcgctcggcgaatggctcggcgcgctggtcacgccgtcgatcatgcgctgggcgctcgcgttctcgttcatcgcgatggggttgtggatcctcgtgccggacaagctcgacgccgacgaggccaatgccaaccgctcgcggctcggcgtgttcggtgcgaccctcgtcgcgttcttcctcgcggaaatgggcgacaagacgcagatcgcgaccgtcgcgctggccgcgcgcttccaggactacatcggtgtcgtggccggcacgacgttcgggatgatgctcgcgaacgtgcccgcgatcctgctcggcgaccgtttcgcgcaccgcctgccgacgaagctggtgcacggcatcgcggccgtgctgttcgtcgtgctcggcgcgctggcgctgctgggcgtcggggtctgacgggaagaaaacggcaggcgcggccggacggccgcgccgaggctgatgccgcgttacttggcggcggcgcccgaagcgggcgcagccggcaccgcgcgctcgttggcggccggtgccgccgggccgccgcgcttgtcgaccggcagccggaccgagcggaccgcgccgttcgacagcgggaaatcggcgagcgcgctgcgcgcgaggaacggcatcgcgtacagtagcgtgccgttgtcgccggtcgtgcgcgcggacacgttgtagacctccttgcccgtcgcgcgctcggtgatgcggatgccgagcgtgtagtcgaacacctgatacgtctgcgcgacataaccggccggcatcggccccagggccccacgggccccacggcccgcgccgccagtacggccccggcccgacgaaccacggatcgtaataaacgggctgcggcaccgtcacgagatcgctgccgaccgcataggtcagcccgacaagatagcgcgcctgcgcctgcggcacctgccggaacgcatacgtggacagctcgttcgcgacgatcggctcgtaagtcgactgctcgatgctgttcttctgcgcgtcggtgcgggtgaacgcataggtgcgtgtcgcgtcgctgccgctccagtcggagaaggcggtgacctgggtcgtcacgtagctggtgcagccggtcagcagcgccacgcacagcaccgccgcccagcccgcaccgcgttgaatccattcgcgtttcatgttgatcctcttcgatccgtcacccgttcgtcgcaccgcgcgaaccgtaacggatgccgataatacgcggactcccggaaccggtaaaagttcgcccggcacgcagccgcaagcctttgtacaatggcccggttcgcccggcccgtgccacgggcccgtccccactccaccgatctcgacgaccatgtccgacaacgcttcctccaccgtgatccgccgcgccgactacacgccgccggcctttctcatcgatgccgttgcgctcgaattcgatctcgcgccggcccgtacgatcgtcaggaatacgatgcgcgtgcgccgcaacccggacgccgcgcccgcgccgcacctggagctgatgggcgaagcgctcgaattcgtcggcgcacggctggacggcgcgccgcatggcgccgtgcgcgcgcacgagcacgggctgaccgtcgagaacgtccccgatgcattcgagctgacgctcgaaagcgcatgcgcgcccgaccagaatacgacgctgtcgggtctctatgtatcgagcggcaacttcttcacgcagtgcgaagccgaaggctttcgccgcatcacctacttcctcgatcgcccggacgtcatggcgtcgtacacggtgacgctgcgcgccgacaaggccgcctacccggtgctgctgtcgaacggcaacctcgtcgattccggcgacctgcccgacggccgccacttcgcgaagtgggaagacccgttccgcaagccgagctacctgttcgcactggtcgccggcaagctcgtcgcgatcgaggagaagatcacgaccggctcgggcaaggaaaagctgctgcaggtgtgggtcgagccggccgatctcgacaagacgcgtcacgcgatggattcgctgatccattcgatccgctgggacgagaagcgcttcggcctcgaactcgatctcgaccgcttcatgatcgtcgcggtcggcgacttcaacatgggcgcgatggaaaacaagggctcaacatcttcaacacgaagtacgtgctggcgaaccccgagaccgcgaccgacaccgacttcgcgaacatcgaatcggtagtcggccacgagtacttccacaactggaccggcaaccgcgtgacctgccgcgactggttccagctgagcctgaaggaaggcctgacggtgttccgcgaccaggaattctcggccgacatggccgcgggcgacgccgtcgaatcggcggcccgcgcggtcaagcgcatcgaggacgtgcgcgtgctgcgccagctgcaattcgccgaggatgcaggcccgatggcgcacccggtgcgcccggagagctacgtcgagatcaacaacttctacacgatgaccgtctacgagaagggctcggaagtcgtgcggatgtaccagacgctgttcggccgcgacggcttccgcaagggatggacctgtatttcaagcgccacgacgggcacgccgtgacctgcgacgacttccgccatgcgatggccgacgcgaacgggcgtgacctcgcgcagttcgagcgctggtacagccaggccggcacgccgcgcgtgtcggtgcgcaccgcgtacgacgcggccgcgcgccgctataccgtcacgctcgcgcagggctacggcgacgcgtcgccggccgcgcgcgaaacgcagcaagggccgctgctgatcccgttcgcgatcggcctgatcggccgcgacggccgcgacctgccgctgcgcctcgacggcgaagccgccgcggcgggcacgacgcgcgtgctcgacttcaccgacaccgaacagaccttcacgttcgttgacgtgccggaacaaccgctgccgtcgctgctgcgcaacttctcgtcgccggtgatcgtcgagtacgactacagcgacgacgacctcgcgttcctgctcgcgcacgacagcgatccgttcaaccgctgggaagccggccagcgcctcgcgacgcgcgcgctgctgacgctcgccgcgcgcgccgccgcgaacgagccgctgacgctcggcgagaacttcgttgccgccttccgccgcgtgctgaccgacgcgacgctgtcgcccgcgttccgcgaactcgcgctgacgctgccgtcggaaacctacctcgccgaccagatggccgaagccgatccggccgccgtgcatcgcgcgcgccagttcgtgcgccgccagctcgccaccgcgctgcgcgccgactggctcgccgcatatgagcagcaccagacgcccggcgcctacgaaccgacgcccgaggcctccggccgccgcgcgctgaagaacctcgcgctcgcatatctcgccgagctcgaggatccggccgatgccgtgcgcctcgcgaccgcgcaatacgacgcggcgaacaacatgaccgatcgcgcggccgcactcggcgcgctgctgtccgccgcggccgccggcgcgaacgaaccggccgagcacgcactcgacgatttctaccgccgcttcgagaaggaagcgctcgtgatcgacaaatggttcgcgatgcaggccgcgcaacgcggtacgcccgcgcagccgacgctcgcgaaggttcgcaagctgctcgcgcaccccgcgttcaacctgaagaatccgaatcgcgcacgttcgctgatcttcagcttctgcgcggccaaccccgcgcaattccacgcggcggacggctcgggttatgcattctgggccgaacaggtgctcgcgctcgacgcgatcaatccgcaggtcgcggcgcgcctcgcccgctcgctcgaactgtggcgccgcttcacgcccgcgttgcgcgaccgcatgcgcgaagcgctcgagcaggtcgcggccggcgcgaagtcgcgggacgtgcgcgagatcgtcgagaaggcgctcgcgtaacgcaattctccgcatcgctcacacgcgaaacagccggtgccgcccatggcggcaccggctttactgcgtgaatactgccggccccggacacagttgcggggtctgaccgcgccgcttaccgccgctgcatagcgcgtcccgtgcatcgccgccgccggaaaccgggccgatccggccgcccggccatgtaaccggacgaaaaagccggcggcacgggaggcgcgacgggtaaaattgcggccattcaaggattctttggccttctggagtctgtcatgtccattgcccgccgcaccacgctgtcgaagttcctgatcgaacagcaacgtgagaccaacaacctccccgccgacctgcgcctgctgatcgaagtcgtcgcacgcgcgtgcaaggcgatcagctacaacgtgtcgaagggcgcgctcggcgaagcgctcggcaccgccggcagcgagaacgtccagggcgaagtgcagaagaagctcgacatcctgtcgaacgagatcctgctcgacgcgaacgaatggggcggcaacctcgccgcgatggcatcggaagaaatggaaaccttcttcccgatcccggcgaactacccgcgcggcgaatacctgctcgtgttcgatccgctcgacggttcgtcgaacatcgacgtgaacgtgtcgatcggcacgatcttctcggtactgcgctgcccggacggcaagcaggcaaccgaggaatcgttcctgcagccgggcacgcagcaggtcgcggccggctacgccgtgtacggcccgcagacggtgttcgtgctgacgaccggcaacggcgtgaactgcttcacgctcgaccgcgaagtcggctcgtgggtgctcacgcagagcaacatgcagatcccggccgacacgcgcgaatacgcgatcaacgcatcgaacgcgcgccactggtacgacccggtcaagcgctacgtcgacgaactgaacgcgggcaaggacggcccgcgcggcgacaacttcaacatgcgctggatcgcatcgatggtcgccgacgtacaccggatcctgaaccgcggcggcatcttcatgtacccggccgacaagcgcacgcccgatcgtccgggcaagctgcgcctgatgtacgaagcgaacccgatgtcgttcatcgtcgaacaagcgggcggcgccgcgacgacgggcacgcaacgcatcatggaagtccagccgacgggcctgcaccagcgcgtgcccgtgttccttggctcgaagaacgaagtcgagcgcgtgaccggctatcacgacgaagcaaaataattgcactgcagcactagacggaggtgcgatgcgcaagtacaatcgcgcctcttgatgtggccctgaccggtcgcatcacagtgaagtgaaagcgggaagtccgccggatcgatggtttcgcgaagcagcagcagcaagctgaaaaaatttcgcaaaacctattgccaagatcccggaaatcaccatataatttcatttctctgctgccggtgtagctcagttggtagagcagcgcattcgtaatgcgaaggtcgtaggttcgactcctatctccggcaccaagacataaaggcctgacaagcatcgcttgtcaggcctttctctttccggcgccaaaatcgtgcgcccgccctctcgcctcacacagtccgcttgcgggcatccccgactccgtatcacacgccgacgactacaatcgccggacactccaccctcgcccccttcttcatgcgcacctggcgtctcgagcgagtgaatctcgccgcgcagctggacgtgtcccgcgcaacgcgcctcgtcgccgcgatcggcggcaacgagccgaacgcattcgcggccgaaatcctgaagctgttcgacgacgcgctgtccatcacgcagtgcacgatcttcgcgtacgagttcggcaatcgcccgcgcacgatgtcggtcgccgatcatcgcggaggccgctacctgcgcgatctcgccgacacctacgcacgacatttctacacactcgatggcaaccagcagatcgtgtcgaccgcccatcgcggcacacgccgccacgatctgctgctgcaccagcaggccggcgacgagatcgatcacgaagcgtatcgtgccgcgtgctaccgcggccccgacgtatccgaccggctggcgctgctgatgcagcccggcgatgcgacgtggctgtcgatcaacctgtaccgcgcgcatcgcagcggcgcattccagccgcgcgagatcgccgcgatcgaagcgctcgcgccgctgatcgcgcaggccgcaaggcatcactacgcgctcgccggtgccgcacagatcggtatcccgcaacggatgctcgcgcgactgcgccatgcatgccccgatttgtccaagcgcgagctcgacgtgctgcgcggcgtactcgacggccagaccgcgcacgagatcggcgagacgatcagcgtgaaggcatcgagtgtcgtcacctaccagaagcgcgcataccggcgtctcggcatctcgagccagcgcgagctgtttgcgctgtgcatgcagccgtgaaacgtcgcggcctgcgttgagcccctcgctgtacccgaattggggacaaccgacgcacgaccggcttccatactgtcccgacctgttgcgcgcatctttgcgtcgatgcgcgcacgtcgagccggacaaccctggaagccaacgatggatatcgacttcaagccctacccgttcgtcgccgagcgccatcccgcgcatctgccggcctgcgacgacggtatcgatacgcaccggcatcgcgttgcgatcgtcggtggcggccccgtcggcctggccgtcgcgctcggccttgcgaaccacggcatccgcagcgtgctgatcgaggccgacgacgcagtctgccacggcagccgcgccatctgcatctcgcggcgcagcctcgagatcatcgagcggctcggtgcgctcgacgacttcctgcgcaaggggctgccgtggaccggcgggcgcagcttctaccgtcgcgacgaagtgctgcatttcacgatgccgcaggacgcaaaccagaagctgccaccgatggtgaatctcgcgcagtatcacatcgagcagttcctgctcgacgccgcgctgcgccgccgcgaactcatcgagatccgctggcagacgagagtcaccggtgtgacccggcaaccggacggcgtgcgactcgacgtcgacacgccgctcggcggctacgcactcgacgccgaccgggtcgtcgcgtgcgacggcgggcgcagcacgatgcgcgacgcgctcggcctgtcgctccggggcacgagctacgagggccgctacgtgatcgtcgacatcgcgctcgacagcgaccggccgaccgaacgactggcgtacttcgacccgtcgtcgaacccgggctcgacggtgctcgttcacaagcagcccgacaacgtgtggcggatcgactatcagttgcgcgacgatgaggatgccgaagccgccgtgaagccggaaaacgtgatcccgcgcgtgcagaacctgctcgacatgatgggcgagcgcggcgactggtcgccgatctggatcacgatctacaaggcgaacgcactgacactcgaacgctatcggcacggtcgcgtgctgttctgcggcgacgctgcgcacctcgtgccgatcttcggcgtgcgcggcgcgaactcgggcatcgacgatgccgacaacctggcatggaaactcgcgtacgtgacgcgcggactcgcatcggacacgttgctcgacagctactcggacgaacgcgtgttcgcgacgcacgagaacctccgctacggcaccaagagcaccgagttcatggcgccgccgtcgttcgcgttcgaactgatgcgcaaggccgtgctgtcgctcgcggtccggcatcccacgctgcgctcgctggtcaatccgcgccagacgacggccatcgcgtatgcgacgtcgtcgctcaacgcggccgaacgcgacacgttttcggccggccccgcgcccggcacggtgctcgccgaatgcccgctgatgctgtacacggcacacggcagcgacgtgcgtcgcggccacctgaccgacctcgtcgctccgcgcttcaccgcattctgcttcactgccgacggcgtgcccgaggcgacgctggccgatctcgaacggcgcctgcaggctgcgcggatgccgttcgcgctcgtcacgctcgcacggcatgcggcgccacggcaaccggcctgcggcggccatgacgccgacggccggctgttcgacatgtacggcgcgcgcgacggcaccgtctatctcgtgcgtccggacggtcacgtactcggccgctggcacgacgcgcgcgccggcgacgtggccgccgcactcgaacgcgcactccatccttgcgcatcgaccgatcctcaggagaccgcatgatgacggataccgaacgcgacaccctctacaccgacctgtgccgcacgatgacgcggatcggtgaagccgatgcatcgctctttctcgcccgcttcgcactgctgtcgatcgaggcgatcggcgacaccgcgaccgtcgcacggctgattgccgacgcaagcgacggattgccctctgcgggcatgcaggcttcgacgctcggacgatgacgctcacggccgaccggcttcaccggcggccattccttacagattcatttcgccgcgcatcgcccgtgcgccagcctcgccgtatgcagacgaattccctggaaaatccggttacgggtgcataacattacttaacgattccgacccgtctatcgcgttacattgcgtgggcggcgcggcgggtcgcaatgccgccttcattcagcttgcggcgacagccgacgtccggtcattcgacacaacacaaggagaggaccaccatgactcatggcttgattatgtggctcatcatcggcgcgatcgccggctggcttgccggcttgctcgtcaagggcggcggcttcgggctgatcgtcgacatcatcgtcgggatcgtcggcgcagtgatcggcggctggctcgccgggctgctcggcatcagcatcggcagcggtttcatcggatcggtgatcgtcgcggtcgtcggtgcggtgatcctgctgttcgtgatccggctattcaagcgagcggcctgacgcttctctccacgcgccttcgggcgcgttttcgcatcaggccggcgcgcggcccgctcgccgcgcgccaccggcccgttcagcgcctggcgcgctgcaacccgccgtcgagcacgtcagccgtcagcaatccgctgcgcgcttcgcgtgcgccatcgcacccgatccatacggtgcgcggcatctccctctccatcccgcatcgagcgccgcgcgcagccgctcgggcatcggctcggcgttcgcgtactgcgcgacctgcggcggcagatgcatctgcgcgagtactcgggagatcgccgggccgttgtcgtcgtacacatccattgcgaccatcgcgagctgcatgtccggactcgtagcgatcttcggacgattctcggcgctcgtgtagatcgactccggcatcgcgttgacggtggcgggcgcggacagcgtgcggcccgcgtcttcggactgcgcgacgacgacatgcgcgccttcgacccacgcgccccacagccggtgatgcgcgtcgaatgccgccccgtcgcgagcggctgcttctgctgcgcgggcacttcctgcatgctcatgtgcgcggcgcgcgaatcggcggccttcggcacgacgtgggcatcgtgcgccccggcagtcgacagcaacgcgcaccacagcgcgcctgccgcgagcgatttcacagtgaccatttcagttctccgtagaaagtacggcccggatatgggtggaacacgtagtagcggcggtccgtcaggttgtcgatgccgaccgacgcggtccagtgacggtcgaagcggtagcgcgccttcaggtcgacgatcgtgaacgagctcgtcccgccgtagacgtccgggttcacgtcgctgttgtcgagcgtgttgaactggcggcccgaatagcgcacgccgacgctcgcgagccagtgttcgtcgaagcgatacgacgcgagcaggtttgcacgcatgcgcggaatacgcggaaagcgcgacccgacgtacgcgggattcgcggcatcggcgaggatctgcgcgttgctcgccgacacgttcgcgtcgagactgaggccgcgcaacccgacgttctcgccgctgaacgcaagttcgacaccgcgcacgcgcacgcgatcgacgttcgagatgttggtcaccgtcgtcgcacccgacaccgtcgtctggctgtagatcgaatcgcgcagatcgctctggaacacgctggcacgcacgacgccgacacccacgtcgcgctcggccgtgaagtcccagtcgatcgccttttccggccgcaggttcgggttgttgttgacgattgcgttgttcgagatcgtgccctggaacagttcgccgaccgtcgggtaacgcgtgcccgtcgcgaacgacagccggaagcgccagacgtcggtcgcatcccattgcaacgcgactttcggcgacagcgcattcgcgctgcgatccgcataaccgagcgtgccgctcgcgttgccgagcgcgccgccgtacgcatcccagcgttcgtagcgcagccccagcgtcgcgagccagcccggtgcgaagcgccacgcatcctgcccgaacagcgcctgcgtgcgcgtgtcgccccgataggtgctcgcgagcgacgtggtcggcccggccagccagtcggccgtgttgtacgtgacgttgcgcaggaagtagttgtcgtagtggtagccgaacgtgaacgtgtggcccttcacttccggcgcctcggccctcaggtcgagcgtgcgccagccggtgccgtcccctggaacagcgtgcctgcaccgccctgcacggtcgacgccgagcgctgcacgtcgcgcgacacgtcgtacgcggacacgacgcccgacaggtgccagcctgaatcgagccggccgttcagcccgagcgcgtacagccagttctcctggtcgccgcgctgcggcgcgaaggcattcggcgcaacggtcatgttctggccaccgatcgacacgttgccgccgtagaccggattgccggccgcatcgcgcagaaaggtttcgccgagctgccggtaatggttctcccaatgcccgagcgtgagcgtcgcatcgacgtgctcggtgaacgcgtagcccatccggatcgtctcgttgagctgttcggtccgctcgatcgtctgcgcgccgacgatcgttcgcggcttgccgttgggcccgatgtcggtcgcggcgccgctcacgggcacggcggcgccaagcttggggttgtacgccgaattggggctcgcatattgcatcggctgaccgttgttctcgagccggtcgagcgacagcgcgaaccagaaccgcccgacgcggttcgcgatccgtgcggtctggtgattgccgccgaggctgtccgcgaatccgtagccgtcgtggtagcgctgcgtaaagaactgcgtcgacagcgacgcctcgagctttccggccggcgcgtcgtgagcagcacggtcgagccgatcgagttgcccgggtacagcgcggaaaaagggccatagagcacgtcgacgcgcgcgacatcgtcaggcgggatcagcgaccagcgcggcgggtacgcgtagctcgagccgagcaggttcgacagcagcacgccgtcggcatagacgagcccacgcgcgctctgcagctcgttgaagtcgcgaccggcgaacacgctgttgcggtcgccgatatagcgcttgcggaccatcaggttcggtgcgtacttgagcgcgtcctcggtggtgacgttggtatgcgattcgatctgctcccgcgtgatcgacgtgacgacggccggcatatccggatcgaccggttgccgctgcgcggtcacgctgaccgcggtcagcgtactgccggccggcaccggcgaaacggttgcggcggtggatgccggcgcgacggtatcggcgggacgctcgacaccacggcaggcagtgtcgacacgcgtatcgtcagttgaagccgcatgggcgacaggccacgcgaaagcggccgcgcatgcgagcgcgagccgcccgcgcgacggccgcgcggcgaaggaggaggacatgaggggattcctgaaaacgtgatcgaacgccgccggacacgagcgcacgcaccgcgcacgggcggcgcggcacgcggcccggccgcgagcggcacgcgcgccaccggggcgcgcggacgacatcaatcagatcggagcgttttcaggcggcgcgcggggctgcgcgagacggatacccttgcgggggcaatcgggaatgacgggtgctgccgcgcggtaggcgaacgtccgcacgaaacccggcagcgcgggcaggctcgtaccgagcgccacgttcgccgcgaagccggggcagtacatgcagtgcggcacgccggcatggtcgaacgacggcgcatcgtgatcgcctccggcctgcgcgagcacgatctggcgggcgcccgctgcactgcacaactcgagcgtgagctcgccggagccgctcgaggcgagacgcgcatagccgacgacgggcgacagtacgttcagtaccagcgccagccatacgaggccgatccatcgcgtcgttcgtttcatcgcggtgcaggaaaaagtgcgcgcaagtataacaagcggcccgattgttgccgattccgcacgactcgatagtcggcatcgcagcgcgcgtccgagcgcatgtgccgttaatacaacagagacaaaatctaacgattcgccactggcataaatccaagcgcgaggatgataatcatcgaacctgctggagaaatgaccatggacgaaagaccaactcgcatgccaccgccggagcaagtgatgagcccggatccggaacccgtcggcgtggaattcctcgccgaattgcccgaccacgtacgggcattcttcgacgagcagcacaagctgtactcgccgaagtgaacgcctgttcggttctgtaaccgccacgtgtcgatcatcgctatcgtgcggttcatcattgcgcatcgcgcgcaactcgcctcgcacccgggccgcaacagcctgacggtgctggatcagctcgcctgctgactcctctgtcgcgtcgctacgccgcgcgactgtcttcgtctatccttctggttttccacgtccggcccgcccggctctcccgatcgttccgatgaagcaagccattcgtgccagcgtcgctgtcgccgcgctcggcgtcgccctcttttcgtccccgcgcatcgccgttgcagacggcgacgacaccgcccttaccaacatcgtcgcactcgcgtcgcagcgactcgcgctcgctgagccggtggctcgatggaaatgggcgaatcacaaggcaatcgaggaccgcccgcgcgaagcggcgctgctcgaatcggtcgggaagcgcgcggcacaggccggcgtcgatcccgcgttcgcgcggacgttcttcgaggatcagatcgcagcgagcaaggatgtgcagaacgccctgttcgcaacctggcgtacgacgcggccgccggaaggcacgcctcccgatctcgcgaccagcacgcgcccggcgctcgaccggctgacgcagaaaatgctcacggggctcacgcaggttgcaccgctgcgcgatgcgcctgattgtcaggcgcggctcgcccgcagcatcgcgaactggaagacgctcacgcgctacgactccacgcagacgcaggcgctcgacaccgcgttgtcgcacgtttgctcggccggcggcgcaagcgcgatcggctgatacggcggtcgcgccgggtcaacccgcttggcccgcaggcgtgagtgcgtcgagcggaatcagttgcaggccgcgcgcgagatgcgtctgcagcaggcggtgggtgaagggttcgaatgcgccggctgccccgtcggccgcgagccgcgcggccgcgtcgagcgattccgcgacgccgagatagcgccagccatcgatcacatgaaacaggcggcgctcgccgcttgcctcgaacgcaacggcgccttcgaacggccagggtgcattgccggtacgggcggtgtcggccgcagggcgccggttgtacgacggacgcagcccggcgatccattgcgcttctgcgagcatcgccccagttcgttacccgtctcgcgccattcaacgcgccgtacctgctgcgcaagccgcatttccttcgacgaccgacgctctcccgtcaacaacgcgcgcagcctctgccgcacgcgtacgctgcggccgacgtacagtggcgcgtcgccctccccgaacagtgcgtacgccccgcacccggccggtgcggtatcgagccaggcttcggtcaggtcgccgcccagacggaagtggcgcgtcgtgcgcgcgatctggtcgcgcagccgctcgagcggcacgatgtcgtgcaactggcgccagaactgccacaggaggtcggcatccgccaatgcccggtggcgcgcagccggcacgaggccgtggcgctcgatcaacgcgtcgagcccgtgccgcgcttcacgcgggaacagcgcacgcgacagccgcaccgtacacagcacgtcgggattgaacgcgaacccggcgcgctcgaattcggcccgcaggaaaccgcggtcgaagctcgcgttgtgcgcgacgaaagcttgccgtcgagccgctcgaacaaggccggcgccagcgatgcgaacgaaggcgcgtcgcgcaccatctcgtccgaaatacccgtcagttgctggatgaacggcggaatcgactgccccggattgacgagcgtcgtccacgtcgacacgccgagcgggccgatttcgaccacgccgatttcggtgatgcggtgttcggcgggcgagccgccggtggtttcaaggtcgacgaaaacgagcgactgttcgctggccggatcggacggacggggaaatcggacatgaaaagactgggaaacgatgcttccgtgagtatgcaccggcatccctgttcgcggccagcccgaaccgtattgttccgtccccggaaaatgaaaagccccgccatgcgggggccggacgtgatcggcaatgcgtggcgcgtcagacggcctggatattcgctgcctgcttgcctttcggcccgactttcacgtcgaacgaaacacgctggttttccttcagcgtcttgaagccgtccatcttgatttcggaaaagtgcgcaaacaaatcttcaccaccattgtccgacgtaataaagccgaaacctttagcatcgttaaaccatttcacgataccggtatccatgtcttcgttccccactcgattagatcaaagaagctatttttatagccgtttcccgaaatcccgaaacatcgcgccagcaactgcaccagcaccagcaccagcacgccgcccgaggacggagtgctgactttataaattggacaatccgggtgcgtcaagaaaatttttgatgatcgttttatcaaaatagtgctaatggcattggaatcggtacaccatcgccttttattaattgattcgagtcaaaaacctgtcaacattaccggggtgggagttccgataatctcgaccacgaaatttctaccggggacaaatcgcctcggtaaaatcctcgggtttttccgggttgcagaaatgcggggacattgcgatgctcatccaatgcggaaggaaggagaaggtcatgtggctggacggaatcaagcgcttcgcgagccggcttgggcgcgtacgccgcaagtcccgcgccctggcagagtccgcgcgcgaagcgccgtgcgacaccgagttcgatacgacctggcacggcgatcactggcagaacctgcttgcatcgccctcgatgcccgtcactacgtgatggaagactggacatacacgccgcccccgaacgaagccaaggaggccgcgcctgcggccaagcgcaagcggcgctcgtacacgcagtagtgcgcagcggcgggcaaaaaaagcgcgactgggaagtcgcgccgacaaaggtttggagatcttttccgtcaacgaaaagtctgcttcggaaagcagagatcgcagtatagcgagagaacaacctttcattatccatgctccacacaaacctctattgccgatgtgtcaataatcgcgctatgaccgcggtcgcctgctggtgattacctgtcgcgatcgcgcaacgtccgttacgcagtcctgagcgccattttctttcgctgcatcgccgcaaacccttgctggacaaccgtttgcgctcccctagatctttgcggattccaaaatacattattgcttaaagcgcgccccatccccgctccacgcactccttacactgcagatggctttttgaaaagcgcaccgccgctctgccggaccggccgcagcgtcaagcacaacatgccagtccgcagcaggttcgatcgacatcatcctgtttggagacagatccatgaaaaactctgatcgtcaccgcgttgtcgggtgtattcgttacggcagcccatgcccagagcagcgtgacgctctatggcctgatcgacgccggcatcacctacacgaacaatcagcacggccacagcgcctggcaggaaacgagcggttcggtcaacggcagccgctggggcttgcgcggcaccgaagatctcggcggcggcatgaaagcgatcttcacgctggaaaatggtttcggcatcaataacggcgcgctgaagcagaacggccgcgaattcggccggcaagcgtttgtcggtctcgcacacaacagctacggctcgctgacgctgggccggcagtacgacagcgtcgtcgactatctcgggccgctgtcgctgaccggcacccagtacggcggcacgcagttcgctcacccgttcgacaacgacaacctgaacaactcgttccggatcaacaactcggtcaaatatcagagcgcgaactacggcggactcaagttcggtgcgttgtacgggttctcgaactcgacgtctttcgcgaacaaccgcgcctatagcggcggcgtgtcgtacagctacctgggcttcaacttcgccgcggcctacttgcagttgaacagcgatgtgaacgcgctcgcgcaggccgcgaccgacccgggcgcggtgaccggcgactggaccttcgcctcgcgcgtgcaacgcacctggggcgccggcctgaactacgggttcggcccggccacggtcggcttcgtgttcacgcagacgcgcctcaccggcatccgcgcaatcagcgcggggcagtccggcgtgtccggtggcatcacgggcctcggcggaaccgcgcgcttcagcaactacgaactcaacggccgctacgcgctgacgccggcgctgtcgcttgccggctcctacacgtacacgcagggccgcctggccggcgacaagccgacctggcaccagttcaacctgcaagccgactatgcgctgtcgaagcgcaccgacgtctacctgcagggcgagttccagaaggtcaacaacgacggcctcgacctcggcgccaacatcaacggtctgggcgccgcgtcatcgaccaacaagcagatcgcggtcacggccggcatgcgccatcgcttctgagcgaccggcacatccgctgcatgccggatgacgaagcgccccgtcggggcgctttttctttgccggactgcaccgggtatcgctcaggcgttgtcccgcggcgggtagcgaacgtcgagcacgtcgatcggctgcgggccggccggcgtcatcagcatgacggtatcgccgatcttcgccttgatcagcgcacgcgcaaccgggaaatccagctgacgcagccgcgatccagatcgacctcgtcgatcccgacgatcgtgatcgtatgatcctcgccgtccggcgtctcgtaatcgaccgttgcaccgaaaaacacctggtcgacattctcctgccggctcgcatcgacgacttcggcaagatcgagccgcttcgtcaggaagcggatgcggcgatcgatctcgcgaagccgtcgcttgccgtagatgtagtcgccgttttccgaccggtcgccgttcgatgcggcccaggacacgagccgcacgacctcgggacgctcgacgtcgatcaggttcagcagttcgtccctcagccgcttgtgaccggccggcgtgatgtagttcttcgcgcccgccgggatcgcgggctgggcctggtcgagatcgtcgtcgtcgccgtccgactctttgacaaacgccttgttcatgatgcagattcaacgtggatgactgatgctccaagggtacacgatgggggccccggcaaggccgcgtagaacaattcgcgaataaggcttccctttatacaaccctgctataatttcgcttctgcgtgcggctgtagctcagttggatagagtacttggctacgaaccaaggggtcgtgggttcgaatcctgccagccgcgccactttttcgagggccttccgaaccgaaggccctttcagttcgaagcagtagaagttttgttttgcgtgcggctgtagctcagttggatagagtacttggctacgaaccaaggggtcgtgggttcgaatcctgccagccgcgccactttttggggccttcccatcgcagaaggttccgacagtcaagcagtaccgttttgcgtgcggctgtagctcagttggatagagtacttggctacgaaccaaggggtcgtgggttcgaatcctgccagccgcgccaccttaaagggctttcctccgggaaagcccttttctttccgcctcccttcccttgctcacgacacggcccgcttacaggcgcccttgtccagccacgccgcacgttcgctcttcgtaccgcacaaatgaaaacggcggccatattggccgccgtcgatcaatcgcccgcttgtgctggcaagcgtcaataatcctgccgttcgcgctcgatccgcatgccgccgtcatggcgcgcatgcgcgccgtcgtcggtcgaacgctcgcgcatgatccgcatcacgtccggattggtccgcacgcgccgcatcacgttcgcgagatgcacgcggtcgctgacctggatcacgaagcgcagtaccgtcgattcgtgcgtcagatcctcgtccatcgcgatatgcacgatgttcgcgtcggccgacgtgatgtccgccgccacgcgcgcaaagatacccttggtgttcttcacgagcgccttcaccgcgacatcgaacaggcggcccggctgcggcgcccattcgacgtcgatccagcggcccggatcgcggcggtgaatccgctgcgccacgcggcaatcggtcgtatgaatcgccatccccaggccgatgccgatgtagcccatgatcgcgtcacccggaatcggccggcagcacgcggacaactgcacggacatcccttcggtaccggtaatcacgaccggaggcgcatggtgcgcgggatgccgctcggacttcggcagatcgtcgtccgcgtcgcggccgctcatcaacacctcgatgcgcttggccatcaccgcggcaacgcgacggccgaggccgatgtccgcgaagatttcctgacggctcttgttgcccgtccactgcacgagcttctcccacacctccggctcgacatcggccagcgcgagaccatagcctttcaggctctggtcgaccagccgctcgccaagctgcaccgactcgttcaggcgcatcgtcttcaggtagtgacggatcgccgaacgcgccttgccggtacgcacgaaaccgagccatgcggggttcggcttcgaatacggcgcggtgatcacctcgacgatgtcgccgctcttcagctcggtgcgcagcggcagcagttcgttgttgatcttcacggccacgcactggttgccgagatcgctgtggatcgaatacgcgaaatcgagcgccgtcgcgccgcgcggcagcgccatgatcttcgacttcggcgtgaacacgtagaccgcatcggggaacaggtcgatcttcacgtgctcgaggaattcgctcgaatcgccggcttcgctctggatgtcgagcaacgacttcagccactggtgggcgcgcttctgcacgtcactgagatcggcgctgccgttcttgtacagccaatgcgcggcgacgcccgcttcggcaatctcatgcatcttgcgcgtgcgcacctgaaactcgatcggtgcgccgaacggaccgacgagcgtcgtgtgcagcgactgatagccgttgatcttcgggatcgcgatgtagtccttgaacttgccgggcacgggcttgtacagcgcgtgcagcgcgccgatgcacgtgtagcagtcgagcgggctgtcgacgacgacgcgaaaaccgtacacgtcgagcacctgcgagaacgacagctgcttgtcgcgcatcttgcggtacacgctgtagatggtcttttcgcggccggtgatctcggcgtcgatcttcgcgtcggccatcgcgcgctgcgcggcctcgagaatcttgctgatcacttcgcggcggttgccgcgcgccgccttgacggccttctcgagcgtcgcgtagcgatgcgggttgaagttcgcgaagctcatgtcctgcagctcgcgatacgtgttgttcaacccgaggcggtgcgcgatcggcgcgtagatatcgagcgtctcgcgcgcgacgcggcggcgcttttccatcggcaccgcgccgagcgtgcgcatgttgtgcaggcggtcggcgagcttgacgagaatgacgcgcacgtcgcgtgccatcgcgagcagcatcttgcggaagttttccgcctgcgcttcctcgcggctgcggaactccatcttgtcgagcttcgacaggccgtcgaccagttcggcgaccttcgggccgaaccgttcggccagctcgctcttggtcacgccctggtcttccatcacgtcgtgcaggagcgcagccatgacggcctgcgcgtcgagcttccagccggcacagatttccgcgacggcgacgggatgggtgatgtagggttcgccgctctggcgatattgaccgaggtgggcttcgtcgctgaagtggaacgccgccttgacctctttgatttcttccggagcgagatactcggccagcacggccgtcagtttcgcgatcgaaacgacgccgtgcttgcgcggctgctccggtgtggcggtcggcccgaacagatgccggaaggactgttcgaggaccgcgtcgatgtactggcgcgcaggcgactgggccgtggcttcggtggtcgaatccgcggaggcggacgatggggtggtgctcatattcgcctccaggtcgagtcgttgcgcgcgtggattacatggctggaacgggccggatgcgcgttacaccggcaccttcttcagcatctcgacgccgacctggccggcagcgatttcgcgcagcgcgacgacggtcggcttgtcgcggctttcgatcttcggcgtatggccttgcgcgagctgccgcgcgcgataggtggcggcgagcgccagttcgaagcggttcgggatttgcttcaggcagtcttcgacggtaatgcgagccatgttggtaattccttctgaatatagtccttattctaccttatgtccctcgtccccgcgtcattccgcgtggggcagatggatgccgagctcgatgaacagctccgtgtgtcgcgcgtactgcgaagcaaagcgcaggcgcgtggccgcgacgatgcattcgagctccgcgagcgcacgctcgaaattctcgttgatcaccacgtattccgcttccgacgcgtgcgcgatctcgctgccggcggcgagcaggcggcgcgtgatcacgttcggttcgtcctggccgcgcttcttcaggcgctcctcgagcgcgtcgagcgacggcggcaggatgaagatgccgaccgcgttgcggaactgcttcttcacctgcagcgcgccctgccagtcgatctcgagcagcacgtcgtggccgttcttcatctgctcttcgatccagacgcgcgacgtgccgtagtagttgccgtgcacttccgcgctctcgaggaattcgtgcgccgcgtgacgcgcgcggaaatcctcgaccgtcgtgaagtgatagtgccggccgtcctgctcgcccgggcgcggcttgcgcgtcgtgtacgagatcgacaggcagatgtcgttgtccttcgacagcagcgcgttcacgagcgtcgacttgccggcgcccgacggcgcgacgaccatgaacaggttgccgggatagacgccgccgtgcagcgaatgcgacgcgtggacgtcgcgatgggaatcggtcatgacagcctccgccgggcagccccaggaggctggccgccctcgggggcagcgaacatagtgagcgtggggtcgtttcatctctgttactccaggttttgcacttgctcgcgcatctgctcgatcaacagcttgagcgccatcgatgcgtcggccagttcctttgccgccgccttcgagccgagcgtgtttgcttctcgattcagttcctgcatcatgaagtcgagacgcttgccgacgcggccgcccttctcgatcacatgacgcgtttcgttcaggtgcgcggtgagacgcgacagctcttccgcgatgtcgatccggatcccgtacatcgtcacttcctgacgaatgcgctccgcggcttcctcgcgcgagacgatcgtcgcgctgccttcgggcgccgcgatgccgagcgcttcctgcagccgttcgacgatcttctgctgatgcttcgcgatcagctccggcacgagcggcgtgatgcgcgcgacgatcgcttccatctcggtgacgttcgacagcagcatcgtcgccagttgcgcgccttcgcgcgaacgcacgacgacgagctcgccgatcgcttccttgccgcacgcgagcaccgcgtcgcggatcgcttccgccgacacgccgctttcggcgatcacgccgggccagcgcaggatttcgcccgcgcgcaggcggccgacgcccgggaacgtgtccagcaccgagcgctcgagctcggcgagctggccgagcgccgactggttcagcgcgccggcgccgatgctctgctcgccgcgctgcaggttgatgcggatgtcgaccttgccgcgcgacagcttgttcatcagcatttcgcgcagcgcgggttcgcacgcgcgcacgtcgtccggcatccggaaattcaggtcgaggaagcgcgagttcacggtgcgcagttcgaccgacacgctggtgccgccgttaccggtggccgtcgcgagttcgcgcgtcgcgctcgcgtagcccgtcatgctgtagatcatggttcgtctcgccgtctgggtgccctcgcgggcggggatatgtcgaggcgcccggcgcatcggaaagcgcggggcgggaagcgcgcattatcccatttttgggaaccaccccgccgggcaagcccgccgttcggcgctaaaatcggagtttcctctcgttccgcgattcccacatgacgtcctccgtttcccgcccgagcggccgccgcgccgacgaactgcgcaaggtcgccctcacgcgccactacacgaaacacgccgaaggctcggtgctggtcgaattcggcgacaccaaggtgctctgcaccgcgagcgtctccgaacgcgtgcccgatttcctgcgcgaccgcgggcaaggctggctgaccgccgaatacggcatgctgccgcgcgcgacgcacacgcgcagcgaccgcgaagccgcacgcggcaagcagaccggccgcacgcaggaaattcagcgcctgatcggccgcgcgctgcgcgccgtgttcgacctcgaggcgctcggcccgcgcacgatccacatcgactgcgacgtgatccaggccgacggcggcacgcgcacggcgagcatcaccggcgcgttcgtcgccgcacacgacgccgtgtcgacgctgatcgcggccggcaagctcacgcgctcgccgatcaccgaccacgtcgccgcgatctcggtcggcgtgtacgaaggcgcgcccgtgctcgacctcgattacgcggaagattcgcgctgcgacaccgacatgaacgtcgtgatgacgggcgccggcggcttcgtcgaagtccagggcacggccgaaggcgtgccgttctcgcgcgccgagatgaacgcgctgctcgacctcgcgcaaggcgggatcgccgaactcgtgcagcttcagaaagacgtgctgggcgcctgacatgccggacgaccacaccatcgcaccgctgtcgcgcatcgtcctcgcgtcgaacaacgccggcaagctgcgcgaattcaccgcactgttctcgaccgtcggcatcgagatcgtcccgcagggcgacctcgcggtgcccgaggcggaagagccgttcggcaccttcatcgagaacgcgctgacgaaggcgcgtcacgcgtcgcggctcaccgggctgccggcgatcgccgacgattcgggcctgtgcgtgcgcgtgctgcgcggcgcgccgggcgtctattcggcgcgttatgcgcagcgcgcgggccgcgacaagggcgatgcggcgaacaacgcgtatctcgtcgagcagctacgcggcgtcgacgaccggcgcgcatactactgctgcgtgctcgcgctcgtgcgccatgcggacgaccccgagccgctgttcgccgaagggcgctgggcgggcgagatcgtcgatacccgcgcggcgagcacggattcggctatgacccgtatttctatctgccttcgctcggcgcgacggccgccgaactcgaaccggccgtgaagaacacgcacagccaccgcgcgctggcgctgaaggcgctgctggcgcggctcgcggaggaagcatgagcatgcccgataccccttcgctgcgggaggttgcatgagccaggccgcggaaaccggcgcacgcgtcgtcgcgaccttcacgtcgcccggccaggtgcggctcacgtcgctgccgccgctcgcgctgtacgtgcatttcccgtggtgcgtgcgcaagtgcccgtactgcgatttcaactcgcacgagtggaaaggcgaacggtttccggaaaccgagtatctcgacgcgctgcgcgccgatctcgagcaggcgctgccgctcgtgtggggccggcaggtgcatacggtgttcatcggcggcggcacgccgagcctgctgtcggccgccggcctcgaccggatgctgtccgacgtgcgcgcgctgctgccgctcgacgccgatgccgagatcacgctcgaggcgaatccgggcacgttcgaggccgcgaagttcgcgcagttccgcgcgagcggcgtgaaccgcctgtcggtcggcatccagagcttcaacgaaacgcacctgaaggcgctcggccggattcacgacaccgcgcaggcgcgcgcggccgtcgagatcgccgcgaagaacttcgacaacttcaacctcgacctgatgttcgcgctgccgaaccagacgctcgacgaatgccgtaccgacatcgaaaccgcactgtcgtacgcaccgccgcatctgtcgctgtatcacctgacgctcgagccgaataccctgttcgcgaagtttccgccggtcgtccccgatgacgacgcgtcggccgacatgcaggaatggattcacgcacgtacggccgaggccggttacgggcgctacgaagtgtccgcgtatgcgaagccgaatcatcagtgcaagcacaacctgaactactggcgtttcggcgactatctcgggatcggtgcgggcgcgcacacgaagctgtcgttcccgaaccggatcctgcggcaggcacgctacaagcatccggcgaccttcatcgagcaggcgatggccggcacggccgtgcaggaagagcgtgaagtcggcgcgcgcgacctgccgttcgagttcatgctgaacacgctgcggctcgtcgagggcttcccgtgcacagcttcgccgagcgcaccggcctgccgatgagcacgatcgagccggcactgcaggaagcggaacggcgcggactgatcgcacgcgatttcgcgcagatcgcgccgacgccgctcggccagcgtttcctcaacgacctgcaggaattgttcctgcgcgacgattgagggcatgaagatcgcggcatttcggttacaatgccgcctcgtgtggaagcgtggccgagcggtttaaggcaccggtcttgaaaaccggcgacgggaaactgtccgtgagttcgaatctcaccgcttccgccaggaagtttgccaaaccccgtccattcagcgaatgacggggtttttgttggttcccgtacggctgtccccacgttccgacgcgtcccgccggatgccgttacaatccggcgctccgattcgcgaaacgggaaacccacgtcatgaagcccctcatcgtctcgtcgctcgtcgccttgctcgcggccgtcagcacgcacgcggcagccgacaccgcgtccggcagcgacgcgcaagcgtcgtgcgcgatcgcatacgtgtccggcgtcggcggctcgccgcgcggcctgagcgaatacctcgcgagcccgtcgccgtacaactacctgaaagacaacgacctccagtgcaaggtgggagacgacggacgcacgtcaaactgcaccggcgtgacctacctgcgcaacgaacaggtgagcgtgtacgacgattccgatccggcgacgctcaccgtcgtggcacgcgtggagctcgaccacggccagaaatacccggtgatcatcgtcgtgcagcgcaaggacgcccgctgcaaacaatgatgcagcgccgcgcacgaacccgttcgtcgaaacggcacgggcagcagcccgtcatcgcgccgctgcgcgccggaagcctcccggccagccgctcgatcacctagaattcgatcaacacggcgacacgaccgccgccgcgtactcgatgccgcgcgcgccacccctgcgtgcggtacacggagatcgccatgaccgaactgtcgataccgacggaacacgtcgattacgaaggcttcgaggtccatgtcgtgccggctgccgtgcccggcagcgacacgcgctatacctacaccggctacgtatgccatcccggcgcgaatcccgcgttacccggccacgcggtaccgttccatgcggacggcgaggaaagcttcgccagcctcgatgaagccgtccacgaagccgtgcatgtcggcaagagcatcatcgacggcacgcaccccgacctgtcggtcctgtcactcgtcacgcacggtttctgaaccgggcgacacgcgtcgctgacgattgcgcgggcatccgccgcggtgctgcccgcggcgacggatgcgcgctgccgaaccatctccaagcgcctgcgcgccggtcgcgttcctcgccttgctttcaaccgtgcaacacgcgcaccgggatgcggacgtgcggcagccgcgcgagcgtgccgtcacatgtcacgtcacatcgcgatacgcgggcgcacgctgcctcgccatcagcgatcgcgacacccggcatcgaccgttatgcgtttctcccgatgccggctcgcgcccgtgcgcctatcatttttatagtcacttctggctagcctcccatgcgccccctttcccgttcgcgcgtcgaccggctgcgtgcagttgcactggccgtcgtcgccatgctcgcggcgtgcacgatcacgccgcctccgtcgctgcactcgatcctgacgattccgtcgatcacacgcagtggcagcctcgaccaataccgcgtcgaagtcgcgcagcgtgtcgccgaacgcaatccgtccggcctgctgcacggcacgccgcaggccatgctccgttcgctcgtcgtcgtggccttcaccgtcgatggcagcggccggctcgtcaacgcgtccgtctatcgcagcaacggcgacagcgaagcggaagcgctcgcgctcgcgtcgctgcgccgctcggcgccgctgccgccgccaccgtcgcggctgctcgacggcaacggccggctcgaaatgatggaaggctggctcttcaacgacgacggccacttccagttgcaaagcaccgcgtcggcgcaggcgcaatcgatcgactgaccggccgccgcaccgcgattgccggtgcgcggcagcgctggctataattttccgcaatcgcgcggccatcacgccgcgcgcgcgttcgtgcgccccacccggcatgcgagccgaccacgccggcaccgggcggcggcgacgtacccgtctccatcgtcgaccggcgggtgacgtccgcgccatggcgcgcgtccacgccgctaccgcatcatccgctcggctgctccccggcaggcgtccgcctgtccgaccgcacgcccagccgaccgccctaacgacaaaacggagacatccatgtccgcatcccccgaccgttgcacacgcaaccggttcggccggcgccgtcagccaccggcgcatcgtgttcgcgagcttcatcggcaccgcgatcgagttctacgatttctatgtgtacgcaacggctgccgcgctcgtcatcggccccgtattctttccacacggctccgcgaccgcacaggcgctgtccgcgttcgtcacgttcggcatcgcattcatcgcgcgcccgatcggctcgttcctgttcgggcacttcggcgatcgcatcgggcgcaaatcgacgctcgtcgcgtcgctgctcgtgatgggcgtatccaccaccgcaatcggcttcgtgcccggctacgacgcgatcggcacgctcgcgccggtgctgctgtgcgtgctgcgcttcggccagggatcggcctcggcggcgaatggggcggcgccgcgctgctcgcgaccgagcatgcgccgcagggcaagcgcggctggttcggcatgttcccgcagctcgggccctcggtcggcttcctgatgtcgaacggcctgttcttcgcgctcgcgttgtcgctgtcggacgagcagttccgcagctggggctggcgcatcccgttcctggtcagcgcggtgctcgtcgcgctcggcctgtacgtgcgactcaagatcaccgaaacgcccgcgttccaggccgcgctcgatcgcaacgagcgcgtacgcgtgccggtcgcgaccctcgtcacgcaacactggcagccgacgctgctcggcgcgctcgcgatggtcgtctgctacacgctgttctatatctcgacggtgttttcgctgtcgtacggcgtgtcggcgctgcatattccgcgccagagcttcctcggcctgctgtgtttcgcggtcgtgttcatgggactcgcgacgccgctgtccgcgtgggcatccgatcgcttcggccgcaaaccggtgctggtcgtgggcgcgatcgccgcgctgctgtcgggtttcgcgatggaaccgctgctcggcagcggctcgatgccgctcgtcgcgctgttcctgacgatcgagctgttcctgatgggcgtgacgttcgcgccgatgggcgcgctgctgccggaactgttcccgaccaacgtccgctatacgggtgcgggggtcgcgtacaacctcggcgggatcctcggcgcgtcgatcgcgccgtacatcgcgcaactgctggcggcgcgcggcgggctgtcgtgggtcggcgggtatgtatcggttgcggcggccatcagcctgatcggcgtgctgctgatgcgcgaaacgcgcgacgcgtcgctcgtctgagtcttcggggcgacccgggttgcgcggtggccagcgctgcctatactcgatcccggtgcgccgccgcgcgcccgggatcccgccccgaaggagccgccgccatgaacatccgcctcggcaatgccgatctcgtcctgatcctcgcgcttgcgctcggtggcgcgcttctgctcgcgctgcgcttccggccgaagacgtggcgcggcctcgtgttcgaggcgctgctggcgaacctggcggcgatcgctgccgtcgtcacggtcgaggcgctgctcgcctgaaccggcccgccccgcttcgtcaggcggtcagtcgcgcgcgccgcgcaccgtaggccgggcagaccgtatcgatcgcgtccagcgcctcctcgaccgacggcatcgcgcccggctcgccgatggacagggcattcggcgcgccgccgatcccgcaatggtgccgcgacgtcgcgacgaaaatcatcacggtcggccgctgcaacgcgtgcgccatgtgcacgaaccccgtatcgaccccaccacgagcgcagcccggccaagcgccgcaccgagttcgcgcaccgtcatcgcgggcagcacgaccgcccccggcgcgcgcgcggcgatgtcctgcgcgtcatcgtgctcggcagccgatccccacggcaacagcacgcgcacgccgcgcgccatcatctgcgtggcgagcgcggcccagtggtcggccggccatttcttgtcggggttggacgtcgcatggaacaacagcatgaacggtgcgccgtcggtcacggccgtcggcaggttcgcgtcctgcggcgggacgatgccgtacgtggcgacaccctcgggcgcgtaaccgagcgcctcgcccgcgctcacgcgcatcccgtgccacgcgtcgcagtccggccgcgggccgaagcggtgcgaatacgcgaagcgtgcgcccgtttcgccgagatcctgcgtctggtagccgacgcggcgcgcggcgcgcgccagcagcgaaatgatcgcgctcttgtagacgccgtgcaggtcgatcaccgcatcgtagcggtgcgcccgcagcgcgctgatcgacgccgagatcgccttcaggtcgccgcgattgcgcatcttcttgaaacggcgcagcggcgcgcaaaggacatggctgacgcccggatgccagcgcacgacctccgcgcacgattcgtccaccgcccagtcgaccgttacgccgggaaaggcgcgatgcagatccgcgacgacaggcagcgtctggacgacgtcgccgagcgacgtcactttcacgatgaggatgcgtttcacgtttgcggggaagagcgagccatttgggatgctaacgacggatacccgccgcgaacattactcctgaattacatttgcaacgaaatgctacaagcttgcgaaaccctgtcgcccactgtgcgaccccggttccttttataatgtctcctttgcctgatggccccgccgatgccacgccccgctcttgccgcccttcccgccctgtttcccgccctcacccgacgctcgctgagaatctggcgccagtacggcgttttctggctcggcgcgatcgtcgtcggcctcgcggccgtgctctacgcgcgactgatcgactggggctacgaaagcttccgcacgatgcgcgatcacgccgcgtggctgccgctgctgctgacgccggcaatcgccgcgatgtcggtatggatcacgcgccgcttcttccgcggcgccgagggcagcggcatcccgcaggtgatcgcgacgctgcatgcgcgcccgagcgcgttcggctcccggctgctgacgctgcgcatcctgttcggcaaggtgctggtgtcgttcctcggcatcctgggcggcttcacgatcggccgcgaagggccgaccgtgcaggtcggcgcggcgctgatgttcaacctgcggcgcttctacccgcgctcgaacgcgcagatcgaacgccagctggtgctcgccggcgcggcggccgggctgtcggccgcgttcaatacgccgctcgccgggatcgtgttcgcgatcgaggagctgacgcgcagcttctccgcgcgcgccagcggcgtgctgatcaccgcgatcatactcgccggcgtcgtcgcgctcggcctgaacggcaactacacgtatttcggtacgatcgatgccggccccatttcccgaaactgctggcgctcgccgtgctggtcaccgcgatcgtgacgggaatcgcgggcgggctgttctgctggctgctgctcaacacgggacgctggctgcccgcgcggctgctgggcctgtatcgcgagcggccgatcgcgttcgccgcgctgtgcggcttcgcaatcgccgtcgtcggcctcgtatcgggcggcacgaccttcggcagcggctatgccgaagcacgcggcctgctcgacggcagccagcatctgtcggtgttctacccgttcctgaaaatggtgtcgatggtcgcctcgtacctgccgggcatccccggcgggatcttcgccccgtcgctgtcgatcggcgcagggttcggcaacctgctgcacgtcgtgttcagcaacatgagcctgccgatgctgatcgcgctcgcgatggtgggctacatggcggccgtcacgcagtcgccgatcacgtcgttcgtgatcgtgatggagatgatcaacggtcacgcactcgtgatttcgctgatggccaccgcgttggtgtcgagccgcgtatcgcgcttcttcgcgccgccgctctacgaaacgctcgcgctgcgctatctcgcgccgcccgtcgcggccgcggaaccggccgcggcagccgcggcgagcacgacggtggcaacgggcatcaccgagccgcaggatgcggccgccgcgcccgccgacccgctcgacacgctgcgcgacgaaggtggtgaagtaccgcccgccgccgcaccgaccgaaggcgccgccgatgcgccggcgccgcacgacgacgagccggccgcggccgggaccaacggcgcggcgcaacccggcccgcgcgacgctcagtagatcacgacgggtgccggccggtagtacacgggccgcgccggcacgacgatgcacccggccagcgtgatcgcgacgagcacgatggcgattgcggttcttttcatcgcccgcccccatcatgcccagtggccacgggtccagaaccagttcggtccgcgctggtcccaatggcccggcacccattgcatgccgacgcgctcggcctcccagtggccgccgatccacacgtagcggccatgctcccagtgccagtgcccgcgatcccacacatagcccacgcgcgcggacggcacgacctcgtagcgcaccggcggcggcgcattcggcgcgacgatgacgacttcctcggtgcgcacggcgaccggctcggcgacgaccacgcggccctgcggcgcgatcacgggcgtgccgacgagaatctcgtccgcatgcgcggcgagcggcgcgacgacggctgacaggctcgcggcaagcagggcgagcgaaacgatacgacgttgaacagtagagacagccatcacaacctccaggttgaacaagttacgcgagcgtattcgttcaatgcgggaggaccgataacggccgacagacgccgtgttacggcgtgcccgaaagtgcaacagggcgtaagacgcgcacggcggcgagtgccgccgtgcggagggacgcggatagaactcaggcctgcgggatctcgatcttcacttcgaggacttcgagatcgtcctggcgctcgaggctcacgcggatgtcatcgttcgaaatatggacgtacttcgagatgaccgcgaccagctccttctgcagcgccggcaggtaatccgccggcgggcggccgccgacgcgctcgtgcgcgatgatgagctgcaggcgctccttcgcgaccgatgcggacttcttcttctcaccgaggagaaacgaaaggatggacattggcggcctccgttacttgctgccgaagaggcgctgcagcaggcccggcttctggtaatcggtgaagcgcagcggcttgtcttcaccgaggaagcgcgcgacgacgtccttgtacgcttccgccacgtcggtgccgtcgatatgcacggccggcaagccctggttcgacgcatgcaggacggcttccgactcgggcaccacgccgatcagcttgatgcgcaggatctcgctgatgtcctcgagcgacagcatctcgccttcgctgacgcgcttcgggctgtagcgcgtgatcagcaggtgttccttgatcggatccttgccttcggtcgcacgcttcgtcttcgacgacaggatgccgagaatgcggtcggagtcgcgcaccgacgacacttccgggttcgtgacgatcagcgcttcatccgcgaagtacatcgcgtgcagcgcgcccgcctcgatgccggccggcgaatcgcagacgatgtattcgaagtccatcgcggtgaggtcgttcagcaccttctcgacgccttcgcgcgtgagcgcatccttgtcgcgcgtctgcgacgccggcaggatgaacaggttctcgcacttcttgtccttgatcagcgcctggttcaggttcgcttcgccctggatcacgttcacgaggtcgtacaccacacggcgctcgcagcccatgatgagatcgaggttgcgcaggccgacgtcgaagtcgatcacggccgtcttgtggccgcgcagcgcgagaccggacgcaaagctcgcgctcgtcgtcgtcttgcccacgccgcccttgcccgaggtcaccacgatgatttttgccatttacccaataccctgtgttcgtcaatgagagccgatcgatccggagcgcaccgcgtgtattacgtcaggcgcagcggttcaatcatcagttttcctcttcgagccggatctgcaccgctttccccagtacatcggcgggcaacgggttctcggttgttcgatagatacccgcgatcgaaatcagttccggctcgagacacgtgcagaaaatgcgcgcgtcgtgattgccgtgcacgcccgcgagagcgcggccgcgcaacggcgcgtagatgtggatattgccttccgcgatgatctccgcgccgtgactgaccggcgcgagcaccacgaggtctcctttcgcgtaaatctgctgccccgaacgcaacggccggtcgatcacgagcgtctggccgcccggctggttcgacaccggcaccgattcggacgcctgctcgggcgccgccgcggctgctgcagcgacgacggcctcggcgaccggcgacgcctccgcgccctcggccggtttcgcggccggcgcgcggcgatcgcgcgcctcgagcaacggcaggccggcttccccgcccagccctgcgtggccagcgcgacgacacccaccgggcgcatccgcacgtcgttcagcatctggcggatgtccgccagcgcgacgcgttcgccgtccgccaggcggcggacgtcgatcgcgacgacatcgtcggcgaaaaactcgggagtcgcttcgaagcgcttgaccagttcggtacgcaacgcatcgagatcggtcgtcttcacggtgaacagcaacgtatcgaccgatccgctgcgcagctcgaagaatggcgatttttaagcgacatggacactctgcaaaaatttttgcgtattttacaggcgtccacgcgcgcggccattatttttgggaaccgggttgcagcggcccgggcgggcgcgcaaccggaaagcgggctggcaagcgggcgaccggaccttcatcgcgccgcgcggccgcgttctgacgtcgcgtcagtgcttcacctgcgacacgtacagcgatttcatcgcgccgggcatccgcgcgatcggcgcgtgttcgccggtgttgccgaaacccgcgcgctcgtagaagcggatcgcgttgcggttcgcatcggcaatccacgcgtagacgtcctgggcgccgcgctcggcgagccaggcggtggccgtctccagcagcagcacgccgccgcgcagatggcgcaccgcgtgcgcgacccacagctcgctgacgaacgcacgccgatcgggcgtattgtcgaaatacgcgccgatcatgccggccggatggccttcggtatacagcaggaaagtcgtcgactcgtcggacacggcgcgctgcgcggcaatcgccgacgctgcgtccgtttcgacgttcagcaattcggcctccggcgcttcgccgggcgcgtaggctcgcgcagcgatgcagcgcggagttcgcgatacacgccgccttggtcggcaacgatacgacgaacggtcaaggtcgaactcatgcaggcacagccccttcggacagcaagctactagcttcaaccgaaagcggggcatgagtcaaatcgtaattttcaaatggcagcgcgaatcgaaaggcggcaggcactgcgggcggccatgcggccagcccgtgtgcaggtgcagcatcggcacatcgacgcggcaaccggatgaccaccgtgacggcttcattcgacgcttggcagcagtcgccttgcggcaacaggcagtcgcaggtcgggccccgtgaatttcatcatgaagggcgtaatgattcgtaatattggtaacgccgaagcaagcgacatgggtcgccatcccgctccgtatattgcgacgcaacatttgttgcgaacctgcagcgtcggcgccaatcctcgtcacggcacgccatccgtctgacaaacctgccgcccgcgcgggccgatccggtcattcccgcatgtttcaatcggcgtgcgcgggcccttcctgcctgcgccgcacgcgcgccgccgtttggagccgcacgcctagtgccggagtttggcaagcgtgcacatgggtcgtataacaggcagaaccggacgacgatccggttcaaccgcgcgtgcgtcgcgggtcaacgagaattcgaacaaccgtacaggcggccgccttcgggccggccggcaggagggagacaatggcaatgaccgacggatcggcttcgggctggtcggatggcaagcgttacctgtggctgctcggcgcgctgacgatcacgctgccgattctcgccgcccagctcgcgctgtcgacgggcctgcacgtgttctggtggttcggcccctgttcgcgttcggcgtgatcccgatcctcgacacgctgatcggcgacgatcgcgacaatccgcccgaggccgtggtgccgcacctcgaacgggagcgctactaccggctgatcgtctatctcgcgaccctcgtcgaatacgtcgcgttcttcgcatgcgtatggatcgtcggcacgcacgcgctcgcctggtacgactacgtcggcttcgcgctgtcgctcggcgccgcgacgggcatctcgatcaacaccgcgcatgaactcgggcacaagaccgaccgcttcgagcgctggctcgcgaagatcacgctcgcgccggtcgcatacggccatttctacgtcgagcacaatcgcggtcaccatgtacgtgtcgcgacggccgaggatccggcgagcgcgcgctacggcgaatcgttctgggccttcctgccgcgcaccgtgaccggcagcatccgctccgcgtggcggctcgagaacgcccgcctcgaacggctcgggcattcgccgtggacctggcgcaacgaggtgctgcacgcatgggcgatgaccgtcgtcgtgtggggcatcgcgatcgcgctggccggcaaggtcgtgatcccgttcctcgtgatccaggccgtctacggcgcgtcgctgctcgaagtcgtgaactacgtcgagcactacgggctcggccgccgcaagctgccgaacggtcgctacgaacgctgcacgccgcagcattcgtggaacagcaatcacgtcgtcaccaacctgttcctgtaccagttgcagcggcacgccgaccatcacgcgaatccgacgcgctcgtatcaggcgctgcgccacttcgacgattcgccgcaactgccggccggctacgcgacaatgatcctgttcgcgtacgtgccgccgctctggtatcgcgtgatgaacccgcgggtggtcgcgcactacggcggcaacatggcgcaatcgaacatcaagccgtcgatccgcacccgggtgctcgcgcaatatccggccacagcttgactctgctcctgcgacgcggacgagatctcgccgatgatcgtcgtgacgcgctgcaccgcatcgacgatctcgtgaatcgactcgcccgcgcggccgatcagcacggcgccttcgtcaacacgctgcgtcgactgctcgatgagccccttgatctccttcgcggcggcgacacgcgtccccgcgatccggacaggctgaactgccgacgctgcccactgcgcagcaagacgtatggaacacagtcgctatcgcatcggcacattccgatgcatcgatggtcgatgctgttgccaccgcaacgccttgcgacacacgatttagcaagcccaaaacgaaaaaccccttgatccttccggatcaaggggcttcgtattttggcggagagggtgggattcgaacccacggtacgggaaaccgtacgcctgatttcgagtcaggtacattcgaccactctgccacctctccttccttgctgctttactgcatttcgcgtttggtcgtttccgcgaaagaaaagattatagaacgatctcttcgaatctcacaagccctttttgcaaatttttttgcgagggcttgaagcgatcgccggcgcgcgaccttacgacgcctgtgccggcgcgtcgatacgctcgatgccgcccatgtacggacgcagcacttccggcaccgtgaccgaaccgtccgcgttctggtagttctccagcaccgcgacgagcgtgcggccgaccgcaaggcccgaaccgttcagcgtatgcacgagttccggcttgccctgtgcgttgcggaaacgcgcttgcatccggcgcgcctggaacgcctcggtgttcgagcaactcgagatctcgcgataggtgttctgcgcaggcagccacacttcgaggtcgaacgtcttcgcggccgagaagcccatgtcgcccgtgcacagcgtgatcacgcggtacggcaggccgagcttctgcaggatcgcttccgcatggccgaccatctcgtcgagcgccgcgtacgacgcatccggcgcgacgacctgcaccatctcgaccttgtcgaactggtgctggcggatcatcccgcgcgtgtcgcggccatacgaaccggcttccgagcggaagcacggcgaatgcgcggtcagcttgatcggcagcgcggagccttcgacgatcgactcgcgcacggtgttcgtcagcgagatttccgacgtggagatcaggtattgcgtgaccttgttctcctcgccgcccttctcgacgcggaacatgtcgtccgcgaacttcggcaactggcccgtaccgtacaggatctcggggttcacgatgtacggcgatacgcttcggtgtagccgtgctgctgcgtatgcgtgtcgatcatgaactgcgcgagcgcgcggtgcaggcgcgcgatcgagccgcgcagcatcgtgaagcgcgcgccggcaagctttgcgccggtctcgaaatcgaggccgagcggcgtgccgacgtcgacgtgatccttcacctcgaagtcgaactggcgcggcgtgccccagcggcgcacctcgacgttgtcggcttcgtccttgccgaccggcacgctttcatgcgcgacgttcggcataccgagcatcaggtcggacaggcgcgcctggatgtcgccgagcttggcttccccgccttcatttcgtcgccgatcccgccgacctcggccatcacggccgacgtgtcctcgcccttgcccttcatcgcaccgatctgcttcgacaggctgttgcggcgcgcctggagctcttcggtacgggtctggatcgcgcggcgttccgcttcgagggcggagaacgcggcgatgtcgagggtgtagccgcgatcggcgaggcgcttcgcgacgccgtcgaggtctttgcgcagcaactggatgtcgagcatgggaggacttggagaatcgttgtgtaagacgggaattctaacgcaccgcagggccgccaaggcactggacggacggactatgctgcaaacgggcgatgaccgtggcgcgatggccatggcagtatcgcgttgccggcccgcccgtcggcacccgcgaaatcgcgcggcatcgaagcgccgcggatcgcgaaacgcccgcgcgggcccgcggcggcgcatcgagcaaggcgcccgccccacgtcacagcaccccaaggaacccgatggccatcgaactggacaaggaaatacgcgatcgcgcgatcgcgtcactgcaacgctatttcacagaaaacatggatgagccgatcggcaatatccaggccggcgcgctgctgcatttcttcgtcgaggagatcggcccggtgatctacaacctcgcgatcgccgacgcgcagtcgagcctgcacacgcgcatcgccgaactcgacatcgaatgccatcaggagccgttcgactactggaagaagcagccggcacgcaagcgctgacgcgagccacgagcatgccggccgctccgggccgcgccgtcagtccttcttgccggcttcgcgatcgagttcgcgcagccacgcaagcttgtcggcgatcttcgattcgagcccgcgcggcacgggcttgtaccagcgcggttcgcgcatcccgtccggcaggtacgtctcgccggccgcatacgcattcggctcgtcgtgcgcgtagcgataggcgtgaccgtagccgagttccttcatcagcttggtcggcgcgttgcgcaggtgcacgggcacctcgcgcgacttgtcctgcttcacgaacgccatcgcctgattgaacgcgttgtagcccgcgttgctcttcgccgcgcacgcgagatagatcaccgcctgcccgagcgcgagctcgccttccggcgagccgagccgctcgtaggtttcggccgcgtcgttcgccacctgcagcgcgcgcggatcggccaggccgatgtcttcccacgccatccgcacgatccgccgcgcgaggtacttcggatccgcgccgccgtcgatcatccggcagaaccagtacagcgcgccgtccgggctcgaaccgcgcaccgacttgtgcagcgccgagatctggtcgtagaagttgtcgccgcccttgtcgaaacgccgcgcgttcagcgtcatcgcgctgctgacgaaatcggcgtcgatcgtcgcgacgccggccgacgtggccgccgtctgcgcctgctcgagcaggttcaggaaacgccgcgcgtcgccgtccgcatagccgaccagcatatcgatcgccttgtcgtcgaacgcgaggccgtcgagcgcgatttcctgtgcgcgcttcagcaactggcgcatctcgtcgtcgtccagcgacttcagcacgtacacctgcgcacgcgacagcaacgccgaattgacctcgaagctcgggttctcggtcgtggcaccaatgaaggtcacgagccccgactcgacgaacggcagcaacgcgtcctgctgccccttgttgaagcggtggatctcgtcgacgaacaggatcgtgtggcggccggtgcggttcagcgtgtccttcgcctgctccatcgactcgcggatgtccttcacgccgccgagcaccgcggacagcgcgatgaattcgcagtcgaacgcgagcgcggtgagccgcgcgagcgtcgtcttgccgacgccgggcggcccccacaggatcatcgaatgcggcttgcccgattcgaacgcgagccgcagcggcttgccttcgcccagcaaatgcgtctggccgatcacctcggcgagcgtcttcggccgcagcgcctcggcgagcggccggcgcggctcgacttgaaacagatcggacatgaaccctcgctccacatcaaacagtcgcggccgaaccggccgccggacccgacattatgacagccgcgcgacggcaccgccgtgcctgctgcccgcgcccagtgcccgcgcccggtgcccgcgcccgaaaacaacacgggcctgccgtcgccggcaggcccgttgcgaacaaacggcgtgcggcgccgtcagccggtaatcacgtcggcgcccttcggcacgacgaacttgaacgtatcgcccttcagcggcggattcgtctggatgttcgtaaacgtcagcagcgtgacgttgccgaacacgtcgtgcagctccatcgcggcgagcgtgccgttgcgaaagccgatgccgatccgctggaactgcgtgtcctgcgccttcggcagcatctcgagccactcgatgccgcccttctcgccggcatcgcgcagcgtgtagttcttgtcgagatcgttgctgccgaacaggatcgcggccgggctcgcgcccagcgcgccgttcagcttgcgctcggtcacctggttcaggtcgcggtcatacacgtagagcttctcgccgtcggcctgcagcacctgctggtaaggcttctggtacgtccagatgaacttgcccgggcgcgcgaacacgaacgtgccgctcgaattgtcggtgggcttcggcacggcctgcgcggcgctcgcgcccttcgccggcgccttgacgatctgctgcgtgaagtcgcccttcgccgaacgcacctgcgacacgaacgccttcagttgctcggtgccgcccgcgaacgcgtgcgtcgccgcgagcatcagcgatgcgccggcgagcgccgcgccgagccagcgccgcgtcgaacgaagggacattgcgaacgaatgttgctgcatattgcggttttctcctgggtggccggcgccgcgaacgccgcggactcattccgcgtcgcgcgccggcacaagaatttcgcggttgccgctcgacgacatcgccgacacgagccccgactgctccatctgctcaagcagccgcgccgcgcggttatagccgatccgcaggtgccgctgcacgagcgagatcgacgcgcggcggttcttgatgacgatctcgaccgcctggtcgtacagcggatcagactcgccgccgccttcgccggttcccgcgccggccgagccctcgtcgccgtcggcggtgccgccttcgagcaggccctcgacgtagttcggctcgccctgctccttgagcttctcgacgacgcggtgcacttcgtcgtcggcgacgaacgcgccgtgcacgcgcaccggcagcccgctgcccggcggcaggtacagcatgtcgcccatcccgagcagcgattcggcgcccatctggtcgagaatcgtgcgcgagtcgatcttcgacgacacctggaatgcgatccgggtcggcacgttcgccttgatgaggcccgtgatcacgtcgaccgacggacgctgcgtcgcgaggatcaggtggatgccggccgcgcgcgccttctgcgcgatccgtgcaatcagttcctcgaccttcttgccgacgaccatcatcaggtcggccagctcgtcgatcaccacgacgatgttcggcaggcggccgagcggctcgggatcttccggcgtcaggctgaacggattcggcagcttctcctcgcgcttcgcggcctcgtcgatcttgttgttgtagcccgcgaggttgcgcacgccgagcttgctcatcagcttgtagcggcgctccatctccgcgaccgtccagttcagcgcgtggccggcctggcgcatgtcggtgacgaccgggcacagcaggtgcggaatgccttcgtagacgctcatttcgagcatcttcggatcgatcaggatcaggcgcacctgctcggcggtcgctttatacagcagcgacaggatcatcgcgttgatcccgaccgacttgcccgagccggtcgtaccggcgaccagcagatgcggcatcttcgcgagatccgcgcacaccggcttgccgccgatgtccttgccgaggctgagcgtgagcgccgacgatgcggccgcgtacacctcggaaccgatgatctcggacaggtgcaccgtctggcggcgctggttcggcagctcgagcgccatgtagttcttgccgggaatcgtctcgacgacgcggatcgacacgagcgacagcgagcgcgcgagatccttcgcgaggttgacgatctggctgcccttcacgccggtggccggctcgatctcgtagcgcgtgacaaccgggcccggatacgcggccacgacgctcgcctcgacgccgaaatccttcagcttcttctcgatcaggcgcgacgtgaattcgagggtatcggccgaaatcgcctcctgcgccttcggcgcggggtcgagcagcgacaccggcggcagcgtcgaatcgcccggcaggtcggtgaagagcggcacctggcgctcgcgctcgacgcgctcggacttcgccggcgtgacgaccggcggcacgatcgtcacgggctcgtgatcctcgatgcgcacgcgttcctcttcgaccttgccttcgcggcgcacggccgcggcctcgccgagcttgcggtcgcgctcggcctcgcggcgcagcttcgcgacattgacggcggacaggatcgcgccgccgacgcactcggcgaccgacagccacgagaagcggaaatacagcgacaggccgatcgcgagcaggatcagcagcagcagcgtgccgccggtgaagccgaacgcgtgcgacatcgcgcccgccacggcctcgccgatcacgccgcccggcgcgcgcggcaactgcaccttcagcgaccacatgcgcagcgcctcgatgccgtcgcacgccagcacgacgagcacgaacgcgaagatttcggtgagccagccgatcggccgctcgggttcgtccacgaccgcctcgtgacgcgtgatgcggcggtagttgacggcgatgcgccgcgcgagcggcacgatcagccagtaggccgacaggccgaacagcagcaggatgatgtcggccgtccaggcgccgacgcggccggcccagttcgagatgtggtccacctgggcggcgtgcgtccagctcggatcgcgccggctgtagctcagcagggccatcaccagaaatgcgcagagcgcgacctggagaatccagcggatctccgtgaggagcttcgacatccggtgcggcaacgcctgtgcctgggcggaataaggagcttttgccatgaatccgtataaagaggacgggctgcgcgcccgcctgtcgttcgatcccgcatattgtaagcgctgcaccgggccgccaagtgtaaatgacggttacataacagggccggggtacggccggcgcggcgcatgctctccgcggcggccctttccgccctttcactccggtgcgcggtccggccggccgcccgcagccgcgccgccccgggcgggtgcctcgccccgcccgccccgcatgcgcgaccgttgcgccgcgagacactatcgccgcgattgaaactctcgttcggcaacgcagcaacggggcctttataatgcgcgtctgatacccatctatgacggcatcccggtcaaccggatcgtacggcgagccctaccccgcccgccgcagccgacttttacggattcgcacatgtccacgcccaaacacgccaaagtcctgattctcggttccggccccgccggctacacggctgccgtctacgcggcacgtgccaacctgtccccggtgctgatcaccggcatcgcgcagggcggccagctgatgaccacgaccgacgtcgaaaactggccggcagacgcgaaaggcgtgcagggtccggagctgatggcgcgcttcctcgagcacgccgagcgcttcaacaccgaaatcgtgttcgaccacatccacaccgcgaagctgcacgagcagccgatccgcctgatcggcgactcgggcgaatacacgtgcgactcgctgatcatcgcgaccggcgcgtccgcgcagtatctcggcctgccgtccgaagaacacttcatgggcaagggcgtgtcggcctgcgcgacctgcgacggcttcttctatcgcggccaggaagtcgcggtgatcggcggcggcaacacggccgtcgaggaagcgctctacctgacgggcatcgcgaagaaggtcacggtgatccaccgccgcgacaagttccgcgcggagccgatcctgatcgaccgcctgctggaaaaggaaaaggaaggcgccgtcgtgatcaagtgggatcacgtgctcgacgaagtgacgggcgaggattcgggcgtcacgggcctgcgcatcaagaacgtgaagaccggtgcgacggaagacctcagcgtgcagggcgtgttcgtcgcgatcggccacaagccgaacaccgacctgttccagggccagctcgagatgaaggacggctacatcctgacgaagagcggcctgcacggcaacgcgacgtcgacgagcgtgccgggcgtgttcgccgccggcgacgtgcaggacaacgtgtaccgccaggcaatcaccagcgcgggcacgggctgcatggccgcgctcgacgcgcagcgctacctcgaaagcctgcacgacaagaagtaagccgcgagaccgctcgcgccgggcgctacaatggcgtccgctgccgcgaagcgggctcgaccggaaagccgctgccgccgtgcagcggctttttgcccgcgcgcccgaacgcgcctgccctgtgtaccgaatcatggcgaagaaccagccccatccgagcgatcccgcgaagcggcagatcgccgcccgtcccgcgaaccccgcgcccgtcgcgccggcgcccgcgcccgatcccgccgcattgcgcggccaggggctcgcgggcctcggcgcgttgcgcaagtcgctgcaaggcgaagccgatcgccgcgaacgccaacgcgtcgaaacggccaaggccgagcgcaaggcggaagccgacgcgaacctgttccgcaacgagatcggcgcgatccagccgctcaatgccccgccgcgcgcggcagccggccgcacgccgcccgacccggtgccgaagcagacgcagcgcgacgaggaagccgtgctgaacgcgacgctgtccgacgaattcgatcccgagacgctgctcgacagcgacgactcgctgtattaccaccgccccggcatcagccgcgacgtcgtgcgcaagctgaggagcggcgcgtggatcgtgcaggcgcagatcgacctgcacgggatgcggcgcgacgaggcgcgcgacgcgctcgccgagttcatccgcgaagccggcaagaaagggctgcgctgcctgcgcgtgatccacggcaaggggctcggctcgatcggcaaggaacccgtgctgaaaggcaaggtgcgcgcgtggctcgtgcagaaggaagaagtgatcgcgttctgcgaggcgcgcggccacgacggcggcgcgggcgcggtgctggtcctgctgcagccgttcgcggcacccgccgaccggggccgcgtgccgcatcctaggctgacgctcgcgatcgcggtactggaggcgatcgccacgctggcctttgcgatctcgggcttcatcgaggcgcgcaagaaccgtctcgactcggtcggcacgttcgtcgtggcgctcgccaccgcgttcggcggcggcacgctgcgcgacatcctgctcgagcgccgcccgttctactgggtcgtgcacgacgactacgtgatcgcgatcttcgtgctcgcgctgttcgcgccgttcgtgctgcgcatgctgtcgcggctgtcggccgagcggctgctgctcgtcgccgatgcgatcgggctcgggatcttcagcatctcgggcacggcgatcgcgctcgatgccgagatgccgcgcttcatcgcggtgatgatgggcgtgattaccggcgtggtcggcgggatcatccgcgacgtgctgtgcaacgacatcccgctgatcctgcgcgattcgcggccgtacgcgacctgtgcgttcgtcggctgctggttctacctgctgctcgtgtggctgcagttcgactcggtgtacagcgtgctgcttgcgaccggcttcatcctcgtcgcgcggctcgcgaccttcaagttcgacgtgcggctgccgcactgagcgccgccgcaacgccggacgcatcgccagaaacaaaggggccgctcacgtcgagacggcccttcttcgttcagcgcgaacgctgcctcacgcgatccgctcttccgacgccggatcgaacagcaccgccttcgacacgtcgaacagcagcgactgcgtctgccccggctgcgggttcgcggccggatgcacgcggctcacgatccgcttgccgttcacctgtgcgaacacgtgcgtgtccggcccggtcggctcggtcacgtcgacgcgcacgtcgatcggctgcagcttcgacgcctcgccgtggtgcgcgttgcgcgcatcggtgatgcgctcggacgcagcccgaggatcacctcgcggccgacgtggccgttcatccgcttcgcgtcgaacggcaggttcagcgcgctgcgcgcgaggcccgtgtcgatctcgagcgcgatcccgctgccctgctcgaccagcttgccgttgatgaagttcatcggcggcgcgccgatgaagcccgcgacgaacaggttcgacggcgaatcgtagatctcctgcggcgcgccgaactgctggaccacgccgtccttcatcaccgcgatccggtcgccgagcgtcatcgcctcgatctggtcgtgcgtcacgtagacgatcgtcgtgccgagacgctggtgcagcagcttgatttccgcgcgcatctcgatgcgcagcttcgcgtcgaggttcgacagcggctcgtcgaacaggaacagcgacggatcgcgggcgagcgcgcggcccatcgcgacacgctggcgctggccgccggagagctggcccggcttgcggtcgagcaggtgctggatctgcagcatctgcgacacgcggtcgacgatctgctgctgttcgctcttcggcaccttgcggatgttcaggccgaacgagatgttctcgcgcaccgtcatcgacggatacagcgcgtaagactggaacaccatcgcgatgtcgcgatccttcggcgacaggtcgttgacgaccttgccgtcgatgcagatctcgccgctcgtgaccgtctcgagcccggcgatcatgttgagcagcgtcgatttcccgcagcccgagccgccgaccaggatcaggaactgtccgtcctcgatctcgatgtcgacacccttcaggaccggcaccccgttcgggtaggtcttgtacacgtcacggatggaaaggcttgccatgctgtgaatcctctgtctcgtctcgcgcggcgcactccggcgccgcgtcgggttcgtttcgatgcgccgcgcgcgaggcgcggccggttcgtcgtatcggatgaagccgcgcttacccttcaccgcgcccgccgtcagcccgcgcacgaaatagcggccggcgacgatgtagacgagcagcgtcggcagcgcggcgatgatcgcgccggccatgtcgacgttgtactccttcacgcccgtcgacgtgttgacgaggttgttcagcgcaaccgtgatcggcatcgaatcgacgccggagaacacgatcccgaacaggaagtcgttccagatctgcgtgaactgccagatcaggcacaccatgaagatcggcagcgacaccggcagcaggatcttcgtgaagatcgtgaagaagccggcgccgtcgatgcgcgcggccttcacgagttcggccggcacgctcacgtagaagttgcggaagaacatcgtcgtgaacgcgatcccgtacacgacgtgcacgaacacgaggcccggaatcgtgttggcgaggccgagcatccctgcaggcgcgccatcggcagcaggatcacctggaacgggatgaagcagccgaccagcatcatcgtgaacagcgcgtcggcgccgcgaaagcgccagtgcgtgagcacgtagccgttgaacgcgccgatcagcgacgagatcagcacggccggaatcaccatctgcagcgagttcaggaagaacggcttcatcccgtcgcagcgcacgccggtacacgcccgctccacgccttcacccacgggtcgacggtccagctggtgggcggcgtcagcaggttgccggtacgcagctggtcgagatccttgaacgacgtcgacagcatcacgtagatcgggaacaggaaatacagcgcgaacaggatcagtgccgcgtagatcactgcccggctgatcgtcatcttaggctgcattgcgggtgctcctcgattccatatacatcagcggcaccagcaccgcgaccacggtcgcgagcatcatcaccgaggatgccgcgccgagcccgagctggccgcggttgaacgaaaacgtgtacatgaacatggccggcagcgacgatgacgtgcccgggccgcccgccgtcagcgcgacgacgaggtcgaaggtcttgatcgtgatgtggcagaggatcagcagcaccgagaagaacaccgggcgcatgctcgggatcacgatcttgcggtagatggtcggcagcgtcgcgccgtccacctgcgcggccttgaagatctcgctgtcgacgccgcgcagccccgcgaggaacagcgccatcacgaagccggtcgactgccacacggccgcgatcaccacgcagaagatcgccttgtccggatcgtcgagccagccgaacgagaagctcgtccagccccagtcgtgcatcaccttctcgaggccgaggcccgggttcaggatccactgccacgcggtacccgtgacgatgaacgacagcgccatcgggtacaggaagatcgcgcgcagcgcgccttcgttgcggatccgctggtcgagcaggatcgcgaggaacagcccgagcgcgacgcagatcgcgatgaacggaatcccgaaccacgcgaggttcgcggcggacgtccaccacacgtcgttctggaacaggtccgtgtaacggccgaagccgtcgaattcgtagttcggcaacagccgcgaattggtcagcgacagatagccggtaatcaggatgaagccgtagatgaacaccacggcgatcacgacgctcggcgcaagcacgagcttcgggatccagcgatcggcgaaggccgacatcggcgacgtacgccgtgcggcggcagcgccggatccgtttccgctaagaggggcagccacttgattcgactcctggaacgagggcggcgcaggccgggccggcgccggtacggcacgggcccgcgggcgagcccgtttgctgcacatgcaaaaacgcccggccgagatagcgtgtccggccgggcgcctgtcgcgcgttacttgaccttcgcggccttcgcgagcgcggcgaccgcgctcttcgaatcctgctgcgagttcatgaacttcgtcacgacgtccgtgatcgcgccggcggtcgcatcgctctgcgccatcccgtgcgagcgacggcacgaagccgcccgacttgatcgcggtctgctcgtcggcgtacgacttcttcgcgcagtcgtcgaacttgtccatcttcacgccgaggcgcacgggcaccgaacccttcagcaggctgaactgctcctggaagtccggcgtcatgatcgtcttcgcgagtgcgagctggcccggcgtcgcggccttctcgcccttctgctggaagaacacgaacgagtcgacgttgaacgtgtaggcattcgccgtgcccggcaccgccgcgcagatgtagtccttgcccgccttcttgccggcgttctcgaactcgcccttcgcccagtcacccatgaactgcatgccggccttgccgttgatgaccatcgcggtcgcgaggttccagtcgcggccgttacgaccggtatcgaagtaaccctggatcttgcgcaccgtgtcgaacacggacagcatctgcggcgacgtcagcgtcgcctggtcgaggtcaaccagcgccttcttgtagaacgccgggccctgcgacagcacgacgtcttcccacagcgtcaggtcctgccacggctggccgcccatggcgaccggctggatacccgcggccttcagcttgtcggccaccgcgaagaattcaggccaggtggtcggcaccttcgcgccgaccttgtcgagcgcggccttgttgatgtacagccagttcacgcggtgcaccgagaacggcgccgcgacggtgtggcccttgtacttgatgatcttgtcgatttccggcggcaggttctgcttccagtcgccggcagcggtatcgatgttgacgagcacgccctggtcggcccagtcctggatcagcggacccttgatctgcgcggccgacggtgcgtcgccgctgatcaccttggtcttcagcgcggtcatcgccgctgcgcccgcgccgcccgcgaccgcgaagtccttccacacgtagccctgcttctgcaggtcgtccttcagcacgccgacggccttcgactcgccgcccgaggtccaccagtgcagcaccgttacgttctcggctgcctgcgccgccacggcgccagccatcagacctgccgcgcagagcgcgcccatgatcgagcgaactttcattacttatctcctccagactgaatcaactcgtgaggttccctgaccgggaaccggcttcttgataaacgacgggaaatcgagccgcgggacgcatgcagcgtacggggccgatgaccggccgggctcttacagaaagcgtgaatcgagattcaacggcgtgtctcctctttgtgtttctggcccgccgcgatgctgcggcgcgagccggggccgacggcgcgccgacgatgcgcgccgtcaatgtccgataacattcggcacaaggcgttcccgaaggcgaagctcgcgcagttcatcgaccgcacttctttttcttcacccaggtgctaccccttgcggcggattgtagttaaactacaattcagtgtcaaaaatatttttatcgcactacggatcgcttcccagcaccccaacccggcggagacacatgcataccgattccagctttaccttcgtacttttcggcggcaccggcgatctgtcgatgcgcaagatcctgcccgcgctgttcgaagcgcaccgtgcgaacatgctggcggagagcggccggatcgtcgccgtggcgcgtcacgaatcggatcgcgcgggttatctcgaatgggtcgacacgcacgtgaagccgcacgcggagaaagccgccggcaaggcgctcgacgaaaccgcgtggaagtccttcctcgatcgcatcgagtacgtgaagctcgacctcggccgtgcggaagactacgtcgtgctgcgcgacgcgatcgcatcgctgcccggcatccgcgtgttctatctcgcgacgggcccgtcgctgttcgtgccgatctgcaaggcgctcgcgtcggtcggcctgaacgaaagctcgcgcatcgtgctcgaaaagccgctcggctacgacctgaagtcgtcgaatgcgatcaacgacgcggtcggcgagatcttcgcggaaggccagatctaccggatcgaccactacctcggcaaggaacccgtgcagaacctgctcgcgctgcgcttcggcaatgcgctgttcgagccgctgtggcgccgcgaatgggtcgagagcatccagatcacgatcgccgaggagctcggcgtcgaggcacgcggcgatttctacgacaatacgggcgcgctgcgcgacatggtgcagaaccacctgctgcagctgctgtcgatcgtcgcgatggagccgccgcattcgatggattcggattcggtgcgcgacgagaagctgcgcgtgctgcgcgcgctgaagccggtcgatccgcgcgacatcggcaaggtggccgtgcgcggccagtatcatgcgggcgtgatcaagggcgcgcaggtgcccgcctacgcgaccgagccgggcgtgaagccggacagccagaccgaaaccttcgtcgcgctgaaggtcgagatcgagaactggcgctgggccggcgtgccgttcttcctgcgcaccggcaagcgtctggccgaccgcgtcgcggagatcgtcgtcaatttccgcccggtgccgcactcggcgctcgggcccaccgcgttgcgtcccggttcgaaccgcctcgtgatccggctgcagccgaacgagacgatccgcctgtactgcctcgccaagcagccgggcgaagggatgaacctcgcgagcgtgcacctcgacctcgcgttcgaccagttcttcaaggaagggcagatggaggcgtaccagcgcctgctgctcgacgtgatcaacggccgtctcgccctcttcgtgcgccgcgacgaacaggaagccgcatggcgctgggtcgaaccgatcctgaacgaatgggcccgcacgctgaagccgccgaagccgtacgcggcgggcacgtggggccggccgcggcgagcgcgatgctcgcgcagcacgacacctgctggctcgaagaagagaactgatgtaaacgtcaccgcgcacgccttcgtacgcggcgacgtgccccacgattcgtacgatttgaacagacaaagcagtccggaggagatgtgatcgagatccacgctttcgacacccaggaagcgcaaagcgaagcgctcgcgcgcgccgtcggcgatgcgctgcgcgccgcgctcgccggccccgcgcgcccgacgctcgcggtgtccggcggcacgagcccgcgcccgttcctgcacacgctgtcgcacgcggcgctcgactgggccggcgtcgacgtaacactggtcgacgaccgctgggtgccggaggacgacgcggccagcaacgcgcgcctggtgcgcgacacgctgctgcagcacgcggcggcccctgcccgcttcctgccgctcgtcgacacgcgcagcgcgctcgacgcgcacgtcgccgcgctgaacgcgaacgccgactaccgcgtgccgaccgtcgcggtgctcggcatgggcgaggacggccataccgcgtcgatcttcgccgatgcgcccgaatgggatcacgcgatcacgacgcccgagcggttcgtcgccgtgcatcccggcgccgcgccgcatgcgcgcgtgagcttctcgctcgatgcgctcaagcgcgtcgaccggctgttcctgctgatcgcgggcgaacgcaagcgcgcggtgctcgacgccgcggccgcatcgctgcagaaaaacgcgatttcccaactggccaacgacaaggggacccagctcgatgtctactggtgcgcaaagtaaggccgttgtcgcgggccagcatgccgacggcccgcgcctgctcgcggacgtcggcggcaccaacgcgcgtttcgcgctggaaaccgggccgggcgacatcacgcagatccgcgtgtatcccggcgccgactatccgacgctcaccgacgcgatccgcaaatacctgaaggacgtgaagatcacccgcgtgaaccacgcggcgatcgcgatcgccaatccggtcgacggcgaccaggtcacgatgaccaaccacgactggagcttctcgatcgaggcgacgcgccgcgcgctcggcttcgacacgctgctcgtcgtcaacgatttcaccgcgctggccatggcgctgccgggcctgaccgacgcgcagcgcgtgcagatcggcggcggcgcgcgccgccaaaacagcgtgatcgggctgctcgggcccggcaccgggctcggcgtgtcggggctgattccggccgacgaccgctggatcgcgctcggcagcgagggcggccacgcgtcgttcgcgccgcaggacgagcgcgaggatctggtgctgcagtacgcgcgcaagaagtttccgcacgtgtcattcgaacgcgtgtgtgcgggccccggcatggagatcatctatcgcgcgctcgccgcgcgcgacaagaagcgcgtcgccgcgaccgtcgacacggtcgagatcgtcgagcgcgcgcatgcgggcgacgcgctcgcgctcgagacggtcgaatgcttctgcgggattctcggcgcgttcgcgggcagcgtcgcgctgacgctcggtgcgctcggcggcgtgtacatcggcggcggcgtcgcgctgaagctcggcgagctgttcacgcgctcgtcgttccgcgcgcgcttcgaggcgaagggccgcttcacgcactatctcgagaacatcccgacctacctgatcaccgccgaatacccggcgttccttggcgtatccgcgatcctcgcggagcagctgtcgaaccgctcgggcggtgcgtcgtcggccgtattcgaacggatccgccagatgcgcgacgcgctgacgccggccgagcgccgcgtcgccgatctcgcgctgaaccatccgcgctcgatcatcaacgacccgatcgtcgacatcgcgcgcaaggccgacgtgagccagccgacggtgatccgcttctgccgctcgctcggctgccaggggttgtcggacttcaagctgaagctcgccaccggcctcaccggcacgatcccgatgagccacagccaggtgcatctcggcgacacggccaccgacttcggcgcgaaggtgctcgacaacacggtgtcggcgatcctgcaactgcgcgagcacctgaacttcgagcacgtcgagaacgcgatcgagatcctgaacggcgcgcggcgcatcgagttctacgggctcggcaactcgaacatcgtcgcgcaggacgcgcactacaagttcttccgcttcgggatcccgacgatcgcgtacggcgacctgtacatgcaggccgcatcggccgcgctgctcggcaagggcgacgtgatcgtcgcggtgtcgaagtcgggacgcgcgcccgagctgctgcgcgtgctcgacgtcgcgatgcaggccggcgcgaaggtgatcgcgatcacgtcgagcaacacgccgctcgcgaagcgcgcgaccgtcgcgctcgagaccgaccacatcgagatgcgcgaatcgcagctgtcgatgatctcgcggatcctgcatctgctgatgatcgacatcctcgcggtcggcgtcgcgatccgccgggcgtcgacgaacggcgaactgcccgaggccgtcgcccaggcgaaggcacgcgcgagcgacgacgaaacggccgacgtgctcgactggctgagccacggcgcgtcgccggcggcgaaggacgtcgcgcgggattgacgcacggcgcggcgcaagccgcttcctgccccaacgaaaaacgccaccggcgcatcgcgcgcggtggcgtttttcatggtgccgcccgctggaggatcacgcccccgctttcaccggccgcccgtgccagcgcagcacgagacagcgcccggcgaaacacagcacgcccgtaacaccgatcgtcacccccatcgcgaacggcgtgccgtctgcgagcgcgccgatcgccacgctcgcgatcgcgccgagcgccagctgcatcgcgccgaacacggctgccgacgcgcccgcattgtgcggataacgatgcatgaggtcggtcgtgcagttcgcggacaggatcccgaccacgccgacgacgaagaacaggcacacgacgatcgaccacagcccgccccaccccgtcagcgcgacgagcgcgaccgcgagcgacgcgatgcagctcaccagcgacgcggccgcgatgatgcgcagcgaaccgacgcggccgaccagccgcgtgttcgtgaagttgccgatcatgatgccgaccacgttcaggccgaacaggagcccgtagtgctgcggcgacacgtggaaatactcgatgtagacgaacggtgtcgcggtgatgtacgagaacatcgacgcgaacgccatcccgccgcacagcatgtgcccccatgcgacggggtcggacaggatgcgcccgtacgacgcgaacgacgcgagcacggccgcgctcttgcgccgctccttcggccaggtttcgggcacgcgcaggtacgcggtcgccgcgcacaccgcgccgaacacggccagcacgacgaacacgccgcgccagcccgagaaacgcaggatctgcccgccgatcagcggcgcgagcagcggcccgaccgcggtaacgatcgcgaccatcgacaacaccttcgccgcgtcggtcggctcgtgcgcgtcgcgcgcgatcgcacgcgacagcaccgacgccgcgccggcgccgagcgcctgcaggaagcgcacgaggatcagcatgtcgatcgagttcgacacgaagcagccaatgctcgcgagcgtaaatagcgcgatgccgccgagcagcacgggacggcggccccacgtgtcggacagcgggccgtacagcagcatgccaaccgaaaagccggccatgaagctcgtcagcgtgcgctgcgcggcgccggggctgacggagaagccgtcggcgatcgacggcaggctcggcaggtacatgtcggtagcgatcggcccgcaggcggcgagcgcaccgagcaacaggatcagccgggcatcgggccggcgccggacgacgtgagacatgggtatccggaatggagcgccgcgcgcatcggggcgcgcgtggtggtgacgacgggaggccgcgccgcgaacggcgcgctcgggcccatgattgtacgcgcaactttttcgtgccgccggcccgacgcgcgaccggcggaaaaacaccggcacggcgcccgccgcgcgggatcgcgagcagggattcgattaagcttgcagcgcctcgctgccaattgtctgatccattcaattcgacacacgaccgaaccgatgaccgctttcctgttgatctggagccccaagaaatggccgtggcccgaactgcccgacgtcgccgcgcgcgtgaaggccggcgaggccgtgcatgacgtgtggggctgcggcttcgcgcgcggcatcctgccgggcgaccgcgtgttcctgcaccgtgtcgcgaaggaacccaagggcgtgttcggctccggctacgtgacgcgcgcgccgtacgaggtacccgatccggcgacgaagcgcggctaccggctgtgcatcgacttcgtatacgactggctggtcgatgcgcaccaggacgtcgtgatcccgcgcgacgcgctgcgcgtgcatccgtactcggtacagacctgggacgcgcaaagctccggcaccgtgatcaagccgatggtcgaaggcccgctcgagaaacgctgggccgagctgaccggcaagcgcaaaccgccgcgataaccgaagcggccgccgtgccgcatctgcccctcctttccggccccggcccgcgcaaccccgcacgcgccgaaaggccgcggaccgcgccgcgggcccgccgcgcgcgtctccggtacaatcggacgatcgttccgcccaggcgccgcggcccgtgcacaggcccccgcacccttctctcgcaggtttcgctcatgtccaacaatcagatcctcttcgaacgcgcccagaagaccattcccggcggcgtcaactcgccggtgcgcgcattccgttcggtcggcggcacgccgcgcttcgtcgcgcgcgcaaggcccgtatttctgggatgccgacggcaagcagtacatcgactacatcggctcgtggggcccgatgatcgtcggccacgtccatcctgaagtgctgtcggccgtgcagaacgtgctcgccgacggcttctcgttcggcgcgccgaccgaagccgagatcgagatcgccgaggaaatctgcaagctcgtgccgtcgatcgagcaggtgcggatggtgtcgagcggcaccgaggccacgatgagcgcgctgcgcctcgcgcgcggcttcacgggccgcagccggatcgtcaagttcgagggctgctaccacggccacgcggacagcctgctcgtgaaggccggctcgggcctgctgacgttcggcaacccgacgtcggccggcgtgcccgccgacatcgcgaagcacacgaccgtcctcgaatacaacaacgtcgccgcgctcgaggaagcgttcggcgcgttcggcgacgagatcgccgccgtgatcgtcgagccggtcgcgggcaacatgaacctcgtgcgcggcacgccggaattcctcaacgcgctgcgcgcactgtgcacgaagcacggcgccgtgctgatcttcgacgaggtgatgtgcgggttccgcgtcgcgctcggtggcgcgcaggcgtactacgggatcacggccgacctcacctgcctcggcaaggtgatcggcggcgggatgccggctgccgcgttcggcggccgccgcgacatcatggcccacctcgcgccgctcggcggcgtctaccaggccggcacgctgtcgggcaacccgatcgcggtcgccgcggggctgaagacgctgcagctgatccaggcgccgggcttctacgacgcgctcaccgcgcagacgaagcgtctcgccgacggcctcgcggccgaagcgcgtgcggccggcgtgccgttcgcggccgactcgatcggcgcgatgttcggcctctacttcgccgaacgcgtgccgaccagcttcgccgaagtaacgaagagcgacaccgagcgcttcaaccgcttcttccacctgatgctcgacgaaggcgtgtatttcgcgccgtccgcgtacgaggccggcttcgtgtcgagcacgcacgacgacgcggtgatcgacgcgacgctcgcggccgcgcgccgcgccttcgcggcactcgctgcctgacccggggccgcgcgcatgttctcggatatcgatttcgcccacatgcagcgtgcgctcgcgctcgccgcgcgcggcatgtatacgacggcaccgaacccgcgtgtcggctgcgtgatcgtcaaggacggcgacgtgatcggcgaaggtttcacgcagccggccggccaggatcacgcggaggtccaggcgctgaaggacgcgcgcgcgcggctacgacgtcgcgggctcgaccgtctacgtcacgctcgaaccgtgcagccatttcggccgcacgccgccgtgcgcgaacgcgctgatcgacgcgcgcgtcgcgaaggtcgtcgcggcgatggaagacccgaacccgcaggtatcggggcgcggcctcggatgctgcgcgacgccggcatcgacgtacgctgcgggctgctcgcgcatgaagccggcgaactgaacatcggcttcgtgtcgcggatgacacgcggccgcccgtgggtgcggatgaagaccgccgcgtcgctcgacggccgcaccgcgctgccgtccggcgaaagccagtggatcaccggcgaggccgcgcgcctcgacgggcacgcgtggcgcgcgcgcgcctgcgcgatcctgaccggcatcggcaccgtgcgcgaggacaacccgctgctgaccgtgcgcgggatcgacacgccgcgccagccgcagcgcatcctggtcgacagccgcctcgacctgccgctcgacgcgcggctgctcgaaggcgctccgctgctgatcttctgcggccggctcgacgccgccggcgaagtacgcgcgaaggtgctgaaggcgcgcggcgcggaaatcgtgccgctcgcgaatgcgcacggcaaggtcgacctgcccgcgatgctggcggcgctcggcgcacgcggcgtcaacgagctgcacgtcgaggccggccacaagctgaacggctcgctgctgcgcgaacagtgcgtcgacgagttgctcgtctatctcgcaccgagcctgctgggcgccgatgcggccggcatgttcgacctcgccgcgccggcgagcctcgatgcacgcacgcggctgtcgttccacggggtcgagcgggtcggcgacgatctgcggatcctcgcgcgcttcacgccgacggacgccgcgcactgaacgggatcgtcgcgccgcgcgagctcggccgctatctcgtgtacaaggggcggtcaacggcgtgagcctggccgtcaacacgatcgacgatcgcgcggacggctgcaagttcgcgatcaacctgattccgtatacggtcgaggtcacgacactgcgccacgtgaaggccggtgacaaggtcaatctcgaagtcgacatgatcgcgcgatacgtggagcgaatgctcacttcgtcccgggacggccataagccgttgaaatgactcgatttttgacgattcgattgtctaccgtcgtctcatcaaaatcaccgaagtctgccactacgtgacggtataccgtcggttccggcggcaagtataccgtcacgcatccggaaatcagtctcttcgacatgcgcaaatcggcgccctgcgacgcccgcattgggatcggcgtcgaccgccgaagaccgctcctgatcgccctcgcccacgcttccgcccgtttccgaacgagggcattcgacactacacccaatctccggccttgctcaaaacaatcgactaccgcgtcagttaagaacatagcttgaagagcgagcccgacgcattcatcgtgcaggtaccatcgcagttcgtgcaggacgtgccccggcaatatccccgtgcgttgttgcccgagtacatcacggacctcatcctccaacgctcaccgacgattgggcgaattcgaaaccttcggattgtctgaaggagcaagtcgtttccaaagcagtcgaccccggcatgctttttgacacggcttggccagaaacgggcagtaggccaagcggcagcgccagcagttatcgaaatgcgctgccgattgtcatgctgacagattggctaccgtgcagcgccgccacctctccttactttcgccagcgctcaatgacctgggtgaagacaacatcccgccattgttctttccattccttatgaacctcgacgctttgcgaatgtggttcagggaccggtagcggcatctttatcaccgccggcagcagcacggcgtcacccaccaccacgcactcacccggagccaagttcggcaggatatccgtaatcgcgttggtgttgtcgggaaagaggcgccgcacgtaggtctgatctgcgtcgttcgtcaggcgcagcgacatgaagttgttgcactgggcgaatatcgtctccgacacttccgagggccgctggctcacgaccatcaggctcaggccatatttccgcccctctttgcgatccgctcaatggactttcgagacgcacgataggctgcgtggtcgtcccgtggaacgtagttgtgtgcctcctcgcaaacgagcatgaccgggatgtcattgagcttgccttgggcgtgctgaagcttcgaatagtggaagcagaagtcgaagatgatgcgagagatcaggctaacggtgatgctgagaacctcgaaaggaacgccgcttaaatccacaacggtgacgttcgccttgtcgaggtagccaatgaactgtttcatcagcgtctcaaagtcagcggtaatatgggcctgcccgtcagccctcttcgcattcaaaaggaaccggagacgcttgtcggccagtttcgcctctaaccgtgaaacgaatctgttgaactctccgttgaatggcccactggttgctttggtcgcagcagcgctagagttagcgacgaagtcgtgaatcttgtcaaaatatatctttcggtcggacactaaacttccgtcggccagcttaggcttgtcttccccggccaggcgcccgataacctcgcgattcaggttctcaatgaagtagtagacctccttgatcgagaaataaactggagtatcgtacgtgacctcttgaacgcccggattgtgcttttccttgttcaaaacaacagcgtgcttgaactgactaacctgattatgagagttcgcctcgttgctctcgatgaacatgctttccagctcttccgaattcatcaaccagtatggaagctgcagtgaatcaatgtcgagtcggctcagagtaaaagactcttcttctttaagagaacgcagcggtgtattcgtcatgaatgtcgaatatcaccacatgcgagttattttgcttgcccttatttttatttttcttctgtgcgataccaacgacatcctgtagcacgctcgcgactgtgcacgatttaccggaaccggtcgagccgacaatggcaatatgcttgctgaagaacctgttgccattgatcatcagatcgatggacttgttcattgagagttttccaagcggaaaatcgtgatcgctatcagccgagaacatcttgtccagagtctccttttcggcaatgaatgcatgctcggttggcaccggcaaaggaggctaccccgatcaaacgtcttgtcttcaaccaaggtgccaatcgcctggcactcaatctgaaaactccagattggctttccatcagaaccaatggtgtttgatcccttaatgttcagaatggtggcaatcgtgaaatcatgattgccctgtgcaatcttcaagaagcggccaacttgcaacgcctctttgtttttctcgaacacttcaagatcatccactgcaacgatgatagctcccggcgcacacgagagtacagctccaatcttaataggcattgctcatccccatcatgtacttgatttcgtcaaatctttcggcaccaaggatctcaaggtttacatccttgacatctacacccgtgatgtccccatcgccaatgacaaagaaatcatctgccttcattttgaatgcgagcttcttgtaatcgtcccagcgaattaatctcagaacaaattcctttttatccctttgaaccatcggttcgcgaaaaaataaacctcggaaaacatctttactggtcgaccgtgatttggaatcacatccttcccgatcaatctttctgcaattccatcaaacgcatcttgcgaaacatccagtgcaaaaagtggcgtatgcgtgtgcaccagcttgaaatgatatttatctatgaacgcttttatgaagaggacgatctgatcatcaaactgctccaagaaagcagggaatacaacaagatgacgcaaacgaacgttcgcactcaagttctctttaagctgattgcgtcttgtttccaagaccttctgccgcgtcttcagtgcaagggtccattgagacactgctgtggatctgatccgccgcagtgattccaaaattccctcttggtaatctttctcagctttgcgtcatgcttgatactcaaatcagcaatgatttgaatggcattcggataaaacaacgcctccacttccccttattgaagccgtgagcctcaagctgtttagcatttccctccattaattcgtcatatttcggcgcaacggaaacggaaaacactttcaagaaaccatcaacatcgactccggcaacctcggcaatcaggtctttcaaatccttgtttttcgatttgagtgcgccgttgagttctaccgccgatataccaatcgctgaaatattgggaaagtgcgcgaataagtgataatttatcttcgcaccgggattggacttgaagtgcttcatcatctgaagcaacgggtgataaagaatgcttggtgtgtagttactttgcgtctcgtggtatttgcactgaatcgctttggtcccggcaaaggttgccacctcgatgtcttcgacaatgccctcgatggtaatcacggcgtcatccgtcgccttcagcagttcagagagcgtctgattaaactggtacagaaaaccctggattgtgtagtctgccgagcggcccatctttttacgttcttcaggttgtgtgcagagacgctaccagcaattgcggttgatgtcaccccgtgctgaacgggacgctgactataagtcctgttggagcaatgaaagcgagcatgaggatcgaccgtgcgtctatagcgccgcccgcagagtgactaacgttctgtcgcaatcgagaaaacggggtgaccgctcacgggtcgactccggtccgtcgccacgtcccgaagcgtgccgattacgccacggccatccttcgactgagcttcccgccaattggaagagcgccgtgacgatcaggcatcacgatcggaggttcgctcaggcgtgcgctgcggcgcgaccggcgagccgaatactggtgtattgactgtttttcggtcgtatcgtcattttatcagggccacatcaccctctcaacggccaaataactttggtcaggctggcgcaatactgcaaatttccggcgctttcgaagtgacatctcaaccagcaagccgatgtcgaacctgcgaatcgttgccgactacgtcaagaaacaccacgacgcggcagttgctcgaagggtcgtgaacgccttgttggacgagacgggctaactgggctgggaccactttcaccggttgggcgggagcttgactgatatgacagaccgccagctccggaaatgcaacgccggatatggctctggggccggtacgttgcgctacgaagtcatgccgcaatactccgaagagcccgcactaccattgcagtgctgcgcgtgtgagacactaggcaggattgctggccctatagccaaggactcggcttcacaagactacatgcactttgcgtcagagacctaataccatgataaagctcgaaaatcgagaccaatttttgtccgattggatcagaattgcaggcgactatgcccgagattatttgggctttgagactcccgacaaccaccagatcgcacacgaccaactgctcgcgaacaacttcgagcgcgttcccaaaaagcgccgcagggtgatcagacttgccgacagttttatgtgccccgatgagcttaaggccggttgggagtacctcaaagcgaagatcgaagctggagatgacctctacccccacctgagccgacagatcaagaatatcggggctcgtgatccgttgctcatgcactggagcatcaatcacttccatctagggacagcaccggattcaaagcacaaaggtttaattcaaggtggaaaggagatcgtctacgcacatctagatgaccaatatttctacgcgatcgcccttcttccgcatggccattgggaagatttcgatttgatcgagacaataaagcgcaattggccaacgcatccgaacatcagcacgcacatgacccttgccacgaactacacacaggaagacgtcttggagctgcgcaaacatcaaatcaatgctcctgtaagcttcggcgatggatcttttatatgggcacgggacaaagtctcgctggcttcagtgcaagcgcatcactgaaagcaaacagcatcagacgccttttcagtcggtgccaaggagaatttgaaaaaatttccacaagtacctacccgatatcgaaatccagcctgacacccgcgtcattgcgcacctcaggctcgaagacgatcacagcttttccatttcgcttcctgatttttcaagatcggtaaagcttggcatcggtactatcgaggacctgatcgaaggactgaaagcctgacttcagcggtcacagatggaaaggagcgcactgggagtattgcgcgacccatgcatcaactcgactctctccactgccgtctatcgtcgtctcgcggtgcagcagctgctaagtgacggtatttctgacggtacgagccgattttcactgtcctacctacgagggccaagcgtctccagccagactcaacataattgcgcgccacgtcgaagggatgctgtcgacgtcgcaaggcgtacatcaggactgatcacgcgggcggtttccggcgtggcggccggtacgctgccggccgccacgtttccttgtccttcgcgccgccgcgcaccggcaatcaggcgtctgcgtcctcccctcctgcccgcgccgaaatcgtcccgagcaactgccgcacatgctcgcgtgccgcgcgcccggccccttccgcatcacgcgcggcgatcgtgtcgaacacccgccggggtccggcgacattcccgccccgtcgtgcccgaccacggacacggccctgccggcggccggtgcggctgggccggaactcgtttccgacgcatcttgtctatccgcttccaccgatgcgacgaggagcttgcgtgacggccgtcccttccgatcctgcgcaataccgccgcttcaccgtcgacgacctgctgtcgctcgacagcttccagcgcgactacggtcgcacctgcgcgctgtcgccggacggcggctcgatctgcttcgccgtcgtccgcccgctggccgatggccgccgcttcgaccgcgcgtatcttggcgggctcgaccgggccgagctgcacctgtacgaattcgccggccgcacgctgcgccggctggccggcgatgcgcgggccggccgcgcgtgcggctcgccgtcgtggtcgccggacggaagatggatcgcggcggtcacgctgtcggccgacgacgatgcagtgcatgccgtcctgatcgacccggcgaccggggccacgatgccggtcacgaccgcgcgcagcgtcgacctgtccccgctcgaccgcgacgggccgttcacgtggctgcccgatggccgcgtcgcgctgccgctgcttgccgaacgggcgacgcccgtgacgtcgcatctgcaccgccggctgttcgggaacgcgcacgatgcatgggcggccaacgcgctcggccgccaaccgacggccgacgtgctcgacagcgccgcgttcggcgatccgcccgccgcatccgcacccgactggtgggcgttcgatcccgcatcgggcgcgttgtccgcgctgtcgccgcatgcgtgcgcgcgggccgggctgacaagcgcggcggtcacggacacgccgccggacacacacggcacgaacgacgccgacgaaccggcagatcacgacggcgtgcgccgcgaacgcatatcggcagaaccggagcgccggtacgcggccttcatcgaacacggccgcgacgccacccggctgacggttcgcctggccggcgcgcgcgacgcgaccgtggtgttcgagacgaatcgccagctggccggcatcgcgaccggcacgacacaccggcttgcctgccgcggcgcggagcccggccggcagcgcttcgtcgacgtcctgctgccaccggattacgcgggtgcgcctgtacccgcagtcgtctgggtgtacccatacgaaaggtcgcgccccacccgcacctgttccacgaacccgactgcccgctgccgttcaacttccagctgttcgccgcacacggctttgcggtcgtcgacgtgaacatgcggggcgtgctgggcgaggtgccggcgacgatggcagacaggatgctcgacgacgtccacgcggcggtcgacgccgcggtcgacgccggattcgtcgatcgcggccagctccacctgtacggccagagcctgggcggctgggccacgatgatgctgctcgcccgtacgccgatgttccgctcgggcatgtcgagcgccggcatcagcgatgcggccgcgctctacgcgtcgctcgatgcacgcctgcgttacgaaacgggccacgacacgcgtcccgagcgtttcgagctgctcggcaaggtgctggccgacaatagctggaacatcgacgcgccgccgtcggtccgcccggatgcctatcacgcgatcagcccggtgctgcacgcggcacggatcacgaccccgctgctgctgatccatggcgacgccgactacgtgccgctggaacaaagtgaacggatgttcgcggcgctgacccagcttaagcgcgacgtgcggctgatccgctactggggcgacgatcacgtgccgcaatcgcctgccaatatcgccgaccgttaccggcggatgatcgactggctgcagcgcgcgtgaccggccggtgccgcgcgcgcaccggcccgcccgccggctccatcggccgaacggccaacgacgcgcacgggtcatgcggtcgcgctaagatgcgtcgacagcggtttcgataccgcaatgcacgacgcgccgcgtagcggccgccctcttcctcaaggagtcgcccccatgtccatctcgatgtaccaggcttcactgcccgtgctgatccgcggcctgaccaatcttcagcacattctcggcaaggcgcaggcgcatgcggccgaaaagcagatcgatccgtcggtgttcgtcggcgcccgcctgtacccggacatgctgccgctcgtccgccaggtctatattgcgaccgacacggccaagggctgcgccgcccgcctcgccggcgccgagatcccgagctatccggacgtcgagcagaccttcgacgaactgcacgcacgcatccagaagacgatcgactacctgaaaagcttcgacgcggcgcagatcgacggcagcgagacgcgccagatcgtgctgaagatgcgtgtcggcccgatcgagttcaccggccagtcgtacctgctgaacttcgtgctgcccaatttcttcttccacgtgacgaccgcgtacgacatcctgcgtcacagcggcgtcgagctcggcaagctcgactacctgggcgggcgcgaccagcacgcctgacgcgcggccgggcaaggcccggcccaccaccgcgcgtgcaggcaacctgcggcgggcccggccaggcctgccgcgcaggccggccgcggcgctttccgagcgcttgccggcggcgcgcggcccctgccagccgaaacgccgcccggctggcgtaaaatacgcactttcctctttctcgcccccttatgacgctcgcctccacgctcgacatcatcgccgagctgaaagccggccggatggtgatcctggtcgacgaagaagaccgcgaaaacgagggcgacctcgtgatcgccgccgaattcgtcacaccggaagcgatcaacttcatggccaagtacggccgcggcctggtttgcctgacgctgacgcaggaacgctgcaagcagctgcacctgccgctgatgacctaccgcaacggcacgcagtacggcaccgcgttcacggtcagcatcgaagcggccgaaggcgtgacgaccggcatctcggccgccgaccgtgcgcacacgatcgccacggcggtcgcgcacgacgtgcgccccgagcacatcgtgcagccgggccacgtgttcccgatcatggcgcagccgggcggcgtgctcgtgcgcgcgggccacaccgaggccggttgcgacttcaccgcgctcgccggcctcacgccggccgcggtgatctgcgagatcatcaaggacgacggtacgatggcgcgcctgcccgacctgatcgaattcgcgcaggagcacaacctgaagatcggcacgatcgccgacctcatccagtaccgcagccgcaccgaatcgatcatcgagcggatcgccgagcgtacgatgcagaccgcgcacggcacgttccgcgcggtgctgtaccgcgaccagccgagcggctcgccgcacatcgcgctggtgcgcggtgcgcccgcgcccgacgtcgatacgccggtgcgtgtgcacgagccgctgtcggtgctcgacctgctcgaaacgggcgtgtcgacgcactcgtggacgctcgacgccgcgatgcgcgagatcgcggagcgcgacctcggcgtgatcgtgctgctcaactgcggtgacacgaaggaacacctgatcgacgtcttcaaggcgttcgacgaggaagaaaaggccgctgtgctgaagcgccggccggtcgatttcaagacgttcggcatcggcgcgcagatcctgcgcgatgtcggcgtcggcaagatgcaggtgctgtcgaatccgcgcaagctgggcagcatgtccggctacggcctggaagtcacgggcttcattccgatgcccggcggcgaagccaagtcctgcccggcgtccaacgcgtaacccgccacggcgctttcgccttataaccgttcatccacaccacggacaagatcatggaaatcggacaataccaaccgaatctcgaaggcgacggcctgcggatcggcatcgtgcaatcgcgcttcaacgagccggtgtgcaacggcctcgccgacgcgtgcgtcgaggaactggaacgcctcggcgtcaccggtgaagacgtgctgctcgtgtcggtgcccggcgcgctggaaatcccgctcgcgctgcagaagctcgcggaaagcggccagttcgacgcgctgatcgcgctcggcgcggtgattcgcggcgagacctaccacttcgaactcgtgtcgaacgagagcggcgcgggcatcacccgcatcggcctcgacttcaacctgccgatcgccaacgcggtcctgacgaccgaaaacgacgagcaggccgtcgcgcgcatgaccgaaaagggtcgtgacgccgcacgcgtcgccgtcgagatggccaacctgacgatggccctcgaccagctcggcgatgacgacgaggacgaagaggaagacgaagacgacgaagaggagcgcgcatgaagaagagcgcccgccgacaatcgcgcgagctggcgacgcaggggctgtaccagtggctgctgtcgaacgcgtcctccggcgagatcgacgcgcaactgcgcggcgcgctcggttacgacaaggctgacaaggagctgctcgacgcgatcctgcacggcgtgatccgcgagcacaccacgctcgtcgaagcgctgacgccgtcgctcgaccgcccgatcgaccagttgtcgccggtcgaacgcgccgtgctgctcatcgcgacgttcgagctcacgcaccacgttgaaacgccgtaccgcgtgatcatcaacgaagccgtcgaactcgcgaagacgttcggtggctccgacggctacaagtacgtgaacggcgtgctcgacaagctcgccgcgaagctgcgccccgccgaaacgcaggcgcgccgcaacggctgataccgtttggtccggaacgggcgcgcatgcgcccgtttttctttcgtcacgcccctcccctgcccgcccgatgaataccgccaccgattcgctcgtcaagctcgccgcacgcgtcgacgcgatccagcccttctatgtgatggaactgatgaaggaggcacagcgtctcgagtcctccgggcgcgatgttatccacatgggcatcggcgagccggatttcaccgcgccggagccggtcgtcgaagcggctgcggccgcgctgcgccgcggcgtcacgcaatatacgagcgcgctcggcattgcaccgctgcgcgaggcgatcgccgcgcactacgcgcgcgcctacggcctcacgatcagcccggagcggatcgtcgtgacggccggcgcgtcggctgcgctgctgctcgcgtgcctcgcgctcgtcgggcgtgacgacgaggtgctgatgcccgacccgtcgtatccgtgcaaccggcacttcgtcgcggcggccgaaggccgcgcggtgctcgtgccgagcggcccggacgcgcgcttccagctcaccgaggacgacgtccgcacgcgctggggcgaccgcactcgcggtgtgctgctcgcatcgccgtcgaacccgaccggcacgtcgctcgaaccggacgagctgaaacggatcgtcgaagccgtgcgcgcacgcggcggtttcacgatcgtcgacgagatctaccaggggctcagctacgacgcggcgcccgtgtcggcgctttcattcggcgacgacgtcgtcaccgtgaacagcttctccaagtatttcagcatgacgggctggcggctcggctggctggtcgtgccgcccgcgctggtcggcacgttcgagaagctggcgcagaacctgttcatctgcccgtccgcgctcgcgcagcacgcggcgctcgcctgcttcgagcccgccgcgctcgacatctacgaagcgcgccggctcgaattcaagcgccgccgcgatttcatcgcaccggcgctcgaacggctcggcttcacggtgcccgtgatgccggacggcgccttctatgtgtatgcgcactgcggcggcgtcgcccacccggcggccggcgacagcgccgcgctcacgacggcgatgctgcacgacgcgggcgtcgtgctggtgcccggcatggacttcggtgtccatgcgccgcgcgactatatccgcctgtcctatgcgacggcctactcgcggctcgaggaagcggtcgaacggctcgcgacattgttcgggcagcactgagccacgactgagcctcggccggcacgccggcggcttctcgcgccgcaaagcaaaaggcaccctgatcgggtgcctttttcatgtcctgccggcggaaccgagcagtgcgtagcgccgggcgttacgcgccgagctccgaacggtcgccgtgcgacttcgcggtatcgacgctcgcgtcgtcctgcggcgcggcttccttcgatgccgccgacttcgccgacgtcgtggtttcgagcgtcgcatgcacgcgcttcgcgccgcccgctgccgctgtcacggcggcggccgtgacgatcggcttcgccggcgcctgcggggcgttgaccggcacgctgcggccgtgcgacacgtcgcgcaggcgaccgcgctcggccatcaccttcgcgccgtatgcggtgtcgtccgggttcgtcgagccgttgtacaggcgcaggccgttcgcgagcgaaccgccacgagcaatgcagtccttcagcacgagcgcgccgacctggaggttcgcgagcggttgcagtgcggtatcggtgccgccgaaatactcgaacttgtcggaatggaccttcgacatgacctgcatcaggcccttcgcgccgacgccgctttcggcgtacgggttgaagcccgattcgatcgccatcacggacagcagcagcagcggatcgaggccgacgtcacggccggtctggaacgcagccttgacgagctggccgagcggctcctgcgcgacgcggtaacggcgcgacaggtaggtggcgaccagcgcctgctcgcgattcgacgcaagcgcacggtcgtcacgcgcatcggccgccacgcgctgggtcgggatcagcttcgccagcgcgacgggcgacgggccgttgcgggccggatcggatgcatcgccctgcgcgttggcttccggtgcgacgtcgaggccgaccgcaagcgcgtccgtttcagggctgtcttcctgctgcggctgcgcgccggcgggcgcgaagttcggcagcggatggccggtcagcagacgggccgggccggcttgcacggccgcggatacgaccggcatcagcttcgcggcgagcgtgccgcgcacggttggcagcagccacagtgcgagtgcaaccgcgaccgcgagacagccgacaacgctgaatagatggtgactgacacgcgtcccgcgacgcagcatgctgcgcacgaattgcgcatgctgctcactaggacgccacgataaccaagcgttcattcagatcatctcccatgaacatgactcgtgcggctcgctcagctcgatggcgagacaggtaacgcgccgcggaatcacgacgccgcacgccttggttgggacgtgcagacatcgggaaacggtataagtaccgttcgaggccacggtgtaagagggccggcaccttcgcacactgggcgaggcgggcatacgcggtggcacccacgcaaaaaccagcgtctggtggcgctggctgagactacgactaaggccgtcggatacgccgtgcaggtatcggcggacggtgacgcgctgcgtcaaagatcggtgattggcggctcgaagccttttaccctgcagccaatgtgagcggattctagcagggttttatagatcgtcaacactataaaaccttgaaattataacaaaaagtaatttacggacactcttcagatcgcgagccccgtgccgtaggggtttgcgcgcggtcgactttttctccgccgggcgggcatgcggcggcgcgggtaaaatcgtcggtcgattcggggccgcagccggccgctgcgcccgcccatcgctgcccgccacccgggtggcccggaccatcttcatgaaatacaaagacttacgcgatttcatccagcgcctcgaggcgctcggcgaactgcggcgcgtcacgcagcccgtgtcgcccgtgctggaaatgaccgagctgtgcgaccgcgtgctgcgcgccggcggccctgcgctgctgttcaacgcaccgaccggctacgatttcccggtgctcggcaacctgttcggcacgccgcgccgcgtcgcgctcgggatgggcgtcgacgcgggcgacgacgccgcgctcgattcgctgcgcgatctcgggcgcctgctctccgcgctgaaggaacccgatccgccgaagagcctgaaggatgccggcaagctgctgtcgctcgcgaaggccgtgtgggacatggcgccgaagtcggtgtcgtcgccgccctgccaggagatcgtctgggagggcgccgacgtcgacctgaacaggctgccgatccagacctgttggcccggcgacgcggggccgctcgtcacgtggggcctgacggtcacgcgcgggccgaacaagtcgcggcagaacctcgggatctaccggcagcagctgatcggccgcaacaagctgatcatgcgctggctcgcgcatcgcggcggcgcgctcgacttccgcgaattcgcgctgcgcaaccccggcaagccgtatccggtcgcggtcgtgctcggcgccgatccggccacgacactcggcgcggtgacgcccgtgcccgattcgctgtccgagtaccagttcgccggcctgctgcgcggcagccgcacggagctcgcgaagtgcctgacgcccggcgtcgacacgctgcaggtgcccgcgcgcgcgagatcgtgctcgaaggcttcatttatccgcaggaaggcaccccgcccccgctccggccggggcaccgccgcgcccggccggaaacgcgtcggccgcgtacgagcacgcgctcgaagggccgtacggcgaccacaccggctattacaacgagcaggagtggttcccgtgttcaccgtcgagcgcatcacgatgcgccgcgacgcgatctaccactcgacctacacgggcaaaccgcccgacgagcccgcggtgctcggcgtcgcgctcaacgaggtgttcgtgccgctgctgcagaagcagttcacggagatcaccgacttctacctgccgcccgaaggctgcagctaccggatggccatcgtccagatgaagaagagctacgcgggccacgcgaagcgcgtgatgttcggcgtgtggagcttcctgcggcagttcatgtacacgaagttcatcgtggtcgtcgacgaggacgtgaacatccgcgactggaaggaggtgatctgggcgatcacgacgcgcgtcgaccccgtgcgcgacactgtgatggtcgacagcacgccgatcgactatctcgacttcgcatcgccggtggccggcctcggttcgaagatggggctcgacgcgaccaacaagtggccgggcgagaccagccgcgaatggggccgcccgatcgagatggatgccgccgtgaagacgcgcgtcgaccggctctggcaggagatcggactctgacgccacgcggccggcgcccgccggcccgtggattgccattgcaacaagaacaacgaagatgacctttccgcccacctccatgctgtccgacggcttctttctgtcgctgtcgctctgtctcgacatcggcctcgtgaacgtcgcgatgctgtcgctgacgctgtcacacggcttccggccgggcttctggctcggcatcggatcgtgcgtcggcgatctcgtctatgcggcgctcgcgctcaccgggatggccgtgctgctgcagttcgagccggtgcgctggatcgtgtggatcggcggcggcgcggtgctgctgttcctcacgtggaagatggcgcgggaagcgctggcgccggccaaggcggcgggcgacgatgccgaggagacgccgcagccgcgcgcgagcgcgcggcgcagcttcctgcgcggcatgctgctcgcgatgtcgtcgccgagcgcgatcctgtggttcgcggcggtcggcggcgcgctgatcgcgaaagccggcgcgaccacgccggccaccgcgtcggtgttcctgtcgggctttttcctcggcggcctcgcatggacgctcttcatgtgcacgctcgcgagccagggccgcaagcgcgcgggcgcgggctgatgcgcgcgtgccacatcgcgtcggcgctgctgttcgcgtatttctcgtatagcgtgatcgttggcggctaccgcgacctgatcgtgaacgcggtgtaatcgcagccggcctgcacgggccgctcaccgaggcccggcggcggcccgaaagaaaaacggcgcagcgccccgctcgggacgctgcgccgtttgccgcgcgcggtcaggccgcgcgggacgaatcagcgacgccagccgtgatggccccagccgccgtaaccatggcgccagtacgggcgaccgtagtagccaccatagccgccgacgaccacggcgggcggcggtgcatagtaagccggcgccggcgcgtaatagacgggcggaggcggcggcgcgtagtacacgggcggcggcggtgcatagacgggatacgcgggtgcgaccgggataccgatgccgaccccgatcgacacgtgagcctgcgcagcgcttgcggcacccaggcccagcgcggcggcggcgatgaacggaatgagctttttcacttcgattctcctgctggagcggtattttatgcgcccctgtcggcaacggcgggcatgcacgtcgcatggaagcaatgtagcgaaaacgcgctcctcacgtatcgggcatttgttgcaaattgcaatcgcacgcggccggaaccgccgtgcggcgggctcgcagcaccttcggcgacccttgcgggccgcgcggttccgtccgacgagtcgggtcgcaacatcatggccggtcagtcttaccggatacggcgcgtgcggcgggcacgcgatcgtaatgaacgattacaaatttgagacaagatgccgacgtttcaagccggacgcgggtgcgatatgtttcggggtcggattccacgatcgtgaatcgaccgtggcgccgggcgccgatacacgcatcgataaatgcgtcgttcgcgccgcgtagcggccggccacgaacgtgtccgcacggaagtcgccctttcgcggccccgccgtcattcctgcgatactggcggttgcttcgttttcgcttacgttcgctgccatgtccgtccccgacacaccccgcctcggcttcatcggcgccggccgtctcgcacgctgtgtcgcgcagcgcttcgcgcaggccggctttccggtcgtcgcgatcgcgagccgcacgcccgcatcagccgcggccctcgccgcgcgcatcgacggctgccaggcggtcgacacgccgcagcaggtcgccgacgccgccgacctgatcttcctgacggtacccgacgaccatctcgcgtccgccgccgcggcactgcgcttcgacgcatcgcgcgccgcgcggcaggccgtcgttcactgcagcggcgcgtcggccgtcgcgctgctcgatccggcgaagcagcagggcacggccaccggcggcttccatccgctctacctgttcggcggcaccgacgccgacctcgcccgcatcgacggctgctcggtcacgatcgaagccgacggcgcgctgcatgcgacgctgatgcgacttgccgccgcactcggctgccatccgctgtcgattccggccggcggccggatgctttatcacgcggccgcgcactacgcggcgagcttcgcgctgtgcgggctggcggaagcggtcgagctgtggcgcggcctcggtttcgacgaggaagccgcgctgcgcgcgctgctgccgatgctggccggtacgatcgagaccgcacgcgacaaagggctcgcgaacgcgctctcgggccccgtgtcgcgcggcgatacgggcatcgtcgaacgccagttggcactgcttgaaacgctcggcggcgatcacgcgacgctgtacgcgttgctgacgcgccgcgcggtcgcgctcgcggcgcagcgcgcggcgccgccggcgtcgctgccggcactcgccgaagccgtcgaaacgtcgctcgcgcgcacggccgcgcaccctccccgtcgcgagacgaggcgtgataaggtgtcggccgatgcgccgccatccggcgttggcggccgcacgctactgaccgtataaaaggatgccaacgatgttcggcgagatcgcccgttttctgctcaataccatcttcacgctgttcggcgccgcgctgatcctgcgcgtctggatgcaggccgtccgcgtgccgccgtacaaccccgtcacgcaggccgtgctgcaggcgaccaactggctcgtgctgccgctgcgccgcgtgatcgcgggcgtgcgcggcatcgactgggccagcgtcgtcgccaccctcctcaccgcgctcgtctacgtcgtgctgatggtcgtgatggccggcttcgacccggctgcggtgatcgcgacgctcgtcgtggtcgcgctgctcaccgtcgtgaagtgggcgctcaatctcgtgatctggatgacgatcctgatggcgctgctgtcgtggctcaacccgagctcgccggccatgccgatcctctaccagctcaccgcgccgctcctgaacccgctgcgccgcgtgatcccgaatctcggcggcatcgacctgtcgccgatcctgctgttcctgatcgtggaggtgctgctgaggatcgtcacgcgcgccgccgtgtcgctgacgatgttcggcatctgacgccgtcgcaccctacaccgccggcccctgcgccggcggtgcgccgagcgtgtcgatcacgccgaattgcgccggcatcatcgcgtagcacacgcgcaccttttcctgcgacagcctcgcgagcaagcgctgcgcctcgtcctcggtgacgatgaattcgacctcgatcgcgagcgaccctgcagttcgaagaagcggtcctcgtgcagcacgcgatgctggccgaagccggccatcgcgcgaaacgcggaaccgccggcgacgcccatccggttcgcctcctccagcagccattcccacagcggcttccagtgcagccggtgctgctcgtgcacgtagaagcgcaagaagaccctgtccatcgctccctccgatggcggcacgctcaggccgccgcgagccatgcgcgcgcggtccacatgccgagcgccgtcagcgcgaacgatccagtcaagtgtagggcagccaccgcaaacgcccatccgaattcgccctgcaacgcatgcgtcatcacttcgaccgaataggtcgagaacgtcgtgaggccgccgagaaagcccgtgatcacgaacagccgccactcgggcggcaacccgacgcgggtcgtgaacacgacggcggcgatgccgatcacgtagccgccgatcaggttcgcggcgagcgtgcccagcggtacggcgggaaagaattcgttgagcgcgaggctcaggaaccagcgcagcaatgcgccgagcccggcgccgacgaagatcgcgacgatcgaatagaacaagggcgctcccgttcgatgaagcggctggattcagccgccggccccggtcgcccggggtgatgtccggccgcacgcgggcggcaccggctgaactgtatgcggattcgcgtcgcgcctgcaacggccgccgccgggatgcccgcccgttcgcgtggcaggtacccgcccgttcacacacggtcacgcgcgttgccaggcggcgtcgagcgcgcccagcgtcgccagcgcgccgcccttcaggccgatcacgtccgcccggcgcgcatgcgcttcgcgcgcgttgatgcggatcacgtcggcgccgagccgttcgctcagcaggcgcacggtcgggatcgcggtgcccgcgccgatctcgaccacggcgacacgcccggcccgcgcgatccagtcttccagcgcgcgttcctgcgcgtcgtagcgcgcaccgagccagccggtatcaccgaacatcaggatgttcggtcgcgcgaggccgccgcagcgcgggcagcgcggcatttcgccgacgaggcggcaggtggtttcgtcgacgtccggcacgaacggcgccgcatcccacgtgtcgtccgagcaggggcgcaggcactgcatggcgtggatcgaaccgtggatctcgacgatccgcgccggatcgaagccggctttctggaactggccgtcgacgttgctcgtcaggacgaagccgccgttcggcatcgcgtcgatccagcggcgcaggatcgcgaagcccgcatgcggcaccgtcgcacggtagagcgcgaggcggtgcccgtagaagccccatgcgagcggcgcacgcgcgcggaacgcgtgcggcgatgcgatctcgtggaattcgaagcgctcgtggcgcagcgccggatacgcgcgccagaacccgtccgtgccgcgaaaatcgggcagcccggaatcgacgccgataccggcgccggccgtcacgagcaatgcgtcggcgcgcgagcgcggcaacggcggaagcgacgagatcggcgggcagttgcgcggcggcagtcgcggcagtgaaatcggcggaatcggagagcggcatgacggggcgtcggtggcgtcggacggtgcgcgggtggcgtcgcgatcatacgccggttcgcgcgcggcgcggcatgcatgacatgcacgatgcaacggcatgacgcgacgctcgcccggccgcgggcggtgggcgagcgatccgcggagccgcctgcatcgccatggccgggcgcctcccgcctgttcagcgatccggatcgtcctgcgcgaccggaatgtcgtcgaccgagaaatagacggccttgccgagctgccgcgcgagggcgacatccgcgtcggcgccgcgcgacgcgccgtcgatccggcataccgcatcgcagcggcgcagcagccggtgcgcggccggatacaggaacgcctcgctgactgcatcgccgacctgtcgcgacccggccgcgacggcgagcggcagcgacacccactcgccgatcatcggcacatgcccgcggcgatacacggcgagcgccgcctcctccagccggtgcaggttcgcggcgatgcgcgcggggtcgccgtccgtgccgctgcggtaagggccggcgaccagcacgagcagcggcgtcatgccgtgcgcgcgccggcggtttcccgcagcgcgacgtactggagcagcatgatcgtcttcgcgtcgacgatctcgccgcgctcgaccgcatccagcgccgcctgcagcggcatctcgacgacctcgagatcctcgccctcctccgcgacgccgccgccgtcgccggtgcgcagcgacgcatcgtattcaccgacgaagaaatgcagcttctccgtcaccgagcccgggctcatgaacgcctcgaacaccttgcgcacgccgcgcacgcggtaaccggtctcctcctcggcctccgcgcggatgcgcgcttcgggcgtcgcatcgtcgagcaggccggcggcggcctcgagcagcatgccgtcgtgtccgccgacgaacgccggcatccggaactgccgcgtcagcagcacgtcgccggtatcggcattgcgcagcaggatggtcgcgccattgccgcgatcgtaggtctcgcggctcaggcgctgccacgttccgtcgcggcgcaggaaatcgaacgtcaccttcttcagcacataccagtcatcggacagcaccgtcgtatcgacgatgcggacacggtcccgcgttgcagccatcgcagcctccggttcgacaaaagacggcgcccatggtaacgtgcagattcgtgcaattccaagaaaattcgtgcaaacccgatgctgacgacacaacgcaagaaagcgatcctcgacgcactcgcgcgcgacggccaggtgctggcggtcgagctgagcacgcaattcggcgtatccgaagacaccgtccgccgcgacctgcgcgagctcgcggccgagggcctgctgcagcgcgtgcatggcggtgcgctgccggcgtcgccggccgttgcgccgttcgcgcaacgcgaaacgctcgagacggcggaaaagcggcgcatcgcgcgccgcgccgcggagatgatcgcgcccgggcaggtggcgatcgtcgatggcggcaccacctcggcgctgctcgtcagccagttgccggccgacctgcgcgcgacgatcgtcacgcacagcccgagtgtcgcggtggcgctcgccgcgcatccgtcgatcgaggtgatcctgatcggcgggcggctctacaagcattcgatcgtcgccgtcggcgcagcggccatggaaggcattgcgcgcatccacgcggatctttacttcatgggcgtgacgggcgtgcacccggttgcggggctcagcaccggcgatttcgaggaagcggcgatcaagcgcgcactggccgaacgcgcggccgagaccgtcgtgctcgcgtcgcagtcgaagctgcgcgcggcgtcgcagttcgtgatcggcgagctgacactggcgcacaccgtggtggtcgaaaggaaaccgacgccgcgttgacgaagccgatcgaagcagcgggcgtgacggtcgtgcgcgcgtagcgtcggttgtggccgtggcggatggcccggatatgtccgtcgtatcacctgcgtgctttcatcacgccaaccctcgccgatgtcagcgtgctgacagcgtccgcttgctaacatgggcgcccgcccaatcgccacgcaccgcacgcccgatgccaccgccctccgccacctcctcgtcggcgccgcccgcaggcaatgcgccgccgcccggcgtcctcgcactgttcattgcgttctcgcagatcggcctgaccagcttcggcggcgggctcagcggccggatgatgcgcgacttcgtgtacgagcgccgctggctcgacgaggaggcgttcctcaacggcctcgcgctgtcgcaggcgctgccgggcgtcaacgtgaagaacctcgcgatctggatcggctaccggctcgccggatggcgcggcgccgtggccggcttcaccggcatcatcgcgccgccggccgtgctgatcgtgttgttcggcatcgcgttctcgaccctcacgcgctttccgctcacgcacgtcgcgctcgccggcgcggcggccgcggcgatcgggctgtcgatctcgatggcgatcacggccgtgcgtcggttgccgcgccgcgcgctgccgttcgcagtgacggcgctcaccttcgtgtcggttgcggtgctgcactggccgctggtgtggaccgtgctggtcggcggcacactgagcgtcgcgctcgaataccgccgcgcggccgccacaccggccgggcgcgacacacgatgaccgcatcgcaacgctacgccgcgctgttcggcgtgttcgcgccgctgtcgatcgcgacgatcggcggcgggcaggcgatcatcgccgacatccagcggcaggtggtcgacgtgcatcactggatgaccgccacgcaattcgtgaacgatttcgcgatcgcgcgaatggcgccgggccccggctcgctgctggcgacgctgatcggctggcaggtggccggtttctggggcgcggtgatcgcgacgctcgcgctgttcggcccgacggcgttcctgatctacggcgtcgcgcatctgtggcggcggcaccagggcgcgcgctggcagatcgcgctcgaggccggcctgcgcccggtcgcggccggcatgatcctcgcgtcggtgtgggtgctgctgcaggcgctcgacggcggctgggccgcgcgcgcgatcgcggtcgcgtcgacgctgtgcgtgatgtatacgcgcgtccatgcgctgttgttgatcgccatcggcgcgctgctgctcgtcggcgtgcacgcgatcggcggcgcgtagcgcacgccgccttgcaccgcggaaccgctcgggcacatgaacgcagaggcctgttcacgccaatggcgggcctgcgccggtcctacccgccgcgaaacaccggcgcgcgccgctccgcaaacgcgcgcagcccttcgtcgaagtcctcgccttcgcacgcgtgccggcgcaactcggcgatccgttcgaacgcgtcggccggcaacggccgcgcgtcctgcagcacgcgcaactgctccttcaccgcgtgcaccgcgagcggcgccttcgcggcgatcgtgcgcgcgacgtcgagcgccgcctcgtcgacaccgcctgcttccgccagccggttcacgagcccgtgatgcgcggcgcgttccgcatcgagcggctgcgcgcagaagaacatctccttcagcacatggatcggcaggttgtcgaggaagcgcagcaggccgctcgtcgaatacggcaggccgatgttcgcgggcgtcatcgcaaaacgcgcatcgcgcgccgcgaccaccaggtcgcagctcatcacgagatcgaccgccccgccccacgccgaccccgacaccgccgcgatcaccgcacccggataagtccgcacgcgccgcagcgcccgttcgagcggcttgccgtacgcgagcggatcgcgatcgtcggccagctcgcgcagatcgtgccccgcgctccacacgtcgccgctgccgtcgttcgacaggatcacgacgggcggaggtcggtgttcggccaacgcatcgaggcgtgcgacgagcgcatcgagcaacggcgcgtcgagcgcatgccggcgcgccggattcgcgaaccgcacgcgcgcgatccggtcgccgaccatgtcgaccgtcacgcgcgacgcgccatcgtgtttcgtcgtgtcgctcattgcacggcctccgccaccgcttccgcctggaagatcgcgcgcccggccagcagcgtgtcgatcgcgtcgtcgtcgtagcccgcttcgcgcagcacgtcgaccgtatgctcgccgagcagcggcggcgcatgacgcgtgcgcggcgccggcaccgcgtccccatcccgccgagcggcgtgacgacctggcgcagcgtgccgagcgtcggatgcgcgaccggttcgaccagcccgcaatgcgcgagctgcggatcgtcgaacacttcgtcgagcgtgttgatcggccccgccggcagcccggcgtcgacgaaacgttgggtccattcgcgcttgccgcgggtgcgcaaccggccttcaagcagcgctttcagttcgtcacggtgcgcgacacgcgcatcattggtcgcgaagcgcggatcgtccggcagttcgggcagatccagcaactggcacagccgaagccacatgtcggtcgtgatcggcgcaaggttgagcggcccgtcggccgtctcgaacacgccgtacggcgcgatcaccgcatgcgcattgccggtgcggcgcggcacgtcgccgaggctcaggtagcgttgcccgtgcacgctcagcagcgacacgaggctttcgagcagcgacgtgccgacatgctgcccgcgccccgtgcgctcgcgctcgaacagcgccgccatcacgccggtcgcgacccacatccccgagctgagatcgccgatcgcggtgcccgtgcgggtcggctcgccgtcgggaaaaccggtgaggctcatcagccccgcgtagccctgcgcgatctggtcgaagcccggccagtcgcgcaacgggccgcgcgggccgaacgcggtgacgctgcccatcacgagccgcggatcgcgcgcgctcagcgcggcgtaaccgagccccatcgcgtccatcgtgccggccttgaaattctcgatcacgacgtcggcctgcgcgatcagccggcacacgacgtcgaggccggccggctgccggaaatccacgcagatgccgcgcttgttgcggttgcaggacaggtagtacgtgctcacgccgcgatcgaacggcccccacgcgcggctcatgtcgccgtgcggccccgactcgaccttgatcacgtcggcgccgagatcggcgagcaccatcgagcagaacggccccgacagcgctcggctcagatcgacgaccctgattccttgtaatgcctgcattccggactcctgatattgatgactgggtgtggcttgtttccgaacgatcgcggcgcaccgctcattcgggcagcgtctgatggcgcgtttcgaccgcgaacggcaggatcaggatgccgagcccgaacgcggccgcggtccatgcaaccggcacgccgagcgatccgtaaccgtgaatcgcggcgccgagcaggaagttcacgcctgcgccgatgaagcggccgaccgacgcgttgaacgcgaacgcggtggcacgcacgcgtgtcgggtactgctcgggcagccacaacgagaagatcgcgaaattgccgccgaagaaaccgaggaacgcgagcgacaccatgaatgccgcgagcccgttcggctggtagaacgcccagccgaacgcgaacacgatcgaaccggccatgcccgcgaaatacacaccgagcgccgtgcgccggcaagccgttcggagagccacggcgcaaccaggcagccggcgatcgtcgcgcacgacaggatcgccgcgccgatcgacgcgagccgcagcgcgccgatgtgatcgatgcccgcgcgcgccgccagcgtcgtgaccgcgctcgcctcgtacaccgagccggcccacagcccgacgatcgcgacaccgaccaggctcgcgctcgtcagcgtgcggcgcaggaaggccggcgcgaagatctcgcgcagcggatgcgcgcgccgcgcgtcagccacgtcgccgtcgcgcgcgtcgtgccggcgccactggccgggctccttcacgcgcatcacggtgaacaccgcgagcagcgcgggcgcgagcccgcacaggaacatcgcgcgccacccgtaggtcgcgccgatcgtgtagttcaggcacgccgcgatgaagaagccgaagtagtagcccgtctgcagatagccggcgcccatcttgcggcggtcctccggccagctctcggccacgtaggtgcccgcgagcgcccattcgccgccaacgccgatcccggcgatcaaacggcacgcggccagtgcccacacgtcgtgcacgaacgcggccgcgccggtgaacaccgagtagatcaggatgctcgcggcgagcgtgcgcacgcggccgaagcggtcggcgagcggcccccagatgaacgacagcccccagccgatcaggaacagcgcgaacaggatcgagccgtacatcccgagattcgcgggcgtcgccgcgatgccggacgccggcagcagttcggtcagcgcgggaatcagcacgagcgcgtagatcaccgaatccacgccgtcgagcacccagcccgcatacacggcccagaagcccttgacctgctcgcgcgtgagcggcgtgcgccgcggcttcgcgccggccgccggcgcgtcgatcgccttgaacatcttcgtctccttgccggcggggccggcactttgccgcgtccggttcgggatggccggcaggctggctcttgtgtgagacgagtatagaaaccccatcgatcggggaaaaatatgatattcatcttgctcgatcggattagcttatggcttgaatcgggaggcggcggcgatggacttgaggcagttgcgctatttcgtgaaggtcgtcgaatgcggcaacgtcacgcatgcgagcgaggcgctgcatgtcgcgcagccggcggtgagccagcagatgcgcaatctcgaacaggatctcgggatgcagctgctcgaacgcagcgtgcgcggcgtcgcgccgaccgccgccggccgcacgctgtaccggcatgcgctcgaactgctgcgccaggccgacggcacgcgcgagctgctgcgccgcgatgccgacacaccgcagggccgcgtgacggtcgggatgccgtcgagcaccgcgcgcgtgctggccattccgctcgcccgcgcggtgcgcgaccgctacccgggcatcatgctggaactgatcgaggcgccgagcgccgatctcgacacgctgctcgaacgcgcgcggctcgatctcgcgatcgtcgtcgacgcggtcgagacgcgcggcatcgcgatccaccggctgctgacggaaacgctgtacctgatcacgtggcccgaattcccggtgccggacgatcccgtgccgctcgacgcgatcgcgcggatgccgctcgtcctgccgagcgcgccgaacacgatccgcaaccgtgtcgaatgggcgatgcgcgaggccgggctgtcgtacgagatcggcttcgaggcgagctcgaccgggctgctgttcgcggccgtgatggcgcagctcggcgtgacgatcctgccgtggacggccgcgcacgtcgagatcgaggagcgcaagctcaagctgtcgacggtcgcgcaccggctgttcgcgcgcgacctgtcgctgtgctggcacgatacggcgctcgtcagcaacgcggtgcagaaggtgaaagccgagatcgtccggctgttcgacacgctcgggcagcggccggagtgggcggccggcaacaccgaccgcgcatgactggcgcggcgcatgccttgtattgccccgccgcgcgtactaggctgctttcgttgtgggtatcgctgacacctccacttctcctcgccgctcggtataagcgtcggggaaggaggccgttcgtgtccccgctccagtctgcctggcttctgctgggcgtcagtgtcctcgccgaagtgctcggctccgtcggcctcaaatactcggccggcttttcccgcccgctcccgtccgcgctcaccgtcgtctgttatgcctgcgccgtctggctgatggcgctcgcgacgaagcggctcgaaatggggctcgcgtacgcgagctgggctgccgccagcaccgcggccacggccgtgatcggcatcgtctgcttcgacgaagcggtgtcgtcgctgaagctcgccggcatcgcgctgaccgtttgtgcgctcgtcgcgctcaacctcggcgaggcggcgacgcactgaccggtggcctgccggtcgtcgacgcatgggcgccaggggcattgacaccgcccccgcgcgccccttaacgtttcgctcatcgtaaccatcaccggttcagcttaagaggttgtcggcccgctcgtgctcgacacctccgccttcatcgaaggcctgctgcttggcgccggcctgttcacgtcggtcggccccaaggacgccttcgtcatcaagcgctcgatctcgagccccatctcctctccatcgccctcgtctgcgcaggcagcgacgcgctgctgatcgtgctcggcgcgcaggggttgtcggcactgctgtcgcggcatcccggtgtggtatcggccgcgctgtgggccggtatcgcctatctcgccggttatggcctgctcgcgctgcactcggcgatccggcggcggcggccggagcacgtcgacgactcacacgcgcgccacacccccgcgctgtcgcgcacgctgctcgcgacggccgccgtgtcgctgctcaatccgtatgcgtggatcgataccgtgctgctgctcggcaccgtgatcgtgagtcacgcgcccgccgaacgcgcgccgttcgcgttcggtgcgatggcggcttcgctcgcgtggttcctgatgctcgcctatggcgcacgcgcgtgtcgcgcgtggtttgcccgtacgctggcgtggcgcgtgctcgatttgttcgtcgcgacgatgatgctcggtttcgcggtgcgtttcgcgatcgacgcgctttagcgcttcgggtgtcaacggcccgataccgcgcgaaacgcgcgatgcgcgccggcatgcagttcgaaaccgatgcccgacgcctgcggcgtgcgcgcaaaacctgcgtcgacagtttcgccatcggcgagcccgctgaacggatcgaacgcgaacggattgacttccgcaccgccgagcccgagcgctgcgacgacatgcagcgagaacaggtggccgccatgtggccagaacgcgtcgcgccgccagccgcgcgatgcgaagtgctcgacgatctgcaggtatcccggcagcccgtagcaatgcaccgggtcgaacacgagtacgtcgcggtcgggacgcaggccgccgtagcggtcgagcagcttcgcttccgcgagcgagaacagcgcttcgccggccgcgatcggcggagcgtagcgcgtggcgacgcctgcctggagcggcaggtcgagcggatcgcagatgtcctcgaaccaccagaggccgaacggctcgagcatcgcagcggcaatatcgacggtcgtcgcgtcgtacgtgttcatcgcgtcgaccgcgagatgcgaactgtccgccaactgcgtggcggccgcttcgatgcgcctgctgtcctgagcgacgtccgcgccaccgatcttgatcttcgcgtgcgtgtagccaaggtcggcaatgcggcgcatctcgtccgacaggcgcgcgagatcgtcgtgcggataacgatagccgccgcccgcgtacacacgcacgcgcggtgccgccgtgcgtccaagccggtcggccagaaagcgattgagcggcaggtcggcgattttcgcggcggcgtcccagatcgccatgtcgagcgcgccgatcgccacgcagcgttcgccgtgtccgccgggcttttcgccggccatcatcgcgcgccacgcgcggaacgggtcgaggttcgtgccggcttcgtcggcgagcgcgtcggcggcggccagcaggcgcggcgcgaaccgttcgcggatcaggccgccctgcgcgaagcggccgaccgatgcgtagccgtagcccgtcacggggcggccgtcacgcacgacgtcggtggtcagcgcgacgacactcgtcgtcaggccgccggatggaatggccgggtcggcatagcgggagacgggaatcgtgcgttcgcggatgtcggtgatacgcatggtcgggattccggggtggcgaccggtgcaagcgaacgaggtacgcgatgcgaccggaacggtgggcggatcgctgcatcataggggtttgggcgatgacgcgcaggacggcgcggcgatcgcctttcgaatcggccggcgcaccggctggacggaatgcgccggtgtgtgccggcttgaacgagcacgcggtcgaccgcgtcgccggggctggcgctttgaccgcgcccctcgatacgaatgccccggcccaccgcgcacaccgcatcggctacgctgtcgcgcgaaaacgtgcagtcgcacggagagcgggcgcgaacctcgaaggtatccggacgacgacggtatgcgtggtcgaatctaccggcccgctcaggcaaagacgaagtacttgcgcaccgtctccaccacttcccaggtccctttcatgccgggttcgatcacgaacacgtcgccggctctcaggtgcaccgactcctcgccttccggtgtgatgatgcagtagccatcgaggaagtggcagtactcccattttcgtagttcacctcgaacttgcccggcgtgcagatccaggtacccatgatcttgctgccgtccttggagaggtacgcgttgaggttcacggtgtgcggatcgccgccgatacgcttccacttggtcgcgtcaaggaccggcgtcgggcaggtttcgcgcaaaacggtgatgaaatcggacatgtcagctccagactaacgttcgtgtaagaggcttgtcacgttagtgcgaaagcgtggtcgggacttgcatgcttccgacaccgactcgtctattttcgacaccggcccgcgggcacgcggccggcgcgtttcgttcggcgttggcgctgcggtgctgcctgacgatgcggtcgtgctttgacagtaaccggtgcgcggacaaggctctcctggcaggccccgtagcgtcggtcaggcgacaggcttgggaagtaagtttcctcctccgccggaatgctgccgtcccggtaacgcttgtcttcccacagcagccgccagcgcaccgcatgttcgtcgttggacccttccaacaggtactcgtgggcaacactggaccggccagagcttcatagacactcacgggccgtttaacgcgtagcgccgctcgaactcaatcggtgaaagatcgcgggcggaaccatgccgacgaaccgggttataaaacatttcgatgtaatcgaacaagtccgaggtcgcggtcgcccgactcggatagatgagccgcttgattcgctccttctttagggcactgaagaagctctcggccacggcattgtcgtggcaattaccgcgccgactcatgcttggcaccatatggtgtgccttcaggaatgactgccagtcatcgctcgtgaattgactgccctggtcggaatgcaccatgacaccgggtcccggtttgcgtttccaaaccgcagccaacagcgcctgtaaaaccagatcgctggtcatcgtcgagcgcgtagcccaaccgacgatctggcgcgagtacagatccataacagccgccagatacagccagccctcgtaggtccggatgtacgtgatgtccgttacccagacccggttcggtgcggttggcgcgaactcacggttcaacacgttgacgattacgccgaccggaccaccccgatagcggggcttgctgccatagcccacttctgcccgcagaccttcgcctctcatgaggcggtggacgcggtgacggctgcacgtttcgcccgattcacgcaatccatcgtgaccttgcggtagccatagacgccgccgctggccagccacgcatgcttgatcagaccgagcaatcgctcatcctcacgcttgcgggccccgactgtctgccgctgccagacgtaatagccgctacgatgcacgccaaggacccggcacatcgagtgcaggcggaactcgccgagatgggctcgcatgaacgcgtaccttgccgctatccctttgcaaagtacgccgcggctttttagaatgtcgcgctcctcggtcacgcgtttgagctcggccttcagtcgccgaacctcggcgctctgatccagctccgcttgccgcacgacgtcgggcctgccgaacttcagtttccaggcgtaaaggctgtgggtcgtgatgcccagccgctgcgccacatccgccaccgaatgaccccgttcggttacctgtttgactgcctcgatcttgaactcatccgtgtaccgcttgccgctcgtcctgacctcctcggttgccataaattatggctcgaagatgtctacgaaaggctggccggtccatgtcgatgtagccgaagtgctttaggtcgaatgccgcgccgattacttgcccttggctgccgccgagaacgcaacttagttcgtgcagggtcatgcccggaaatgcattgatcagtccgagtgctctggccgccatcggcgtcatctgcaacgcgctcgcgagcgccgacgctcgacatccctcataggcggtcatgaaggcgtgaaaccgggaaagaggatcgttcgtggtcataggtcgttgatttttctggattggcccttgcccgagagcgttcgttgttatccccgaccgctcaggcatctccgcacgatacgtcacccccgacaaattcaaccattttggaatattaaattccaatgtggttgttcatctcaatcggaatgaagtcgaccatatcgtcctatgactactcgccctacatcgccgaccgacgacgcccaagacgcgctgcttgccgcccgcgttgggaccgctattgccgaacaacgacgcgcccgcggcctgacacaggcgaagctggcagagatgatcgatctggaacaggaagcgataagccggtgggaacgcggcacacggatgccaacattgcatcggcttcagcagcctagcgatgcactcgactgctcggtcgatcagctattacaacgtggatcgagacggcccgatgaccaactggcaatgattgcggctgcactcgatggattggatagcgacgagcgcgaactcgtcgtgaatttcgttcagcagttcgccgacatgctcggggccaagcatcctcgtcggggacaacgcaagaaatagcaccagccttggtatcatcggccaatcactagccgatatcatgctgtcatgccaattcccggttatcaatctctcatgctgccagtacttgaactagcagccgaccaacaagaacacaggtttcgagacgttgtagaaactttggctggcaaatttcagttaactgacgaggatcgcaacacgctcctccccagcggaaccgccccgttgttcgacaaccgggtgggatgggcgcgaacatatctgaaacaagccggactagtcgagtcgaagaagcgaggcttttcaacatcactagtcggggtctggccttactcgcacaacacccgacaaagatcgacaatacagtcctcgatcaattccccgagttcgcggccttcagacaaaagaaggtcgacgactccccagtggtcaaaacaagatcctgtcgaccaaagtttcacctcccctgtcgattccacgcctgaagagttgttcgcacaagcatatcaacgactacggggaaccttgaagccgaattgcttgagcagatcaaggactcaacaccggcgttctttgaacggctggtaatcgacttgctggttgcgatgggatacggcggatctcgtcaagatgccggaagtgtcatcggcaaaagcggcgacggtggtatcgacggcactatcaaggaggacaagctaggcttggacgtcatctacgtgcaagccaagaaatgggaaggttcagttggccgtcccgaaatccaaaaattcgcgggagcactgcaagggcagcgcgctaacaaagggtattcatcaccacgtccacctttactcgcgaagccaaggactacgcaagcgcgatcacgtcgaagatcatcctcgtggatggcgagttgctcgttcaactcatggtagatcatgatgtcggggtttcaaccgcgagcagctatctgatcaagaagatcgactcggactactttgacggcgacgcgctttgatcgtaggcagcccatgctgcgtcgatcaatgctgccgggacatcgcccgtctcgtaacccggcacgtcttccagcagagctagcagatggttcgtgaactcggcacgcgagaaattgccgccgaacgcgtcttgaacagattccgccaatcgttgaatctgggctggcgtgagcggtgggaaatcgttggggtgtttgatgtcgtccatacgacggctatccggcagttcaaacggccgagacaacaacaagcgtccatagagacagtgcttttgcctttccgtgtcaggcaaaaccaaaggggaccggcgatgcgaccgaacattagatgtgcccgctccactggccgaaagttctagtagcagcttccacgtcctacggggataatacggggcaagacgaacgaaggctacgaagccctcatgatggtgacagatggtgaatgaattgacgcaattactggaacgttcgcagcagattgccccggcactcagctttgccgacacggcgcgccgcgaaatctccccggccttgatcccaagctacgcagcaagctaggtcagtttatgacaccagccgccgttgccacattcatggctggaatgttcgaccatctccccaagaccattcgtctccttgacgcgggcgcgggtgtcggctccctaactgcggcttttatccgggaaatcatcagccgaaaagaccgtcctcgatccgttcacgtaaccgcctttgaggtcgactcgctccttgggcgataccttgcagagactctaaccgcctgcgctaacgattgcgaggaagcaggaattgcctttacatcttgcatcgtcgcggatgactacatcctccattccgccgaacctctcctgtcaaagcattccgagtgccagcaatacgattgcgccatccttaacccgccttacgcgaagatcaacaccggctcaacggcgcgcaaggccttgcgtagtatgggcatcgaaacaacgaacctttatacagcttttgttgccgtcgcccttgatcagctcaagcccagcggtcagttagtagcgatcacgccacgcagcttctgcaacggctcctacttcgagccgttccggcgcttcatgttggagcactctgcgttgcgtaagattcatgtctatgagtcccggaagcacgcattcaaagatgatgatgtcctacaagaaaacatcatctatcaacttgtcaaagcccagccgcaacccacgacggtcagtgtctcgttgagtcaaagccctcaagacctcgacgcgacagtgcgcgatattccgttcgcggaggtcgtgttgcccaatgatccgcatgcgttcatccgcttagcgatctcagaggaagacggcgatcttgcccaacgtgtccgcggacttccttgctcgcttcgcgacttaggcataactgtctccaccggccgcgtcgtggatttccgcgcacacgacttcctgcgcagagacccggaaccgggtagcgtaccgctgatctatccatgccattttaacgagggctatgtgtcgtggcccaagcctggtgcgaagaagccgaacggccttgtactgaacgacgcgacagcggcattgatggtcccacgcggaacctatgtattgaccaagcgcttctcctcgaaggaggaaaaacggcgattggtagccgtggtctatgaccccgcacatcgaagcagaagtggtgggcttcgaaaatcacctcaactacttccacttgaatggtgaggggcttccacgcgaccttgcgcggggactcgccctgttcctgaactcgacggcagtcgaccagtatttccgccagtttagtggtcatacccaagtcaacgccacggacctgcgcaacctccactatccaaccgtggaacagcttgcgcaggtgggccgccacttcgacgaagccctttcggaacagcaacggatagacgcgattgtggaagcccttctgtaagacctactcgaaggaaccgacccagaagtgcttggctggatcagattgaatccagatatagctgccgacagcgacgtttccttgggcaccttgcctagaggcggcctccttccatgttgggtaagcggtggtgaagtcaatcccagcttttccacaacgcgccgcaagcaaccgaagctgattcaccttatgaaggtccacctcgccgtcgctggtcacggcctcaatgacccaaagcctgtccgtctcagggttccatagaagcacatccggcatagcgtccccaagtcgcaactcaatacccgctcgggacaacacttcccgatcctcgtcggtgatccgatcgccatcgccgtcatcgacgtagacaacctcaaaaccgggcaagaaacgagccgcatagtgctcaatgctcgcccggatgagatcgctgtgcccggtatcaaccaattgcctcgatgcttctgccatcgcggcttgaaactccggcgccttctcgctgcgtcctgctgcgcccacgtggcaagcatcccaggccactggtcatcgggggcttggaggatcgccttgaagtcctccaccagccgataggacgaattaggtgacttcgcaacgacatggccatgaataaactcgtggccgtgaagcaaaattggttcgattccgcccagttctcgaagcggcttgatccagtagtcacggccttcgcgatctagcttcccactccctcgctgaagaatgccgatatgacaagcaagatgcgccgtgcttgccccgtgactgaacttcgtcccggccgcagcctttgaaaaccaactgtctgtctggtcgtcgaggagtgcaaacaccccatcaacgagatcggcgttatcgccaagatcgagacgcccgagaactcgtctgatcttttccttcgtaactccctgaagcgccgccggtacggccacgcctccgttttgtgttcgcgccgcgcgcaacctcgctacatcgtcatgcaacgccatcccgtaccccacgctgtttatcaacagcgtgtgatggtatgagccacgagagaacgtgtctatatctggcagttaaaattcgggcagaacgagtaagggaaaaatcgcatcgcgcgccagcgacgccaccgctccagcatcgagcgatgccagtttcgatgccagcggccaaaacgccccgcttgccatcccgccccgaacccctgtagaattgcgcgttctgcgggcgtcgtataatggccattacctcagcttcccaagctgatgacgtgggttcgattcccatcgcccgctccactttccggctgcatcgcagcctgcgcaaaagccgcctcgtcgaaggcggctttttgtaccatgtgccgggtcacccggcgcactgctgcgcgcaacgggccctcgcccgcaaccgagcctttctctgtaccgatgatgcacgacgatccgaacgaagccggcctgccgccgcacgacgacgccattcccgacgaagccgccgaaggctcgacgccgtcaatccgctgcaccaccgccgcatccgcagcttcgtgacgcgcgccggccgcgtgtcgaccggccagcgccgcgcgctcgacgaactcggcccgcgcttcgtggtgccgtatgcgccggagctgcccgactggaatgcggtgttcggccgcagcgcgccgcgcatcctcgagatcggcttcgggatgggcgcatcgaccgcggaaatcgccgcgaaccgccccggcgacgacttcctcggcgtcgaagtgcacgagccgggcgtcggcgcgctgctgaagctcatcggcgagcaggatctgccgaacatccgcatcatccagcacgacgcggtcgaggtgctcgagcacatgcttgcgccggaaagtctcgacggcgtgcacatcttcttccccgacccgtggcacaaggcgcgccaccacaagcgccggctgatccagccgccgctcgtcgcgcatctcgcgtcgcgcctgaagcccggcgcgtacattcactgcgcgaccgactggcagaactacgctgaacagatgctggaagtgctcggcgcggaaccgacgctcgaaaacaccgccgccgactacgcgccgcgccccgactaccgcccggtcacgaagttcgaacggcgcgggctgcgcctcggccacggcgtgtgggacctggtgttccgcaagcgcgcaggctgagccttcccgctgcggcggcgcatgccgcccgaatccggataaaaagcccgatcggttatctgccgatcgggctttctcatggaagcgcgcccgcctccgtgtccgcgtcacgcccagttcagccagccgctgtacccgaccagcagcacgaacagcccgaacgcgatccggtaccacgcgaacaccgtgaaatcgtgcgtcgcgacgtagcgcagcagccagcgcacgcacacgaacgcgctgacgaacgcggcgacgaggccaagcgcgaacaggccgagcgaatcgacggtgaacgcctgccagtccttgacggtttcatagagcgtcgcgccgaagatgatcggaatcgcgaggaagaacgagaattcggtggcgacgcgccggtcgagaccgaacagcatcccgccgatgatcgtcgagcccgagcgcgacatgccgggaatcagcgcaaagcactgcgcgatgccgaccttgagcgcatcgagcggggtcagcgcgtcgaccgacaccacgcgcggcggctcgctgcgttcacgctgccgcgcctcggcccacaggatgatcgccccgcccacgacgagcgcgaacgcgacgggtaccggcgagaacagcacggccttgatcttcttctcgagcaggaggccgagtgcgatcgcgggaatcgtcgcgatcacgacgttcagcgtgaagcgccgcgcatcgggccggctgggcagcccggatacgatggacgcgatccgttgccggtattcccagcagaccgcgagaatcgccccgaactggatcacgacgtcgaaggtcttcgcgtgcgaatcgttgaaattcaggaagctgcccgcgacgatcaggtgaccggtgctcgacaccggcaggaattccgtcagcccctcgacgacgccgaggatcaaagccttgcagatcaggatccagtccatccgtggcccaactccgaaatggtcgaatgaatgggccactcttccgcgcgcggccccctccggccgggcgcggttcgtcgtcacttttcgacgatcgccacgcgtatgccgtttgtaagaatcgtaattgtaccgggttcgtagttcaccccggcaaattgcagctgttcgggcttgaacgtgtagatcggatagttggtcagcaactgcgtcgcgagcaggcccgcggccgcgccgacctgttgcgcgtacatctgcgcgtcgccgtcgagcgcgaggctgtcgacggccggcgacttcagcaccaccgaacggctcggtgcatcgtaagcaagctggcccgacacggtgaacttgccgctgacgggcgcgcgcaggaacgggctcgcgaaatgcgcgtcgaactgcacggcgacgcggttctggtcgggcagcaggttgacggccgggttcgcgagcgacacgtcgacgacctgcgcgaccgtcttctggtacgggaacttgcgggcgacggccttctgcacgtcgccgcgcgagaaggtgtagtgatcggggatgaacgggaaggtcgacgcgcacgcggcgagcgacagcgtcacgccgacggcgccgacggttgcggcgaggaaacggcgccggccgggcgcgcaaggtgcggtcatgctgaacactctcctggttgcgacggccgcgtcgcggcctcgagacgcgtgagccacgcgagcgcgtcgtcgcgcgacgcgccgcacatgtccgcggccggctgcagcccggaacagcacgcgggccgctcggggcggccgaagatccggcagcgcaggtcgtcgccgagctgcacgcagcgcacaccggccggcttgccgtcaggcatgcccggaatcgggctggaaatcgacggcgcgatgcagcacgcgccgcagccctcgcggcacgcatgcggcggcgggacatcggcaggcgccgggcggacaggcatttcgacggacactcggctctctcgaacgaacaacaaaaacggtgcggcaaccggacgcggtgccggcagccccatcccgcattgtgccatcgccggctgcgacgttattacacaatgcagcccaatcgcgcgtttatatactcgaaagcatctaaaagcgcgagaccaccatgcgttccggttctgccgactcaatgttccgtcccgatttgctcgcgaaatacggcgcgaacgggccgcgctatacgtcataccccaccgcgctgcagttccgcgacgatttcgacccggccgactacctgcgcgcggcgagcgacccggcgcctcgtcgagcgagctgtcgctgtacttccacatcccgttctgcaacaccgcgtgcttctactgcggctgcaacaagatcgcgaccaacaaccgccgccgcgcgcgccgtatctcgagcagctcaagcgcgagatggcgctgcaggccgcgctgttcgatcccgcgcgcccggtcacgcagctgcactggggcggcggcacgcccaccttcctgtccgacgacgaaacggccgagctgatggcggccacgcgcgagcacttcgcgctcgcgccggatgccgacgccgaattctcgatcgagatcgatccgcgcacggtcacgcccgccacgctcgtccacctgcgcaatatcggcttcaaccggctgagcctcggcgtgcaggatttcgacccggcggtgcaacaggcgatcaaccgtgtccagccgcgcgcgatgacggctgacctgctctccgccgcgcgcacgacggggtttcattcggtgagcgtcgacctgatctacgggctgccgcaccagaccgttgccgtcttcgcgcgcacgctggaaacgatcatcgaactcgcgcccgaccggctgtcggtgttcggctacgcgcacatgccgcacctgttcaagatgcagcggcagatcgacgatgcgacgctgccgccgccggaaacgcgcatcgcgctgctcggtctcgcgatcgacatgctgacgtcggccggctacgtgtacatcgggatggatcacttcgcgcggccgtccgacgagctcgtgcgcgcgcagcgcaacggcacgctgcaacgcaacttccagggctacagcacgcgcgcggataccgacctcgtcggtttcggcgtgtcgtcgatcggcaaggtcggcgacgtctacgcgcagaacgcgaaggacctgcccgcctacggcgccgcgctcgacgcgggccggctgccgatcgcgcgcggcgtgcggctcacgcccgacgaccggctgcgccgcgacgtgatcacgcagctgatgtgcaacctcgaactgccgttctcgcatgtcgaggccgcacacggcatccgcttcgccgatcatttcgcgcgcgagctcgacgcgctgcgcccgttcgagcgcgacgggctgctgacgatcgcgggcgaccgcctgacgatccatccggccggccggatggtcgtgcgcaacatcgcgatggcgttcgacgcgtatctcgggcagacgcagcagcagcggtattcacgcacggtctagggtcggccgggcgcaggcggacggccggtttgatacagtgtggggcttacgccccgccagaatccgcacgatgcgcaccaccaaagcgacccacgcggtcgaacgcctgaagacccgctccggcaacccgcatttcgcggccgtcgcaatggcgggcggcctgttctatctcgtcgaccgctcgggcggaaccgccgagaagcgctgcgagccgctgccgctcgacgagttcgtcaagttcgtcgacgaattcggccccaaaaaccgcgcaaggcgagcaagctcgacctcgcattcgaggcgcagatcaggaagagcaaggggtaaaggtctgttgcaggccgcctgaaggctttgcagccgccccgtttggtacaatcacgaagtttctctatccccgctgatggccgaccaggctgcgtgaccacaccatgaatatcgaaaacgcgcgtttcaacatgatcgaacaacagatccggccgtgggacgtgctggatctcgacgtcctgggcctgctgtcgatcgtcaagcgtgaaaactacgttccggccgaataccgcgatctcgcgttcgccgacctcgaactgccgctgccgggcggcaccagcaagatgctgttcccgcgcgtcgaagcgcgcgtgctgcaaggctggccgtcaagaagcacgagaacgtgctcgtgatcggcgccggttcgggctacctggccgcgctgttcgcgcatcgcgcccggcacgtgacggccgtcgagatcgatccggccatcgcgaagttcgcggaagacaacctgcgcaacgacggcgtgaccaacgcggaagtcgtcctcggcgacggttcgcgcggctgggccggcaaggcgccgtacgacgtgatctgcgtcgcgggcggcctgcccgtcgttccgcaggaaatgctcgagcaactgaaggtcggcggccgcctgtcggcattcgtcggcggccgtccggtgatgaaggcgcagatcatcacgcgcatcgacgacaagcagtaccgcgtcgccgacgtgttcgaaacctacatcgaccacctcgtcaacgcgatcgagccgtcgcgcttcaagttctgagcggcggagcctccatgcagatcctgaccgccgcgatgctcgcggaatggctcggcgacaaggcgcgccccgcgccggtcgtgctcgacgtgcgcgaaccgtgggaaatcgcgaccgcgcacatcgccggcagcgtgtcgatcccgatgcagcagattcccgcgcgcagcgaagaactcgacgacgaagcggaaatcgtctgcgtgtgccatcacgggatgcgcagcgcgcaggtcgcgatgttcctcgagtcgcgcggcttcacgaagctgtacaacctgcaaggcgggatcgacgcgtggtcgcgcgacgtcgatccgtccgtaccgcgctactgatcccgccggtggcgcatcgcgcgccgccgcaccggccggcacatcgccgccggtcataccgacccgccgaacgggcgcgcatggcgcgcccgtttttcattcccgcgccggttcgtctcggcgtcatccgacctgcgacggcaccgcgccgcgcccgcgccgccccgcttgccgcgaagtcatggtgcacgaccgttcccgcaccgcacgcggacaccggaacgggaaccccgaccgtgcaccatttccgcccgcgaccctgcaccgcgacggaccgcgcatgctgcacgacgcgtcatgcgccccgtcgcgacgccccgccctgccccgcgcgggcacgccgggcgtgcatccgcacgactggcacatgccttgcgttatccgttggccgacgccgtcaaggcgcacgcatatccaacacgtcaagggaacccgatgaaacgtcgcagtctgttgaagttcggttcgatggccggcgcgcttgcgctcgcgggcaagagcccgttcgcgcacgcggccgacgcgggcaccggcccgatcaaggtcggcatcctgcactcgctgtcgggcacgatggcgatctcggagacgtcgctgaaggacaccgcgctgatgacgatcgccgacatcaacaagagcggcggcgtgatgggccgcaagctcgagcccgtggtggtcgatcccgcgtcgaactggccgctgttcgccgagaaggcgcgccagctgctcacgcaggacaaggtcgcgtgcgtgttcggctgctggacgtcggtgtcgcgcaagtcggtgctgccggtgttcgaggagctgaacgggctgctctactacccggtgcagtacgaaggcgaggaaatgtcccgcaacgtgttctatacgggtgcggcgccgaaccagcaggcgatcccggccgtcgagtacctgatgagcgcggaaggcggcagcgcgaagcgcttcttcctgctcggcaccgactacgtgtatccgcgcacgaccaacaagatcctgcgcgcgttcctgaaatcgaagggcgtgaaggacgccgacattcaggaggtctacacgccgttcggccacagcgattaccagaccatcgtcgcgaacatcaagaacttctcgcagggcggcaagacgaccgtgatctcgacgatcaacggcgactcgaacgtgccgttctacaaggagctcggcaaccaggggatcaaggcgaccgacgtgccggtcgtcgcgttctcggtcggcgaggaggaactgcgcgggatcgacacgaagccgctcgtcggccacctcgccgcgtggaattacttcatgtcggtgaagaacccgaccaacacgaagttcaaggaccagttcgccgcatgggtgaaggcgaacaacctgccgggcggcgcgaagcgcgtgaccaacgacccgatggaggcgacctatgtgggcatccacatgtggaagcaggccgtcgagaaggcgaagagcaccgacgtcgacaaggtgcgcgtcgcgatgatcggccagacggtcgccgcgccgtcgggcttcacgctcgcgatggacggcaaccatcacctgcacaagccggtgatgatcggcgagatccgcggcgacgggcagttcaacgtcgtgtggaagacgaagacggccgtgcgcgcgcaaccgtggagcccgtacatcgcgggtaaccagggcaagccggacatcgtcacgtcgatcccggcgttcctgcgccggcagcgcacggcgctcgcctgacgcgacgcggggcgtcgcgcaccggcgcgatgctccgcccgcttgcaggcgccgccgtaccgggcacgcttgccgacgcaccgcaagcgcccgcgcatcgccgcctgcatccgctttccacgcccgacaggatttcccgatgcctacacgctttcgccgagccgccgtcgcgatcgtcgcgtgcgccgccctcgcgggcggactgccgcgcgccgcattcgcgctgacggctgccgataccgccgcgctcgccggcgacgacttcgacgcgaagacggccgcggtcgaacggctcgccgccgatcccgatccgcgcgccgtcgcgttgctcaacgcgctgtcgagcggcgacgcgctcgcgaccggcgacggccgcctgctgatccagtccggcgacaccgcacacgacgcgctcgcaggccgcgacgccggccggcgacgcgcagcctgtgatgctgaacaacctgctgcgcacgaaaatcgcgggcgcgctgtcggggctcgcgctcgcgtcgcccgacgttgccgcgcgccgcgacgcgatcgatgcgctgctgaagtcgcccgacccggcactcaagccgatgatcgaccgagcgcgcgcaaaggaaacggatcccacgctgaagcgccgcctcgatgcattgtgggcgatcgccgcgctgcacgacgccgatccggcgaagcgcctcgaagccgtgcaggtggtggccgcgcgccgcgatctcgacatgatcgagcagttgcgcccgctcgtcgcgaagaatgccgacggcagctacgcggagcccgacgcgcgcgtgcgcgacgccgcccagcaagggctcgacgcattgcactcgctgcagcgccgcggcgagatcgcgggcacgctgttcgcggggctgtcgctcggcagcgtgctgctgctcgccgcgctcggcctcgcgatcacgtacgggctgatcggcgtgatcaacatggcgcacggcgaattcctgatgatcggtgcgtacgcaacctatgtcgtgcagacgctgatccagcgctacgcacccggcgcgttcgactggtatccgctcgtcgccgtgccggtgtcgttcgtgacggccgcgctggtcggcatcgtgctcgaacggctcgtgctgcggcacctgtacggccgcccgctcgagaccctgctcgccaccttcggcgtgagcctgatcctgatccaggcgacgcggatgctgttcggcgcgcagaacgtgcaggtcgtgaacccgtcgtggatgagcggcggcgtgacggtgatgcagaacctgatcctgccgtacaaccgcctcgtgatcctcgcgttcgcgctcgccgtggtgttcgtcgcgtgggccgtgctgacgaagacgcgccttggcctgttcgtgcgcgccgtcacgcagaaccgccggatggctgcgtgcgtcggcgtgaagaccgcacgcgtcgacgcgtacgcattcgcgttcggcgccggcatcgcgggcctcggcggctgcgcgctgtcgcagatcggcaatgtcggcccggatctcggccagaattacatcatcgattcgttcatggccgtcgtgctcggcggtgtcgggcagatcgccggcaccgtgctcggcggcttcgggctcggtctcgtcagcaaggcgatcgagccgttctggggcgccgtgctcgcgaagatcgcggtgctcgtgatgatcgtgctgttcatccagaagcgtccgcagggcatgttcgccccgaagggccgcagcgcggaggcgtgacatgacttcaatcaccgattcgttgtcgaagccgctcgccgacgcgccgaagcccgctgccgccgcgcgtgcggagaacggtttcgcgctcggcctgccgccccgccccgcgctgctgtcgcgccgcgcgtggctcgcgctgatcgcgctgtgcatcgcgatcggcatcggcgtgccgctcgccgcgctggtcgcgcccgagtcgagcgcgttccatctgtccgcgtatgcgatgacgctcgccggcaagctgatgtgctacgcgatcgccgcgctcgcgctcgatctcgtgtggggctactgcggcatcctgagcctcggccacggcctcttcttcgcgctcggcggttatgcgatcggcatgtacctgatgcgcgagatcggccgcgacggcaagtacggcagcgacctgcccgacttcatggtgtttctcgactggcatcagctgccgtggtactggagcggcacgcagcatctcgcgtgggcgctcgcgctcgtcgtgctcgtgccggccgtgctcgcctgggtgttcggcttcttcacgttccgctcgcgcgtgaaaggcgtgtacctgtcgatcatcacgcaggcgctgacgttcgccgcgatgctgctgttcttccgcaacgagacgggcttcggcggcaacaacggcttcaccgacttcaagcgcatcgcgggcttcgcgatcacgtcgcccggtacgcgcacggtgctgttgctgctgacgttcgcgacgctcgtgctcgcgttcatcgccgcgcgcgcgatcgtcaccagcaagctcgggcgcgtggtcaccgcggtgcgcgacggcgagacgcggctgatgttcctcggctacagcccgctcgcgtacaagctgttcgtgtggaccgtgtcggccgtgctgtgcggcatcgcgggcgcgttgtacgtgccgcaggtcggcatcatcaatcccggcgagatgtcgcccggcaactcgatcgagatggcgatctgggtcgcggtgggcggccgtggcacgctgatcgggccgatcgtcggcgcgttcgcggtgaacggcgcgaagagcctgtttaccgcctacttcgccgaatactggctgttcttcctcggcctgatcttcgtgctcgtgccgctgctgctgccgcgcgggatcatgggcctcgtcgaaaccgtgctcgcgaagggaaacgcgcatgaacggaacggccctctaccagttcacgccgccgcccgaggacgagctgctcgccgtcagcggcaccgcatcgatggggcgcgtggtgccgccgggcatcgacacgtcgcacggcacgatcctctacctcgaggacatcgaggtgagcttcgacggcttccgcgcgctgaagaagctgtcgctcgcgatcgacgcgggcgagctgcgctgcgtgatcggcccgaacggtgcgggcaagacgacgatgatggacgtgatcaccggcaagacgcgccccgatgcgggcaaggtgtttctcggccagaccatcgacctcgcgcgaatgaacgagccggaaatcgcacgcgcgggcatcggccgcaagttccagaagccgaccgtgttcgagcagcatccggtgtgggaaaacctcgaactcgcgatgcagaccgacaagggctggctcgcgtcgctgcgcgcgcggctcgaccgcaccgcgcaggcgaagatcgaggaaacgctcgcgctgatcggcctcgaaagcgacgcgtatcgcgcggcgggcgagctgtcgcacgggcagaagcagcggctcgagatcggcatgctgctgatgcagcgccctgcgctgttgctgctcgacgaaccggcggccgggatgaccgaccacgagacgatggagctcgccgagctgctgaacacgctgcgcggcacctgctcgatgatggtcgtcgagcacgacatggaattcgtcgcggcgctcgccggcgacacgggccgcgtgacggtgatggccgaaggcgcggtcctcgcgcaaggcaccctcgaccaggtcaagcgcgacgacgcggtgatcgagtcttatctcggacgttgatgcaatgctgaagatcgaagcactgaaccagtactacggcggcagccatatcctgcgcaacgtgagcctcgccgccgacgacggcaagctcaccgtgctgctcggccgcaacggcgtcggcaagagcacgctgctgcgctgcctgatgggcgtcgtcgccgcgaaaagcggcagcgtttcgtggcgcggcaccgcgctcggcgcgatgccgccgtatgcgcgcgtcgcggccgggctcgcgtacgtgccgcagggccgcgacatctttccgcggctcaccgtcgaggagaacctgctcgtcggcgcggcaagccggaaagcaccgtcgaaggtgcccgaccgcatctacgacctgttcccggtgctgaaggacatgcgcacgcggcgcggcggcgacctgtcgggcggccagcagcagcagctcgcgatcggccgcgcgctgatgagcgaaccgcagttgctgatcctcgacgagccgaccgaaggcatccagccgtcgatcatccaggatatcggccgcacgctgcgccagctcgtcgacgaagcgaagatgaccgtgctgctcgtcgagcagtattacgacttcgcccagtcgatcgccgaccgctactgggtgatgagccgcggcgagatcgtcgcgggcggcgacgcgcgggacatggaagcgaacggcgtgcgcgagctgatcgccgtgtagagacgcacgcggcgcacgattgcgccgccgcgcggtgccggcgatcgatgcacgtcatgcgatcgccggcgtcatcgcctctccgcttcaccgcgtccagcaaccggaacacccaggcgtatagtgttgcggtagcatcctcgatccctgcgcccgtcccctgcttcccgccgatgtctgcccccgattcccacgccccgctgtcccgccctgccgtcgccaagtcatggcgcggccgcctcgaactcggcttcgagcggcacggcgcacgcacgacgctcgcccaccggctgcacgacggcccgctgcgcgtgcagcggccgctatatccggaaggcgacgcgatctgccatgcggtgatcgtccacccgccgggcggcgtcgcgggcggcgaccggctcgacatcgacatcgcgctcggcagcggcacgcacgcggtgctgacgacgcccggcgcgaccaagtggtacaagtcgaacggcctcgacgcgacgcagcgcatcggcatcacggtcggcgaccacgcgaaactcgactggctgccgcagaacaacctgttcttcgacgcggcgcatgcgtcgctcgctttcacggtgaagctcggcacgggcgcaagcgcgatcggctgggacgcgacgcagctcggccggcaagcagccggcgaaacctggtcggccggccgcatcgtgtcgagcgcggcgctcgtcgatgccgacggtcggccgctgtggaccgaacgcgcgctgctcgacgcgcacgatccgctgcgcggtgcgctgcagggcctcgccggctttccggtatacggcacgttgtgggccgccggcgccgcatgcgacgccgcgctcgccgaatcgctcgccgcgcggatgccgttcgatgccacgctgcgcgcgagcgcgacctgcgtgacgcccggcgtcgtgctggtgcgcgcgctgtcgacgtcgatggaagcgctgcaacgccacttcaccgactgctggctgcatctgcggccgatcgtgcacggcgtcgacgcacggccgctgcgcctctggcaaacctgagcacggtcgcgccacgcaccgtttcgatgcagcgccgcggcccgcgccgcacgttgcccatgcatcgcgcaccagaagcgcgcatcgcgccgcgttccatgcacatggcacgcgccttgctgcttacataaccgatacacgacgcacgcaaaacggcgcggtgctacgatgacccgcgcgttcgccccgttgcccacgcaccgataaaaattacgttttactgaacgtttgccttcatgaaactgactccccgagagaaggacaagctgctgatcttcacggcggcgctgctggccgagcgccgtcgcgcacgcggcctgaagctcaactatccggaggcagtcgccttcatcaccgccgcgctgatggaagccgcgcgcgacggcaggacggtcgccgaggtgatgcattacggcacgacgctgctcacgcgcgacgacgtgatggacggcgtgccggagatgattcccgacatccaggtcgaggcgaccttccccgacggcacgaagctcgtgaccgtccatcacccgattccgtgaggccccgcatgatccccggcgaaatcctcaccgacgacggcgaacacgaactgaacgcaggccgcgcgacgctcgcgctcgtcgtcgcgaacaccggcgaccgcccggtgcaggtcggctcgcactaccacttcttcgaagtcaacgacgcgctgtcgttcgatcgcgcggccgcgcgcggcttccgcctgaacatcgcggccggcaccgccgtgcgcttcgagccgggccagacgcgcaccgtcgagctggtcgcactcgcgggcgatcgtgccgtctacggttttcagggcaaggtgatggggccgctgtaagccgcgccccgctcttcaggaacagcacatgacattacgcttgagccgccgcgcgtacgcggaaatgttcgggccgacgacgggcgaccgcgtccggctcgccgataccgaactgctgatcgaggtcgaacgcgattacacgacctacggcgaggaagtgaaattcggcggcgggaaggtgatccgcgacggcatgggccagtcgcagcgcgtggccgccgacgtgcccgacacgatcatcacgaacgcggtgatcctcgatcactggggcatcgtgaaggccgacatcgcgatcaagcacggccgcatcgccgcgatcggcaaggccggcaatccggacatccagccgggcgtgacgatcgcgatcggcgccgcgaccgaagtgatcgccggcgaagggctgatcgtgacggccggcggcatcgacacgcacatccacttcatcagcccgcagcagatcgacgaggcgctcgcgtcgggcgtcacgacgatgctcggcggcggcacggggccggccaccggcaccaacgcgacgacctgcacgccgggcccgtggcacatggagcggatgctgcaggccgccgacggctggccgatcaacctcggcttcctcggcaagggcaacgcgagcctgccgcagccgctcgtcgagcagatcgcggccggcgcgatcgggctgaagctgcacgaggactggggcacgacacccgccgcgatcgacaactgcctgtcggtcgccgacgacaccgacacgcaggtcgcgatccacaccgacacgctgaacgaaggcggcttcgtcgaatcgacggtcgccgcgttcaagggccgcacgatccacacgtaccacaccgaaggcgcgggcggcggccatgcgcccgacatcctgaaggtgtgcggcgaggcgaacgtgctgccgtcgtcgaccaacccgacgcgcccgtacacgatcaacacgctcgacgagcatctcgacatgctgatggtgtgccatcacctcgatccgtcgatcgccgaggatctcgcgttcgccgaatcgcggatccgccgcgagacgatcgcggccgaggacatcctgcacgatctcggcgcgctgtcgatgctgtcgtccgactcgcaggcgatgggccgcgtcggcgaagtgatcatccgcacctggcagaccgcgcacaagatgaaggtgcagcgcggcgcgctgccggaagacggcacacgcaacgacaacttccgcgcgaagcgctacgtcgcgaagtacacgatcaacccggcgctcacgcacggcatcgcgcacgaagtcggttcgatcgaacccggcaagtgggccgacctcgtgctgtgggagccggcgttcttcgggatcaagccgtcgatgatcctgaagggcgggatgatcgccatggcgcagatgggcgacccgaacgcgtcgatcccgacgccgcagccggtccactatcgcgagatgttcgcgacgcgcggcggtgcgctcgcacgcacgtcgctgaccttcgtgtcgcagatggcggccgatgccggtatcgcggaacgctacggcctcgcgaagcggatcgtgcccgtgctcaactgccgcaacgtgacgaaggccgacatgatccacaacgcatggcgcccgtcgatcagcgtcgatcccgaaacctacgacgtgatcgccgacggccagttgctcacctgcgagccggccacggtgctgccgatggcgcagcgttatttcctgttctgattgccggtttccggttcctgtttcatgcgcaccctcgacaaacgtattgccccgaacgtgaaactcgccgcgtcgctcgtcgcgcgcgcgccgacgctcacgctcgcctatgacgcccgctgcaagagccgcctcgcggcgacgctcgacaccggcgaagacgtcgccgtgctgctgccgcgcggcacgatcctgcgcgacggcgacgtgctcgtcgccgacgacggcgcgctcgtgcgcatcgccgcggccgccgaaaccgtgctgcgcgtgcgcgcggccgatccgctcacgctgatgcgtgccgcgtatcacctcggcaaccgtcatacgccggtcgagatcggcgacggctacctgaagctcgaggccgacccggtgctcgctgacatgctgcgccggctcggcacgcaggtcgaggaaacgcaagcgccgttccagccggaagccggcgcgtacggcggcggacacaagcacgggcacgatgcgacgttcgccgaggattacgcgcttgcgcagcaggtgttcggcgagcatcacggccactcgcactcgcactcgcactcgcactcgcactcgcacgatcacgatcacgatcacgatcacgatcacgatcatcagcatggtcccggatgcacgcacggccacggccatgaccaccactgaactcgtcgcgctgctgcatctcgcgtcgccggcgctgccgatcggcgcgtacagctattcgcagggcctcgaagccgcgctcgacgcgaacctgatccacgacgccgattccgcgcgcgactggatcgccagcggcctgaccgacgtgctcgcgcacggcgagctgccgttcctcgcgcaccagctcgcacgctggcacgcgcacgacacgcacgcgctcgtcgccgaaaatgcatggttcgtcgcgagccgcgaatcggcggaactgcgccgcgagaccgaacagatgggctggtcgctcgcgcaactgtgcgcgtcgctcgaatggggcgatgccgcgcgccgcgcgacgctcgcggcgatgtcgccgatcgcgctgccgaccgcgttcgcctacgcggccgccgcgcacgacgcgagcgccgacgccgtgctcgccgcgtacgcattcggctgggtcgagaaccagacgtccgccgcgctgaaggccgtgccgctcggccagctcgccgggcaacgcatcatcgtcgcgctgcgcggcgcgatcgacgcggccgtacgccgcgcgctcgcgacgccgcccgacgccgtcaacacgttcgcgccgcagctcggcatcctgtccgcacggcacgaaacccagtattcgcggttgttccgctcctgaacacgacacacgccatgaacgcacccgctccgtccccgcccgccgcacgaagaaactgccgccgctgcgcgtcggcatcggcggccccgtcggctccggcaagaccacgctgctcgaaatgctgtgcaaggcgatgcgcgagcgctacgacctcgtcgcgatcaccaacgacatctatacgaaggaagaccagcggctgctgacggttgccggcgcgctgcccgaggagcgcatcatgggcgtcgagacgggcggctgcccgcacacggcgatccgcgaggatgcgtcgatcaacctcgaggccgtcgaccggatgctgtcgcgctttcccgacgccgacatcgtgttcatcgaatcgggcggcgacaatctcgcggcgaccttcagccccgaactgtcggacctgacgatctacgtgatcgacgtcgcgggcggcgagaagattccacgcaagggcggccccggcatcacgaagtccgacctgctcgtgatcaacaagacggacctcgcgccgctggtcggcgcgaacctcgacgtgatggcgtccgacacgaagaagatgcgcggcgagcggccctacgtgatgacgaacctgaaggcgctcgaaggcgtcgcggacgtgatcgcgttcatcgagaagaagggtttgctgacggtgtgagcggcgtggcggcgccctgcgacgccgccacgcgtgccggggcggcatcgcaccgcccgccgtctatgcgtcgtcggcagcgtcctgcgcgcccggcagcgcatgcgcgccggcttcggcgggcggcagcagtgccgcgagcacgtcgaccgtgcgcgcggtcgcgccgcggtgacgcgcagcgaacgccgcgccggccgcacccatcgcgatgcgccgcgcgttgtcggcaaacagcgcgtcgagcacgtgcgcgagatcgagcggatcctcgacctgcagtgccgcgccggccgcgaccgcgtcggcggtcgcctgcgtgaagttgaatacgtgcttcccgatcagtaccggcacgccgaccgcgcacgcttcgatcaggttctgtccgccgagcggcagcaggctgccgccgatgaacgcgatgtcggcggccgcgtaatacgcgccgagctcgcccatcgaatcgccgagcagcaccgtcacgtcctccggcagcggctcggcggccggacggccggccgcgagtgccgccgcgtcggccgcccatgcggagcgccgcacgcacttgagcccgttgcgcccgacgagcgcctcgacctcggcgaaacgttgcggatgacgcggcacgagcaccagcagcgcgccgggcgtacgcatcgcggcgaacgcctgcagcaccagcgcctcctcgttctcgcgcgtgctcgcggcgacccacaccggccgcgcgccgatcgcgtcgcgccacgcatggccgcgcgccgccagttccggcggcgtcgtcatgtcgaacttcaggttgccgagcacggtcacgttgcgcgcgccgagcgaagtcagccgctccgcatcggccggactctgcgcgagcacgcgcgagaagccgccgaacacgtcgcgcgtcgccgcgccgaacttcgccgcgcgccggaacgaacgcgcggacatccgcgcattggtcagcaccagcggcacgtccgcgcggcggcactcgtcgatcagcgtgggccacacctcggtttccatcacgaggccgagcgtcggccgccacgcgcgcaggaagcgccgcaccgcgccgggcatgtcgtacggcaggtaacagcgcagcacgcgatcgccgaagatctgttcgccggtcgcgcggccgctcggcgtcatgtgcgtgagcaggatgcgcgcatcgggacgcgcgcgcatcagcgcgtcgatcagcggctgcgcggcgcgcgtctcgccgaccgacaccgcatgcacccagatcagcggcgcgcggtcgtcgcgcgagcggcccgccacgtggccgaaacgttcggcgatgtgctcgcgatagccgcgctccttgcgcgagcgcacgtagagccggatgaccgcggccggcgcgacgagccaccacagcgcgcgatagatcacccgcagcatgcagcggccctcgtgttgcttcggagaagaggcgcgctcaaaccagcgccctgcccttcaggcgttcgagaatgccgagcggcgcgcattcgcggcgaaccatcgcgtcgaccggcaggaagaacgtctgttcgagcatgaactggccggacatcacagcgtgcgaagtctgatccgagaaacatatccacacgcaacccggcggaaacggcatcgtctcctgcgggctggtcttctggtagtcgagatcggccttcatgctgtcgtgcaggttcagcatcaggtggtcgtacgcgctgcgcggcgacttcgtcacgtgcagcaggttcagcagccacgcggcgcccggcagctgcggcttgatgcgcggcaggaagcgcttcgcgacgtcctcgaacggctcgccgacgcgccacacgcgcggcacgccggccgggttcacgttcgtgaacacgcgcaggatgcgctcgccgtagttgggccgcgacgggaacgcgtcgacgtgcagccggctgtcgtccttgcgccaggacgtctggcgcgtctcgacctgcatcagccgcaggctcgtcggcgcgacgcgcagcttgccgcggtattcgggaaacaggccgtcgacgagcgtgccggcctgctgctggaaacgcgcgacgagcgcgcgcaccgccgactgcgtgacgctgtcgccgagcacgccggcgagcgcgccgccgttcggcgcgaggctgatgttcttgcgtttcgggtcggcgagcgccggatcgagcagcgcttcctcgccgccttcgatcgcgaagcgcaggtgcgggaaatacagcaccttgccttcctcgacggcggccagcagctgctcgcgcggcgccgacagattgtgtccgctccagtcggcggacgggacttcgatgatctgggattcgctcatgatcggttcgcttgggttcgcgcgggttcgtgcgggtgcgtgcgtagggcgggcgttacaggagaccgaagcccgcgagcgccgacttcacctgcgcgatcgacggggttgccccgccgtgccgagattgacgacgttcggcgaccagtagccgccggtccgccaggccgtcgcgaaattgtacagttcgaccgtcggacgcttcagcgccgccgcgatgtgaaccagacctgtatcaaccccgacggtggcggccgcgccgtcgatcaggccgaccacggccggcagcgacagcttcggcggcacgatcgccgccgcgccgaattccttcgcgagccgctcgctggtcgcgcgctccgcgtcgttgccccacggcagcacgagcgacgcgccgcgccgcacgagcgcctggccgagctcgatccacgcggcatccggccactgcttgtcggcacgcgacgtcgcgtggacgaacaccacgtacggcaccggcaggttcaggccgagcgcggccaccgcgagcgccgccgcgcgcgtatcgaggccgaagtcgaccggatcggccggcgtcggcgccgggtcgcccagcgcggccgcgacgagttgccgcgagcgctcgacgacgtgcgtgcgcggcgcgatcggcacacgcttgcggtagaagaaacgcacgggccactcgtagccggcgccgtcggtgcggttgccgagcccgacgagcgggccgcgcgcccagctcgcgacccaggccgtcttgatgagaccctggcaatcgatcacgaggtcgtactgctcggccgcgaggcgctggcggaacgcgcggatctcgcgccacgtggcgcccgagaacggcttcttgcgccagcgccgcaacgaaaacggcagcacgttgcgcacgccgtcgacgagcttcacgagatcgacgaagctttcctcgacgagccagtcgatctgcgcatcggggtggcggcgccggatatcggcgatcaccggcatgttgtgcacgacgtcgcccagcgacgatacgcgcacgatcaggatctttgcacgctgaaaaacgccggctggcagccggcgacaggcataaagacgcgattttatcgcgcccgggggccgatcaggcgaaaaactgaggtcggactgaattagtggcagtcaaccggttcacgagcagttgataggccaacgcacagtgttacgacgcgcgctcggtgtggcgaatcagacctgctagtgccctgcgagtcgcgacagcgcgaatcaaggcctgcgtgaccagatgtttcgtcatccgttcgctcatcgcgtaaccggcgatttcaccgcggtacaggtacctcagggcggcaggacacaaccaaccctcatcgatcgcaaaagaggtgacgtcaccacaccagacttgattgggcaccgtcaccgagacatcttgtttcagcggattcgacccgacaggcaggtcgtgcttcgaattcgtcgtggccttggtcctgcgcttctgcttgcagcgctatcccgattttcttcgcagcctcctgacccggtgcaagccgattcgcacgccacgctcctccagatgtcgccgcaggcgctccggcctgaaactttcccggattcgccggtggaccgtaagcacctccgcttccagggcgaggttcctacatggtggccgctcatcggtacgcccagcactcggcacattggcggcacggggtagtctcgtcgcatttgttcaatccgcacctcacctcgacgccttcgcgaagtacgtcgcgaacctttgaggagggcgcgctccgttctgacctcgaccagccaacgcctggcctgtgccggctcggcctccatttctgtcagtggcttccggtgtcgatcgacgacatctttcagcttgccggccttcgtcgcccccgcccccggtttgtcagcatcttgatctgcccctcaccatctcctgccccgtttcgccgctcctcgcgcggcaaggatccgcagggttccagtcgatagttttgtgtcatctgcaagtgataaactccgcgaacctttcgtaatacatcgtaacgtttttaatacgtcgtaatattaaaggcgctcgccgagcctggttcctcgtcgctcgattcatctaaccctgtttctctaacactcgcggtcacatgttcgtagtattcgataatgttgcaagcagattgctgctggtcggttcggtgctcattctcgcggcgtgcggccacggtaccgacgaggaaccacaagggacgcccgctccgcccgtcgccatgccggtgcccgcgccaggatccgaccctgcggatgtcctcgtctacggtgcgacgccgggcggtatatccgcggcactggaagccgcgaaactgaaaaagcgggtcgtcattctggaaccgacgaaacacgtcggtggcatgacgacgagcgggatcggcgtgacagacgcctatccccaggatcgtctatgggcaatgggcggtttcgcgcatcgtttcgtcgacgcggtaaacacgcgctacgggaagacctggacgatgggcggcatatttcacgagccgcatgtcgccgagagcattctgttgcagatgcttgccgacgccccgtccgtttccgtcgaatacggtgccgaactggcgagcgttcaaaccaataatcacgagatcaaggtcgtccagacgagcaacggacatagttacgcggcgaagatgttcatcgatgcgagctacgaaggcgatttgctcgagaaggccggcgtcgaccatacgctcgggcgcgaagcgaaatcacaatatggcgaacccctcgccggcgttggccccatttccatcaaggacggcgcgcgcgtggatccctacgttgtgccaggtcaaccgaacagcggattgcttccgcatgtggcgcccaacaatctcggcgcaccgggcacggcagactcggccgtgcaggcatatggctatcggctttgcctcactgcggataagggaaaccagattcccgtcgtcaaaccggccaactacgatcccaaggaattcgaactgctggggcgcgtcgccctggctcacccggaaatcgtcaagacgttcaactacatcgcgaacgttccgattcccaacaacaagttcgacgtcaatagcctcggcctgctctctacggacgagatcgagggaagcgcggagtatgccaatgcgaatgcgaacggtcgtcgccaaatcgaggcggagcacaagcgttatacgctggcgctcctgacgtttctcgcgacggatccccgcattccgccaaacgtacgcgatgacgttcgctcgtggggattctgcaaggacgagttccaggataacggcgggttcccatggcgcctttacgtacgggaaagtcgccggatggtcggtagctatgtgatgacacagcacgatctgtacacggaaaccaggatcccggatcccatcggtcttggtgcattcccaatcgatcagcatacggtcaatcgcattgcggtagacggacaggtcggtaccgaaggtgccatttggcagccgctgccgcgtccgtacccgatctcgtatcgatcgatcgtccccaagtacagcgagatccggaatttgctcgtgccggttgcactgtccgcgtcgcacgtcgcgtattcatcgatacgcgtcgagccgacattcatgattaccggtcaggcggctggagccgccgcagcgctcgccatagattcgcgaagcagtgttcaaaacatcgactatgcaaagctgtccgcgacactggtgagcgaaggcgcggtgttggcgaacagatgacgccgacgggacagcatggctgcttgtactttctgaggttcccgatggaattcttggtcgccttcaccgactcaaccgagaaagtagtcgaccttgaacaatccttgaaggcatatacagccaggctgcaaggtcgaaacgatacaggagttgcagggaacgggcatattggtgcgtaaaacctgcaactctttacaaggcaactacaaggacgttgccatcgacggcaaactcgatcggagccggctcaagggcgcgctgggtgacgcgatccacgcagtgccgtgcagcgccaagcacaacctgcggatggtcctgcgcaagctgatccacgatggacgtcttacgctgcccagtttccgccagacacattaaattcacctggtgcctgattggttcatgctcggtgcgccgccagacacgacgccaccttttgcgcgaaccacatttctgcaagggtcaactatctgcctgttcaagtattcgagcgccgccgataaagccacggccaagggagcgtgaaccagaacaacgtccagccagttgccttcgtagaaagaaggagctggatggcgaaggcagcctgatagtggatgagatagatcgggtaagacaggcctccgatatttcgatcaatccatctgaaatagcgcccttccgtcgcggacgcgatgaagaagaatgccaccgcgaatcccgccagattcaggtagtaagggattcctgcagcatcgagcgggaggaaatgcagcgcgcatataaatcctgcgtacaggagcgtagcggtaaccgaggcatacgtagtgacggaagcccgacatgccttgactgcgaaatagaggcatattccgatgccgtacggaagtgcagccgcaggtatcgcatatatccgctcgttcacgtcatgagccatcgcaacatggaacaacacgccgacaagcaggcacagcgcgccggttttgatgttgcgcgcagcacccaatgcgagcaccacgtacatggcaaattcaacggctagcgcccatgccggcggcacgacgtgcgatacgctcggcttgccgggcagggggaaatccgggcgccagtaccagttcatggccaagcaggcccacgatcgcagcgaatcgggcagcagaaaatttcggtgatatgcctccgcaagcgtgggctcaagggcaatcagcaagaccgacatgccagctgcaatccagtacatcggatagagcctcaggaagcggttcaggaagaatcgaaagaatcccgatgacccgaacccataattgcgatggagcgttgcggtcatcagatagccactgatcacgaagaacgtcgacacagcataggtcgccgtgagatcagtccatcgcccaagatgggcggccatgacgatcagcgctagaaaagtgcggagtgctccgagcatgttgacgggtcgaatcgggaaggggcgcaatcgcatgttgcgggttgcgccaattttctcacatcgcgaatcgcccctggttcgctcgtagtgcgctgatcacaatcggccgcagaaccgtttcggcataccgtctcgttcggttgcgtgcaggatctcgagacgtggccgtatcaaggggcccgatcagacactggcgagcggcgtgatgcttacgccgatttttctccccgccggaacatttggtttcgtaaattaattacgcccagcgaatcgcctcgctgcaagctttagcctaaggtcgaggttatataacttccgtcgaatttgattcttgaccagccgtaggccaccctctttcagattttcttggacggcagattgagattgtgcggcttccggattcgctgggccggcttctcgatgatcatgaactgatcatcccccggtcggacaattcgtagtttgagttcctcatgaactcttcaaccggactgaaatcccataaatgccatacaaactcggcgttatgttcaacgacctcaaatccggcatattcaacgatctgacgcatttcgtgtttcgtgaattcacggaagtgccagtcatacatcaatggcgcttgttgcatcatcgcccgctgaattgcccataggctggtcgcattcggagttgagattagcgcacgcccccaactcgaagaaccctgtagacctcatcgaggaaaaagaatattccgttcagcgtcgtagcctgccgataagaaatgtccgaaatatgctcgatgacttcggtacagattacgttgtcgactgaattatcggcaaaaggaagcggatcatatcgcagatcgctttcggtaccgcggacggttgagcctggaaagaacgaccatatcactttggagctcaagtattcgaggctaccgatttcgacacaataccctcggtgaagctcgaacgctttcatgtattcgaccgtcagcgcgaaacgcctcgtatcgaaatgaagacctccgccgccgacgccgaggcgtcggccctcctcgtcaacgcgcctcgtcgcttcggtgattgtctcctgatttatatatggcgaatcaaacctcattcctgcggcaatggtttccatatgtcaatgctctgttgacagctggtgggaatgttcggtcaggacattgtatagcatcctccgctatttccgaattgcaccaaccaacgcagtgatgatagggcgcaaacccgtctctgcgttagccgccttatcggcatattccacatcgatcggatgagtcagatattcggaatagccatgaacgccagcccgggagcctttaggctcgtcgaatacacagattttcccgtatttgcgcgctatctggcccgcttggattctggatccgatatgaacctatataaatgaagtcgatgatttgggtgtgcatccgacaggcgaagctgcactcgactacccaatgtctgggcagcaacacgaaacgcgaagctgtccgggatcattgcactgggttgagctttgcattcatcgcatacgcgcagctgttctcgcaggtcacgcaccatctgaagcaaggttcgtaacacgctccggcgtaagctgacgttcgccgacaccgagcaagcagtcaaggccgcatgcaacccggtgccaccggcgcagcgttcgcagcaagggcaagacgaggtggtcaaccgcaacgcccgtccaccgcttctccacgctgatggctgagctgggcggcatcatgcgccacatctgtcgcccccgaaccgggcgccgaccttcgacattgccaccacgcccaacgcaacgcactcgatctgatcaggcaggcctggccgtagacagaaaccgggacctcaaaatcacatcgaatgcttgcggcacaaggacaaacccgccccgctgcgactggaattgcagtctagccgcacacagtgcgaaaagcggcctcacgcgatgcgtgtgcgccgcttttcggacccagccctggggcgtttagcaccaatggcggccgcgccgccaccggcactcagaacggcagcttgacgtccggcttcgcggccgtcagcacgcggcggaagtcttcctggatgcgctcgagcccttcctgcgtctcggcctcgaaacgcatcacgacgaccggcgtcgtgttcgacgaacgcgcgaggccgaagccgtccgggtactcgacacgcaggccgtcgatcgtcacgacttcctcggcgccgtcgaacttcgcctccttctgcagcttgtcgatcaggcggaagttctcgccttcgtcgagccagagctgcagctcgggcgtgctcatcgcgtccggcaggctgttgagcagcgcgctcgggtcggccgtcttcgcgaggatctcgagcaggcgtgcgcccgtgtagaggccgtcgtcgaagccgtaccagcgatccttgaagaacacgtggccgctcatttcaccggcgagcggcgcacccgtctcgcgcagcttcgccttcacgagcgagtggcccgtcttccacatcagcggctcgccgcccttcgctttcacccattgcgcgaggtggcgcgtgcacttcacgtcgtagatgatctgcgcgcccgggttgcgcgacagcacttcttccgcgaacagcatcgctggcggtccggatagatgatctggccgtccttcgtgacgacgcccaggcggtcgccgtcgccgtcgaacgcgaagccgatctcggcgtcggtgtccttgagcgcctggatcacgtcctgcaggttttccgggtgggcgggatcggggtggtggttcgggaacgtgccgtcgatgtcggtgaagcgctcgacgagctcgcagccgagcgccttgaacaggcgcgtcgcgagcgggccggccacgccgttgccggcgtcgacgacgagcttcatcggacgggccggcttgatgtcgccgacgatgcgcgcgatgtattggtcggccacgtcgaactgttcgtacgagccgctgcccgtttcgaagcgctcgtcgacgatgcggcggtacagcgcctggatctgctcgccgtagatcgcggcgccgcgcagcaccatcttgaagccgttgtagtcgggcgggttgtggctgcccgtgacgacgatgcacgaatcgacgcggcgctcgccgtccttcagcgcgagcggcacgttcgccgcgaaatagccgaccggcgtgggcaccatgccgacgtcgacgacgtcgacgcccgccgcacgcaggccgtcggcaagcgcgccgacgagctccggcccggacaggcggccgtcgcgcgcgacgacgaccgcatcgccgccctgcgcacgcacttcgctgccgaatgcgcggccgatcccgcgcgccgtgtcggtgtcgagcgtcttgccgaccacgccacggatgtcatatgccttgaagatggattgggagatcatcgattcacttctctcagttgcgtgcatggaaaattgtctggcttgcctggccgccgctcgccggtgccgcgcatgatacatgcccgcccggcgaggagcgcacccgctggcgcagaacggcggaagccaccccgatcccacttataatcgcgggttttgatgacgcgcatgccgcccattttaatgcctagccgtcccgccgccgccgacctgcagccttcgggcgccctgccggccccttgcgcgcacgccgccacagcgcatgctgaagcgcttcggcaacccggacgtcgcgaaggccgtcgcgaatctcgtctggctggggctcgaacggctcacgcagatcggcgtcgcgatcgcgatcagcggcctgctggcccgttatttcgggccggatgtgttcggcaaatggcagtatgcgaatacgctcctcctggtactggcaccgctcacctgggtgtgcggtgcggaaatcctcgtcccgaccatcgtccagcgcccgcccgcccagctcggcgcggtactcggcagcgcattcgcgctgcgcatcgccgtctccgccgccgcgctcgtcgcgacctggatcgcgatcgccgcgggcgccttcgatccgctggtcggcgcgatgctcgcgggcctggcggtcacgatggtgttccgcgagccgttcgtcggcgtcatcaacgcgtggctgcagagcatgacctacagcaagccgcagctcgtcaccagcatggtcaccgcgctggcgaaggcgctgctcgtctggctgctcgtccgtgcggccgcgggccctgcccgcttcgcatggctgtgggcgctcgaggccgccgccatcggtttcgcgctgatgctgtactaccggcatcgtaacggcggctcgctcggctggacgttcgacaagccgctgttcaggcactttgcgacggccggcaccgtgttctggctcggcctcatctgcatgtacctgttcctgaagctcgaccgcctgatgctcgagcgtcacgtgtcgttcgccgatctcggccgctactcggccgcgcagcagctcaacgagaactggatcacgctcgcgctgatgctcgcgcagacgatcgcgcccgccttcgtctatcgcgtgcaggacgtcgcgcggctgcgccgcaacatcgtccggctgatcgcgatgacggcctgcctgatgacggccggcgcgctcgtgctcgacgccgccgccccgctgatcgtcggcaaggtgttcggccgcggctacgaggcgtcggtcgacatcttccgctgggcggtctggctgtcggtgccggccggcatcgaggcgataggcaatcttatcgttctcaaatatcaagcaaaattcgtgttgctgtcgaaatggctgctcgcgctcgcgatcgccgcgctcgtcaacctgttcgcgatcccgcggctcggcctgtacggcgcgctcgtcgggctggcggccggctatctggccgccgccgccgtcaactttattacatccgtttcaagctgcgaccatgacgtccctgattgcccgacccgctcgacgacgtggccgtgctgatgccggcctacaacgggcacgacgacgtcgtccgaccctcgcatcgtttcgcgagaacacgcccgtgcacgtgctggtcgtcgatgacggcagcacgccgccgatcgtcgcgcccgacctgcccggcctcacgatcgacgtgctgcgcatgccggagaacggcggcatcgagcgcgcgctcgcggccggcatcgacgcactcgccgcgcgcggcttccgcttcgcggcgcgcatcgacgcgggcgatctcgctgcgccgcagcgcctcgcgaaggagcgcgcgtatctcggcgcccacccgcgcgtggcctgcgtcggcatgtggacgcaggtcgtgtcgcgcgccggcgaaccgcgcttcatgctgacgccgcccgccgatccgcgcacgctgcgccgcacgcgctttctgcgctcgccgctcgtgcatccgtcggtcatgctgcgcatcgacgccgtgcgcgaagtggggaactatcgtgcgaaataccgtgcggccgaggatctcgatctttttgcggttaatgcaacgctacgattgcgcgaacctgccggaactcggcctctattacgaactgaacgagggcgggatcagtgcgaccaagcgccggcgccagctggtgtcgacgctcacgctgctgttgagccacttcaacgcgctgaacccgtacgactgggccggcctcgccaagaacctgctgcatttcgtgacgccgtaccgtacgttgcagcggatcaagcaaacgctgttcgccgcccggccgtccgcctgacgcgcagccggcgttttcggccatttcgacgctttatttttctttttcatgtccgccacctccccgctgcgcatcgcgctcgtctgcaacacggcctgggcgatctacacgtatcgccacgggctgatccgcgcgctcgtcgcgcgcggcgccgacgtcatcgtgatcgcaccgcacgaccgcacggtgcccctgctcgagcagatgggctgccgctacgtggcgctcgcggtcgcgtcgaaaggcacgagcccgcgcgaggatctcggcacgcttgccgcactgttccgtcattaccgcgcgctgcagcccgatctcgtgtttcactacacgatcaagccgaacatctacggctcggtcgccgcgtggctcgcgcgcgtgccgtcgatcgcggtgacgaccgggctcggttacgtcttcatccagaagagccgcgcggcgagcgtcgcgaagcgcctgtaccggttcgcgttccgcttcccgcgtgaagtgtggttcctgaaccgcgacgatctcgccaccttcaccgacgagcagttgctcgcgcatcccgatcgcgcgcggctgctgcacggcgaaggcgtcgatctcgaacagttcgcaccggtgccgctgccggccggcagcgcgcctgtcttcatcctgatcggccgcctgctgtgggacaagggcgtgcgcgaatacgtggaggctgcgcgcgtcgtgcgcgagcgcttcccgaacgcgcgcttccagctgctcgggccgctcggcgtcgacaatccgagcgcgatcggccgcgcggatgtcgatgcgtgggtcggcgaaggcgtcgtcgagtatctcggcgaagcgcacgacgtgcgcccccatatcgcggcggccgactgcgtcgtgctgccgtcgtaccgcgaaggcgtgccgcgcacgctgatggaagcatcggcgatggggcgcccgatcgtcgcgaccgacgtgccgggctgccgcgacgtcgtcgccgacggcgacacgggcttcctgtgccgcgcacgcgacagcgcgagcctcgcggagcagctgctccgcatgatcgaactcggaacggccggacgcgacgcgatgggcgcgcgcggccggcagaaggtcgtggcggaattcgacgaacagcaggtcgtcgaacgctaccggcgaaccatccattcgctaaccggcatcaccctctgaaggagcgcatctgcaatgaccgctaaaggcaccatcctcgttaccggcggtgcgggctacatcggctcgcacacggccgtcgagttgctcgacaacggctacgatgtcgtgatcgtcgacaacctcgtcaacagcaaggccgaatccgtgcgccgcatcgagcggatcaccggcaaaacgcccgcgttccatcaggtcgacgtgtgcgacgaagccgcgctcgccaaggtgttcgacgcgcatccgatcaccggcacgattcatttcgcggcgctcaaggccgtcggcgaatcggtcgagaagccgctcgagtactaccagaacaacctcggcggcctgctcgccgtgctcaaggtaatgcgcgagcgcaacgtgaagcagttcgtgttcagctcgtccgcgaccgtgtacggcgtgcccgaacgctcgccgatcgacgagtcgttcccgctgtccgcgacgaatccttacggccagtcgaagctgatcgccgagcagatcctgcgcgatctcgaggtgtcggacccgacgtggcgcatcgcgacgctgcgctacttcaatccggtcggcgcgcacgcgagcggactgatcggcgaggatccggccggcatcccgaacaacctgatgccgtatgtcgcgcaggttgccgtcggcaagctggaaaaactgcgcgtgttcggctccgactacccgacgccggacggcacgggcgtgcgcgactacatccacgtcgtcgatctcgcgaaggggcacatcgccgcgctcgacgcgctcgcgaaacgcgacgcgagcttcgtcgtgaacctcggcacgggccagggctacagcgtgctggaagtcgtgcgcgcgttcgagaaggcatcgggccgcccggtgccgtacgaactcgtcgcgcgccgcccgggcgacatcgccgagtgctacgcgaacccgcaggccgcggccgacatcatcggctggcgcgcgacgctcggcatcgaggaaatgtgtgtcgaccactggcgatggcaggaggggaacccgcgcggttttgtataatccgctgtccatttttcgagcgatcccatgctcagcttcgcgtccggcttcatcgtctccctgctcgtcacgctgttcatcgtgcgctacgcgcaccttcacgagaaattctcggtcgacagcgacctggccggcgtgcagaaattccacgtgcggcccgtgccgcgcgtgggggcatcgggatcctcgccggggtcgtcgtggccgcgctgattctgtcccggcactatccgacgatcgcgggcagtattctcggcatcgcggcctgcgggctgccggcgtttctgtccggcctcgtcgaggacctgaccaaacgcgtgtcgccgcgcgcgctgctctgcacgatgggcgcggccgcgctcgcgttctggctgatgggtatcgcggtcacgcgcatcagcgtgccgccgctcgatttcctgctccactacgcggccatttcggcgttcatcaccgtgctcgcggtcgcggcgctcgcgaacgcggtcaacatcatcgacggcttcaacggactcgcgtcgatggtcagcttcatgatgttcgcatcgctcgcttacgtggcgttccaggtccgcgacccggtcgtcatgtcggcgtcgatcatcatgatgggtgccgtgctcggcttcttcctgtggaatttcccggccgggctgatcttcctcggcgacggcggcgcctatttcatcggcttcatgctcgcggaactcgcgatcatgctcgtgatgcgcaaccgcgaagtgtcggcctggtacccggtgctgctgttcatgtacccgatcttcgagacctgcttctcgatctaccggaagaaattcattcgtgggatgtcgccggggattccggacggcgtgcacctgcacatgctcgtgtacaagcggctgatgcgctgggccgtcggcacgaaacacgcgcacgacctcacgcgccgcaattcgctgacgtcgccgtacctgtggctgctgtgtctcgtcgcggtgatacccgcgacgctgttctggcggcacacggtgcacctgttcgtgttcgtcttgctgttcgcgctgacctacgtgtggctgtatctcagcatcgtgcggttccgcgtgccgcggtggatggtggtgaggaaggagcggcgcagccactgaacggcctgccggcttcatcaaaaaaccccgcggggcgtttttcgtcattgccatgcggttcgaaccgccgcccggccaagttacccgttcgatacgacgcgcaccgacggcacgctctgcagcgtcggggtaacggccgtttggtattccggcacccagcgccgcaggtctcgccgcacttcgtcatcgggcaggacacgatgctgcatcagccacggcagcagctcgtcgaggaaattgtccggtacttcccgcgcacgcgcgatccgcagtttcggatgcggggtgcgcgtcgtcgcctcgtcgtccgcgagcagttcctcgtagagcttctcgccgggccgcagcccggtgaactcgatctggatctgatcttccgagaagccgtacaggcggatcaggtcgcatgcgagatcgacgatcttcaccggctcgcccatgtcgagaatgaagatctctccgccgtgccccatgctcgacgcctgcagcacgagttgcgacgcctccgggatcgtcatgaagaagcgcgtgatctccgggtgcgtgaccgtcaccggaccgcccttcgcgatctgctgctggaacttcggaatcacgctgcccgcgctgcccagcacgttgccgaaacgcacggtttcgaactgggtgcgcccgctcgtctgctgcaacgcctggcaggccatttccgcgaggcgcttgctcgcgcccatcacgttggtcggattgaccgccttgtcggtcgagatcagcacgaagtgacgcacgtcgtggcggatcgccgcacgggccacgcgatacgtgccgagcacgttgttgcgcagcgcctgccatgcgttgtgctcctccatcagcggcacgtgcttgtaggccgccgcatggaacacgatatgcgggacgtggcgggacatcacctgatcgagcagcagggaatccttcgcgtcgccgatgatcggcacgaccggctgatcgggaagcgctcgcgcagttcctcggtcaggcggtacatcgcgtactcggacaggtcgaacgcgacgagttgcgctggcgcgaaacgcaggatctgccggcacagctcggaaccgatcgagccgccagcgcccgtcaccatcacgacacgaccgcgaagcagcgcctcgacgtgcggcgtgtcgatcgtcacggcgtcgcggccgagcagatcctcgaggtcgatctcgcggatctgggacaggaagccctgccccggcatcagtgcggtcagcgacggcagcaccatcactttcaagccggcgcgcacgcagagggtcgccgtccggcgctgcacctcgaccgacgcggacggaatcgccacgatcgcgtattcgatcttcagtgcctcggtccagtgcgcgacgtcgtcgagcgagccgagcaccttgtagccatagatttcgcggccctgcttcgtcttgtcgtcatccagcaggccgacgagacgccattcgcccgagcgcgacaattcacgcgccaggttcgcgcctgccgtgcccgcgccgatcacgagcaccggcttgccctgcccgacgaggccgccgtacaggtaaaactccttcatcgcgcgatacagcgcacgagcgccgcccatcatcaggaacagcatcagcggggagaccagcagcacggaacgcgggatgatcggcgacggctggaacatcacggcgccgatcatcacaatcacgccgccgcccgcaagcgccttcgaaatccgcaccaggtccggcaggctcgcgaacacccacagtccgcgatacaggccgaacaggtggaacgtcagcgcatagacgggaagcacccaggcgagcgcagtcagcgagcccctcaggaaatcgggcggaacgctaccgttgaagcgaacgagataggcgaacaaccacgcgacgacaaccgccagcagatcgaacaggaaagcactgagtgacagccatgatgctttggatcgcaacatcggcgagagacctcacgaattgttatcaatgaccgtccgcagccggcgccagcgcacgtcgatcgccacgccgatacacatcagcacgccataccacgccaggaacaccaaccattgcagcaggacaggacgaccgagcgcccagaaagcgacgacgatgcccaggagcatgatgaggtaccaataaacggcagtacgctcgtgactcatgccagaacgcaccatcctctgataatagtgctcccggtgcgcttgccagaacttttctccgcgtaacaaacgtctcagaagcgttacagatgcatcggcaataaacggagcgaacaccgccgccggaaaccagaccggccaaatgccccgtgccagccccaatagccgagcgcgccggccatgaatccgagaggatcgaacctgcgtcgccaagaaacagtcgcgccggatggaagttcagcagcaaaaagccgaacgcggctcccgcgatcgccccgcccgcgacgacgagatccggggacggttgcgcgccggacagtgccgcaacggcgtaggctccgaagccgaacagcgccatgccgccggcgaggccgtccgctccgtccatgaaattgtagagattggtcagccagaccatcacgaaaccaatccccacgagcagccaccacggggcggcggccgggtagatgacgatcagcgccacgaccgcggtcaaatgcgccgcaaaccgcacacgagcgggtagcccgcgccgatcgtcgagctgcgacaaggccgccagccccgccgccgccacggcgatgaaccacatctgtggcgcgagccacagcaatgcgacaacgcagaccggcacgatgccccagccaccgacgcgcggcgtcgggcgcgtatgcagcgagcgttcatttgggatgtcggtggcaagtcgccacgccagtccggtggcgagcagcacgcgcaggatcgtcgtcgtggcgacggccgcgcccgttgccactgctaccgcggcaaaccacgtgttaatcgtgaagtgcatgttgcctatttctgtaagtggcgcgaacgataccatgcggccgttgcctcgaggccctgccgcgtcgtatagggcggatgccaattcagtacccgcctcaagcgccccgtgtcgagctgcaggctgcccgtcaggcgatcgacgacagcgcttcgaccggtcagccgaccgagcgcgcgcaacgcacctgccggcaccgggaacagccttgccggcttgccgagcgcgtcgccgaccatccgcagcaatccggcaaccgagggcgcatcgtcgtcagcgacgtggaagcactcgcccgccgcacgcggatcgattgcgcagtgcagcagggcatcggcaaggttgtcgacatagacaacgctgcgacgagcaggaatcgcggccaagggcaatggcgcaccgcggaatacggcatccatcatccggaggaaattggcgcgcaccccggcccgtagacgagcggcggacggacgacgacgacttcgagaccggcctcaccgagccgggccagctgctgctcggcacgcagcttcgagcgcccatatgcatcctgcgggtccgggacggtatcctccgcgagcggtacgcccgcgtcgccctcgccgactaccttgatgctgctcgcgaagacgaaccggcgcacaccatgcatgcgcgcggcatcggcaacccgcaacgtgcccgctacgttggtcgcatcgaaggcggcgtccggatcggaggatttgtcgtgcatcacgtgtacccgcgcggccagatggatcacgcaatcggcctgcaaatcatcgggccacgcaccagcgactccctcgaagtcaggtgcgtcgtgcacccactcgcacgccctcgatacacccacccggccggcgcaccagcgccgtgacggtatgccccgccgccagcgcaagtcggcacacagcgtggccgacgaaaccgttcgcaccggttacgacaatgcggctcaccacaacctccagccgaaccggctatagaacttcagcgcggacactgcgaacatccgaatgtgcgcgaagcccttacgcgaggcgcctccgccgtggtgaatcacgcggatggacgggacataggcgacacgcgcgacattgtgggtgcgcaagctcaagtcatagtcctcgaaatacaggaaataacgagggtcaaagcccctagcgtcttcagcacgttcgttcgaaacagcatgaaacaaccgctgatgattgggatcccagacgacggacatgccgtcgatggtatcgcgcatttcatagcgggcaagtcgcttccggaacggccgtctggcccaggtcggcaagaagccgcgaaccagcaggtcgacgatcgacggaaaccggcgacagagatactgaaacccgcctgctccgtccccgacccagggagcgatcaagcccgtatcggcgtgcgatttgaaaaacgtacgggccaacaccaatgcctgcggatccagatcgatatccggattcaggatcaagtgcaacgacccgctggaatgctcgatcgcaagattgtggccacgcccataaccgacgttgccatgccccgtcaatattcggcataccacgccttgcgcactgagccggtcgaccgccccgaaatgtcgcagagtccgccgttgtcgaccaggaacagctcgacggggtattcaggtgaaaccacccgcaggttctcgcacgctgcgccgaggctgtcgagcgtctgccgcagctgcgcgatatcggggcggtacgaccagggaaatggagagaccatcgacgtcatcggactgacgttgtggggcgcttatgacattcatccggaattcggctaagcgcttgactgcagcaagcgcgatgggttggctggcccgtctgggagacagcgggcttactcatttgtcaggcgtgcagggaatgcctgccgcgtgctcgcgatacgggtgcaattctaactgctcgcacccttgccggacgcgcccgtcccgggacgccgtgcaatgccgctgccctcgatccgtgccggcccaacgcgttcggccctgatcggcgaccagggcgagccacggccggacgggttccagcacgagatacgcgccccttccaggacgcgcctctctcgcggcgccgaatgccgtatctcataaacaccaggaggcctgagcatgtcaatccccgccggacgcctagttgttaaaagatgtgaaaacattaacatctattgcgcgtcatcggcattccggcgatcatgcttggtttccatgggcgagccgtcgtcagtcggtaccggtccggtctcaacccagcgtcgccaagcgccgccaatcaaggcagagagcgcttcagtccagggctggacggatggcctgcattagaatacgttgcgggcgatggcaccttgtttgcccgatcgctcaggattgaagtcgggagcacattgaaacgtcgcggccaactggattgccgcctttttcagactcacgacaccccgcaacaatggctgcgccacgtgggcgaggggttggggctccatcaccgatccgaatgcaacgacacgcaacttgatgaatccgaactcgaagcacccggcatcgccgatggcgatcgcccgtagcatttaccgtaatcgcggactgattctgcaaatgactcaacgcgaggtcgtcgggcgctatcgcgggtcagcaatgggtcttgcgtggtcgttcttcaatcccgtgctgatgctcgtcgtctacaccttcttcttctccgtcatcttcaagtcgcggtggggtaccacgagcgacgacaaggcaagcttcgcgatcgtcctgttcgtcggcctgatcctccacagcctgctggcagagtgcatcaaccgggcgccgacgttgatccttgcaaacgtcaactacgtcaagaaggttattttcccgctcgagatactgccggtggtcgcgctcgcgtcagcgctgttccacagcgcgatcagcctgctggtcctgatcatcgccgagtgcatccttatccactcgctgccctggaccgccatcctgttccccgtcgtcatgctgccgctgatcgtcggctcactggggctcgcatggtttctgtcggctttgggcgtctacattcgagacatttcgcagattaccggtgtcatcacgtcagtgctgatgttcctgtcgccggttttctaccccgtgtcgaatctgccgccacagtatcgatcctggatcgaactcaaccccttacgttcatcatcgaagagggacgcaacacgctgatcttcgggcacccccgactggacgaactggctaacctgcatgatcgcatcgctgcttctcgcgtggttcggattctggtggttccagcggacccgaaagggattcgcagacgtcctgtaatccatgccagcgcgctcgcctgccgccttgcatcagtggcagtggccgtgcacgcggatagatcgccgaccgatcggatcatgacgcgatagagcaatcaccggagatattctgcacatgtcgacgcagccccaaatagttcccaccatcctgtgtggcggcgcaggctctcgcctgtggcccgtttcgcgcgaatcccatccgaagccgttcatccgcctcgaagatggcgagagcctgctgcaaaaggcattcaagcgcggcgcccagcttccgggcgtcaccgaagtcgtgaccgtcacgaaccgcgagttgtacttcaagacaagcgacgaattcagcaccgtcaataccgggcatctgtcgacgtcgttcatcctcgagccgttcggccgcaatacggccgtcgcgatcgcagccgccgcgctgcgtgttgccgcaacgctcggcgaaaatgcaatcctgctggtgcttcccgcggaccacctcgtgacagacgatgccgccttcgcgaccgccgtccaggaagctgccgccttggcgctcaagggtgcgctggtcaccttcggcatcacgccgacgtttgcggaaaccgcatacggatacatcgaggcagacggcacgcgggtcaagcgattcgtggaaaagccgacggtggacgtggccaggcaatacgtcgagtcgggatcgttcctgtggaactccggcatgttctgctttaccgccgcattcctgctggcggaaatggcaaaacattgccccgacgtgctcgaagccacgcgtgcatgcatcgcgcagtctcgtcagtcggaaggcggcggcgtttcattggtcgaactgaacggtgacctgctgaatcgcacgcccgatatttcgatcgactacgcgctgatggagcgctccgacaaggttgaggtcgtgcgctgcgatatcggctggagcgatatcggttcgtggaatgcgctcggcgacctgttgaaaccggacgaccacggcaatcgtgtggacggcgaagcgctgctccacgatgtcagcaattgctacatccgtagcgacaaccggctggtcggcgccgtaggcgtcaaggacctcctggtcgtcgacccccgacgcactcctcattgccgatcgcaatcgcgcgcaagacgttcggcacgtctacgcggccctcaagtcgcaaggccacgaaaccttccgggtacatcgaacggtaggccgtccgtggggcatgtatacggttctcgaagaaagcacccgcttcaagatcaagcgaatcgaggtcaaaccgggcgcaagcctcagcctgcagttgcatcatcatcgcagcgaacactggatcgtggtgagcggcatggccctcgtcgtcaacaacgacgaggagttttacctgcgcaccaatgaatcgacctatatcccggccggacacaagcaccgtctgaccaatccgggcgtcgtcgacctcgtgatgatcgaagtccagagcggcgactacctcggcgaagacgacatcgtccgcttcgacgacaactacggtcgaagctagccttctgccatcgcgcaaaggcggttgcagtcgtcgtcctttccggcgcgcgacgacagcaaccgtctgatcaaccgctccctcacatcatgaccaatgcaagcttccgaggccgcatgaaaagcaggatcaaggcccgcctgctagcgtcgtcgacgtatttttctggccgcgctcaagtactacatcggcaacaacttcattgcgcgcatgccgattgaaagagtccgcaacttctactatcgacgcgtgctgggtatcgtcatcggccaacgaacgcacgtcagcatgcggcagttcttcaccgggtaccacacacgctgcaacgtgcgcatcggcgacaactgcgtgctcaatcgtgagatctacctggacggtcgcacgggcatcgagatcggaaacaacgtcaacatctcgttccagtgctgccttctcagcctgcatcacgatcacaaccacccgggtttcatgtcgatcggcggcgtcgtgaccatccacgaccacgcatggctgggcgcgcgcgccattatcctgccaggcgtgacgatcggcaaaggcgcagtcgtcgcggccggcgcggtcgtcacgaaagacgtcccggatttcaccgtggtcggtggtgtgcccgcaaaaatcatcggtcaacgcaatcccgacattgcctatctgaccgacttttctcctttcttcgacaccgacgtgtttgacgaatcccgtggctaatatgcagaaaaagagcatcctcgtttttacgctgtccccgccgcttcctgccagcgcgggggcccgatctacgtgatgaatacgctcgcgccgctggtcgacgagtatgatttccatctgttcaccatcggtggagacgaggaaaaaagaagatcgaggaaaatcgttcgctatatgaacgacatttcaaatcggtccacgtggagccgcgggctgccatgcctgccgacatgggtacgcccggacgagcatggcattcactggtccactgcttccatggccttccgttcatggatgcgagctacttcagccctgcggcaattcgcagtgcccgccggatcgtcaaggaaaagaagatcgacatgcttgaagtgcacagcagtcatctggcgtttttccgcaagttcttcccggcgttgccggccgtcctggtcagtcacaacatcgaatccgatctcttcccgttctggattcccgcgcagctgacaggctggaaaaagcagcggtcgcgcgcatcgccgagatcagccgccgcaacgcccgacgcgtcgaaatcgacaacgtctggcgcttcgacgccatgacgttcatttcacgcgaagacatggagcgcgtgaaggcgcccgtggagaagcactatttgccgctgtgcttcccgatcaaggacaccgactaccgagcgaagccgaccaacgaggtcaacctgctctggatgggtggcttctggtggtatccgaatgcggaaggtgttgcgtggtttgtccgcgacattctcccactggtacgcgacaagctcgagacgcacaacatcaagctccatttcaccggaggcaacccgccggacgatctcaaggcgctgcacgacggacgacacatcttcgttcacggcttcgtgccgtcgctcgacccgattctggcggatgcacatctactgtttgttcccctgctttcaggcggcggcgtgcgcgtcaagattctggaagcgatgagcaacggcattcccgttctcagcacggcaaagggctgcgaggggctgggcgccgtcaaccgtcgggatatcgtcatttgcgatacggcggctgaatttgccgactcgatcatcgagctcgcccagaatcgcgagatgctggcgacgctgtccacgaacgcccgtcagctcctgaaggacaagtatgatctcgatgcgtgcgttcgcaccaaacgggacctctacaataggctgatgcattcgcggtaaccgaacgaatgctgacctcgcggtgccaccgtggtggccgcgaggcaagtcagcatccgacccctgagcctactgtgcgatcgtctttttccgcctgcgctgaacacgtgaaagctaactcgctccctctcatgcaaactcgcgagcctgaacctacaagccaaacggaacagctgctcgtcaacgtcgagcacctttccaagtgcttccgtatctacgacaaaccggcggaccggctgcggcactcgctcgcgactcgcatcaagctccctgggagcaattcccggcaatacggtcgcgatttctgggcgctgcacgacgtctctttccccgtccggcggggcgagaccatcggaatcattggcagaaacggttccggaaagtcgacgttgctgcaaatcattgccggcacgctgtcgccgagcgacggctcggtcacggtcaacggccggatctccgcactgctggaactcggcgccgggttcaatccggaattcagcggccgcgagaacgtgatgctgtctgcacggatcatgggcatcacgtcggaagaaatccgcgcgcgttttcacgaaatcgaagcgttcgccgacatcggcgaattcatcgaccagcccgtcaagacctactcgtcgggcatgtacgtccggctcgcattcgcggtagccattcacgtctccccgatatcctggtggtcgacgaggcacttgcggtcggcgataccgcgtttcagaccaaatgcctgacgcggatccggaagatgcagaaggaaggcgtcacgatcctgctggtaacacactccaccaacaccctcgtcgagtactgcgaccgggccatctacctgaagcggggccggctggtaaaggacggtccgtgccgcgacgtggtcaagctctatgcgaacgacctcgtcgacgaagaaggcgggagcgcgatcgacatcgaggtgccgacacagcacaccgacaccgattcccccgccagctcggcggtaagcgatgccatgacggccatgtcggaccggacgtcgattctcgacgtgaagatcgaggatgcgaacggcaaggaacgcacgaccttctcgttcaatgaagcgttccgcgtcgtcgtatcgatcagcgtgtccgagccgaacccgaagccttgcttcggacttcagatcaaaagcatcgacgatatcgtgctgtggagcgcgaccacccagcacatgaatattgcgctgccgcccctgtccgccggaacgtaccagttcacctggaagatgcgcgcgagcttctccggcaaccgctatgtgctggcggtcggcgtcggcgatatcgcctccggcgaatacaagcggcacgcgcgcctgccctatggtggccacatcgacgtgcttccggaaaacaacagtggatcggggtggctcgcgccgtgtccggtattcgagttcgaatgatgacggagaacgacaccatgcaagcgcgcagcatcaaggtcgtcgcggtcggctattacggcgcacccaacgtcggcgacgaattgttgctgggcctgctcgctcgccaggttcgggagcgcggcggcgagctcgtcgcactgagcatcaaccccgaatatacgacgcatgcccacggcatcgccgccgtcgactatttcaatctcggtgccgtcggccgcgcactgtccgacgccgatctgctggtattcggcggtggcggcatctttcaggatcatcatccgttcaacgtcgaggcactttacgacccgacccaaaacgatatcgcgggctatgcgcggatttttacatggctcggcagttcggggtccgcacggtcatctgggcacacggcgtcggaccgctggtcaacccggacagccgcgacatcacgcgcgacgtgttcacgcatgtggatcacgtttcgctgcgcgatacggactccgaggcgcttctgcacgatatcggcgtaagtcgggacattcccgtcggcgccgatccgggctgggcattcgtcagccgcccgcccgccgaagtcgacgtttccggcacactcgccccgttggggacaaagaagaagctggcggtcattgcccgatcgtgggagttcaaccggaactgggaagaaaaactcgtctccgcgttgaatgaagcgctggacgacagctggtcgatcgtgtggctcggctttcaatggagcgtcggcgaccacgagcgtctcaccgatcgatcctttctcgagcacctcaagctcgcggtgtcgccccatatcgaaagtgtcatcattgacgggctcacgcccgacgaggcattcgcggttatcggcgagtgcgacgccgcgttctcgatgcgcctgcacggaagcatcctcgcactcggaaaatcgatcccggtcgcggcgctggaatatgacgtcaagatggcgcgtgcgcacgatatggcgggccttccggcgtcgctgcgccttcaactgaacgacgacgcagcagacttcactgccgcggtgcgcaggctgacacacccggatggcgcgccctggatcatcgcgcaggaaaagctcgatgcgctaaacgcttcggcgtgcgtacattcaaccgtcctggaccacgcttttgcggccgttcgcgccgcgtcgggcagagtcccgcgccgctggagcagccagcagctggattggatgagcacatggctcgagcagctcgtctggcaaaagaatggcgccgctcgcatgagcgagaaggcgctcgacctgctgcgctaccgcgattcacaactcgccgagaaagacgcacgggtcggccagcttgagacggaactcgggaaaacagtggatttgctgcatttccgcgacgcacagcttgcgcaacaggaagaacaggtcgccgagcttcagaaccgattggaactggcgaaccataaactgctcgcggcggaagcgttcgtcaagcacgcgtcacaagtgcatgccgcgcaaacgacgacgctcaaggactccgctcgaaaagcggcggaggaacaagctgataaaatttcaagcctcaaggcaacgatccggcaattcgagcagggtcacgccgagtccgaagcaccccgcaacccaatgtggccgcagccgcaattcactccacttcgggatcctctatgctttttcgccggtacatgtccgcccctctcacctacatgagccgtgccgcctatattctgcgcaatggcggcgtacgcgcgctcgtgtctgctgcacgacgccattaccggtatcagcaagcacagcagcagatccagcaggccgccatcgaagtggcaagcggcactccgactgcggaagatcaacgcctctcgttccgcgcagcagccaagctgcaacgcgaagaaatcatcgtcatcgccgctcacgcgtacgactgggctggttccgggcatcgctacgcacaactgaccacgacggcgctcgccgcgggccatcgcgttgtctatctggtcgcgcctccggatacgggatcgacacccgcgccgctcacgccccgcattcccggattgattcacgaatatatcgatccgacgaagatcgaggacattttcggtcaggtatcggaaagcgcaaaattgatcatcggcgtgcccgactcccgggtcacaccctttttcgagttcgcacgcaatcgcgggctcgaaacaatcctcgacgtcgcacaggactggagccacgatggccaggccatgcgcatcctcgagtcgatcgccgtcgatgccgatcgatgcaccgtcggcatgccggcacttgcagacaccatcccgcagcgtgcccgggaaaaatcgagctgctgcccggtgccgcggttcatacggtcttcgacgtctacaagcagtacaaccgtccgggcgacatgccgtccaagcgccgcagcgtcgcactgctctactcggtcgatggactcgactcggtggattaccagtggctcaaggaaaccgcggagcgcaacgtcaacgtcacgttctgcgtgatcgctgacgggcaactgacgccgggcctgccggataacgtcgtcatgcttggcatgcggcacacgagcgaagtgccggcctacatcgcccatgcggatttcatgttcttcccgcttggcgcgcggagcctgcgcagcgccgactccaccgcaggtatttatgcagcgctgcttcagcgcaagccggtcgtgtgttcgatggaacttggcgtgacagccaccccgctgttacacgttcgcacggaccttgcgtcgttcgcggcgcaatgcggcgcactcgctgcggcagaacccgtcacacaaaacgacgacatcttcgttgctggcaacagttggctcggccgcgtcgagcagctgtgcccgccgcagccccggcacgacgtcagcgtcgttatcctgattcacaacaacgcgggcatcatcgcacgctgcctgcagaccctgctccagcatgctgcgccgtacatagcggaagtgattgtcgtcgacaacgcaagttccgatggtggtgcagaactcgtcgagcgcgaatttcccaacgtcaggctggtccgcaacccggagaatggctgctcgtcgggacgtaatctcggcgttcagcacagcacgggcaagtacatcgtcttcttcgacagcgatcagtggtttgtgggcgcgtcgggtttcgaggaagcgctgcacgtcctggaaaacgacgcgagcgtcggcgtcatcggatggaatgcaggctggttcgacgccacgcgcaccgatctcggcggcatgatcgccgactattgtccgaatcgggcgatgaacgcggcggcaatccgcgacggctatcgtgccgacatcggcttcctcggcaccagcggcttcttcatgcgtcggcgcacgttcgatgcgacgcaaggattcgataccttctatgacccgacctgctttgaagatacggacctgtgcttccaggtcaaggcactcggaatgaaggtcacttaccgggatttgtccggaatccgccatcagccccatcaaacgaccggcgccgacagcggcagcgaggcctatcgcaagctattccttcgcaacgcgaactacttcaaggagaagtggcgcgattactcgcatttctatctggactacatcgattgattcgtaacgacagcatgtctagaaccatactgtgcgtcgtaggtacgcgaccggaggccatcaagatggcgccggtcatcctgcgtttgcgagcggatccgggattcaaggtgcacgtgctcgcgaccgcgcaacaccgcgatctgctcgaccagatcctgacctgtttcgatatcaaaccggatgtcgatctcgacatcatgcgtccgaatcaggggcttgccagcctgacgtcgcgtctgcttgacggtatcgatgccgtgctcgtggacaagcgtcccgatctcgtactgggacaaggcgacaccacgacggtcatggccacggcgcttgcatgcttctatcggcatataccgttcggtcatattgaagcgggcctgcgtacccgcgatctcggcaatccgtttcctgaagagatgaaccgcgttttcgcggggcgtctcgcaaggctgcatttcgcgccgacagcgagttcgcgcgacaacctcttgcatgaaaacatccccagcgaccagatctgggtgaccgggaacaccgtcatcgacgcgcttcacactgtcttgcggacacatccgtcctgcggcgtcgatatcgacgacacgaaacggctgattctggtcaccgcgcatcgccgggagaatttcggcgccccgctcgaacggatctgccatgccattcgccagattgtcgacgccaacgacgacatcgaggtgctgtttcccgtacatcccaatccgcacgtccagcgtacgacgcgcgaactgctgtcgcaccacgcccggatccgactctgcccgccgctcgactatgtgccgttcgtcgctgccatgcagcgctcgtacctcatcctcagcgactcgggcggcgtgcaggaagaagcaccagctctgggcaaaccggtcctggtgttgcgcgacgagaccgagcgcccggaagctgtcgaagccggtgtcgtcaggcttgtcggcactcaaaccgatacgatcgtcaatgcggtccaactgatgctcgacaacgccgacgaatacggcaaggttgcacgcggcgtctcgccctacggtgacggaaaggcagcccagcggattttcgacgtcatccgggaacaatgcgtgtgatcgaacaactcgtctatctgtcgccggtgccatggagcagctttgcacagcgacctcacaagttcgtcgagtggtttcatcaagaaacccatggccgtgtgctctggatcgatccgtatccaacccgcctgcccatgcttcaagacttgcgccgtccatccggcgaaggcaagtccgacgcgcataccgccgcgccgccttggctcgacgtcgtccgcatccgcagccttccgcttgagccactgcccctcggcaccgcaatcaatcgattcggatggcgtgacatcacgcgtcgcgtcgtgcaattctgcgccgagcgcaacacgcttctcgcggtcgggaagccgtccgggctcgcgctcgacttgttacgagcggctcgtcccgcccggtcgctctacgacaggatggacgacttccgtcgttctatcgaggcgtttcgcgctcggcgatgaaacgcaccgaactcgctgtcgcgcgcgaggtcgacacggttttcgtatcgtcttcgggcttacgctcgagctggagcagtattcggcctgacgccaggctggtccacaacgggctcgatccagccgtccttccggcgttccgcgaaaagacgtcggatcatgccgggccgcatgtactgggttacttgggcaccatggggccttggttcgactggcaatggctcgctgcgcttgcgcaatgccgccccgcggacacgattcgattgatcgggccgttattccatccccgcaaatcgcgctgcccgagaacgtgcagattcttccgccgctgaaacacgccgccgctctcgccgcgatgtcggacttcgacgtcggcctgattccgttcctgcgcaacccgctcacggacggtgtcgatccgatcaagtattacgagtacagagcgctcggattaccggtcatctcgaccccttcggagaaatggcaacacggtgcgacgaacccggtacattcctctcgagcggatccgagaacctgtcttcaatcgttgtcgaggcactcgaataccggacgacgcacgacgaggtatcgcggatccggagcgcaaacagctgggccgcccgtttcgcggcaacaggcattctcggctagtgttctatcgttctatccccgctcgatcgcggttcgcttcggcatgcaaggctgacaagacggtaaaacccggtgacgggatccgccgcttgctcgactgcccgttaccctgacgcgcccggtcaataccgagcgatgcaccggcgatccctttcagtcggccatgcagaggcccagcgcgtattcccaatcgggcaggtgcaagccgaacgtctcggcgagtttgccgtgggacaagcgcgaattcgccgggcgacgtgcgcgcaccggaaactcgctcgcggaaatcggcaccacagcgggtgcgtcatcacccatcgcgataccgagaatcgccttggcgaaaccgtgccaggacgtctcgccggccgcactcagatgataggttccggagcgcgcctgccaccaggcctcatcatgggccgccagccctttggagaggatgtgcgcagtcgcggctgcaattgttttcgaccaggtcggcgcgccgacctggtcggcaaccacacgcaattcgggtcgctccgcgcccagcttgagcatcgtgcgcaagaaattcctgccacgtcgcccgtatacccagctggttcgcaaggtcaggtacgcgcaccctgcgttctcgatcgcacgctcgccctcaagcttggtcatcccatacacgttcagcggattcactgcatcggtctcggtatacgcgcccgccttggctccgtcgaacacgtaatcggtcgagtagtgaatcagcaccgcaccgctgcgcgcagcctcttccgccaggactcgcggcacatcggcatttatgcgtcttgccgcatcgacgtcgtcctcggcattgtcgacggccgtataggcagccggattcacgatgaaggccggctgcaacgcccgcacgacagcacggatccggtcgagatcagacagatcgagcatcgagcggtcgcactccaccacacggccgagcccctgcagcgagcgcagcagctcaaagcctacctgacccgtgacaccggttacgaggatcgtcgactcggaattcatcacgacctcactcaaaagatctgcgtccatcaaccgcatgcccgcggcatccttgacggccagcagcggctcgccatccagcggccacgcgatcccgatgtccggatcgttccagacgatgctgcgctcgtgctcgggaaaccaataatcggtcgtcttgtagagaaactgagcagactcggacaccacaaggaagccatgcgcgaaccccggcggaacccaaagctgccgatggttgtcggcggacagcgtcacgccgacccacttgccgaaattgggcgaactgcggcgcacatcgactgcgacgtcgaacacctcgccctcaaccacgcgcaccagcttgccctgcgtgtgttcgatctggtagtgcagcccgcgcagcacgcctttgcggatcgcgagtgattgtcctgcacgaactcgatacccggagcgacgtgctccgcaaactcgcgcgcgttgaagctctcgtagaaatacccgcgcgcgtctccgaagaccttcggctcgataagcttgacttcgggcagtgccgttgacgttacgtggattgccatgcgacctgatgggtgagtaggttccggagatacagcccgtaggcgttcttcgcgagcggctgtgccagtttcagcacctgctccgcgtcgatccagttgcggcggtacgcgatctcttcggggcacgcaaccatgagaccctgacgcttctgcagcgtcgcgatgaacgtcgccgcctcgatcaaggaatcgtgcgtacccgtatcgagccacgcgtaaccgcgccccatgagctcgacgtcgagctggcccgccgccaggtagcgcgaattgacatcggtgatctcgagctcgccgcgcgccgacggcttgatgtcggctgcgatgtcgcaaacctgcctgtcgtagaaatacagccccgtgaccgcatagctcgaacgcggctttgccggcttctcttcaatcgataccgcgcggaattcgcggtcgaactcgaccacgccataccgctcggggtcctgaacgtgatacgcaaatacggtcgcgcccgtatccttcgcgctggcccgctcgagctgcttcgcgagatcgtgcccgtagaaaatgttgtcgccgaggatgagcgccgacggctcgttgccaacgaagtcccggccgatgacgaacgcttgcgcgagcccgtccggcgacggctgcgtcgcataccggatattcatccccactggctgccgtcgccgagcatcgactcgaagcgcggggtgtcctgcggcgtcgagatgatcagcacgtcccggatgcctgcaatcatcagcgtcgacagcggatagtagatcatcggcttgtcgtacaccggcagcagctgcttcgatactgcatgcgtgatcggatagagccgtgtgcctgaaccgccggcgagaatgatgcccttgcgtgccatcgcctctcctgtcaaacgcgtgctgcgtaattggtctcgacccacttgcggtattcgcccgaagccacctcgtccgaccacgcctggttgtcgagataccaggagaccgtcttcgcgaggccggttgcgaacgtctcggccggcttccagccgagttcgcgctcgagcttgcgcgcatcgatcgcgtaacggcgatcgtgccccggacgatccttcacgtacgtaatctggtcgcgatacgtgccctgtgccctgggtcgggcatcgtcgagcagatcgcacagcgtatgcacgacgtcgagattcgtcatttcgttccagccgccgacgttgtaggtctcgcccggcgtgccgcgtgcgagcacttcgcgaatcgcgctgcagtgatcgccgacatacagccagtcgcgcacgttctggccatcgccgtagaccggcagcggcttgcccgcgagtgcattggcaatcatcagcggaatcagcttttcggggaactggtacggaccgtagttgttcgagcagttggtcgtgagcgtcggcaggccatacgtatggtgatacgcacgcaccaggtgatcggagcccgccttcgtcgccgagtacgggctgttgggcgcgtacggtgtcgtttcagagaactgcggatccgtcgcggacagcgaaccgaacacttcgtcggtcgacacgtgcaggaaccggaagccggcctgctccgcgtcgggtaacgcgctccagtactggcgcgcggcctcgagcagcgtgaaggtgccgacgacgttggtctgaacgaactcggccggaccgtgaatcgagcgatcgacgtgactttccgccgcgaaatgcaggatcgcgcgcggccggtgctcggccaacagcgcgtcgagtgccgcgcggtcgcagatgtccacgcgggcgaatacgtgcttcgggcttccgttcagcgattgcagcgtgcgaaggttgcctgcataggtcaatttatcgacattgagcacggcctcgtcggattgactaagccagtcgattacgaaattggcgccgataaaacccgcgccgcccgtcaccagaatcatgaggctccctctagtcatgcatggcgtgcctcaagcgcgagccgccacgaactccggacgcgacgatgacgtgcacgtcccccaaggcgggcattctaactgctgaccgtaaccctcaaaaccatgaaatgctaattttgttgaagggccaccaattataagaagcgggttgggtcaaaatccacgtcgctaacaacttgaaacagcgcccggaccctccccgaaaaatattcattcaaatcaatacgttaaaattccccgaatacgctcgcagttgagttgcagcgatcgcatcctttttcgacccgcgtcaggatttgtaacaacctacctctcatgacccgcacccccatcgcaatcggcgacatccagggctgtcattccgctctccagtcgctgctcgacaagctgtccccgcctgccgacaccccgctatggatcgccggcgacgtcgtcaatcgcggccccggctccctcgccgcgctgcgtgcgctcgtcgacctcggcccgcgcgcgaccgtcgtgctcggcaatcacgacctccacctgcttgcggtctccgccggcctgcgcaccgagcgcccgggcgacacgattggcgaaatcctcgacgcccccgacgccgacgcgctgctcgactgggtccgccatcgcccgttcgtgcatgcggaaaacggaatgctgctcgtgcacgcgggcgtgctgccgcaatgggacaccacgctggtgctcgaactcgccgacgaactccagcgcgctgcgcgcgcccgactggcgcgacacgctgcagcagctgtacggcaacgagccgaatcgatggagcccggatctgaagaaacgcgaccggatgcgcgtcgcgttcaacgcattcacgcgcgtgcgcttctgcacgcccgacggcgcgatggaattcaaggcgaacggcggccccgacagcgcgccgcccggctacctgccgtggttcgacgtaccggggcgccgcacggaggacgtgacggtcgtgttcgggcactgggccgcgctcggcctgatgctgcgagagaacctcgtcgcgctcgattcgggatgtgtggggtaaccagctgtcggccgtgcggctgacggccgatccggcgcagcgcacggtcacgcaggtgcagtgcgaagcgtgccgcgagccgggcggagagtgacgagagactgattcgcggggccggaggtgggtcggccccgacgcgtcagccctcgcgccccggcacgggcgcatcggccgcttcgttgcccgcttcgccggcaccgacctcggtcgccggatacgcatgcttcgccagttccgcgagcgactcggccgacggcttgccgaccttctcctgcagcgtcgcgagcgcggccgcgatcgcatcgcgcgccgcggcggacgtcgcccgccggtcgccgcccggcgcgatcggctcgcacacgtaaagatgcgcgacgatcgggccgccgcgcagcaccatgtcgagcgacttgccgagcgccagctcgcccgtgtaggccggcgcgaccgactgccgccgctgcgcgtcctcgtacatcaggcagatcggctgcaccgcgcagcccgccgataccgcggcctggaacaggttcgcatggaacggcagcagttcctgcccgtcggtcgtcgtgccttccggaaacacgcacatcagcccgccgttgcgcaggcgctcggccatttcgtgcatgacccgcatcgcctcggtgcgcttctcgcgctgcaggaacacggtgtcgagcttctcggcgagccagccgacgaccggccattgccgcacctcggccttcgacacgaacggcgtcggccgccacgcgttgatcgtgtagatgtcgagccaggacacgtgattgccgaccacgagcgcactcgcgtcaagccgcgcgccgtcgttgtggacgacgaggcgcatcccgcagatccgcagcagcttgagcgaccagcggcgcgtcatctcggcacgccgcgcgggcgtgacgtgcgaaaaacgcagcgcgacgatcgccatgccgcgcaacaggtgaaagacgagacgcagcttgcgaagggcaatcatggcgaaggtccggcgtggttcaggggcgctcgaacgcgatctgtccggcgacgagcgtcgtgcgcacgcaggcgggcagttcgtagccgaggaacggcgagttgtggccctggctcttcagcgcacgcggctcgacgcgccagtgcgcgcgcgggtcgaacacgcacaggtcggccgcgccgccttcggcgaggcggccggccggcagctgcagcacgtcggccggcgcggacgtgatgcggcgcagcgcctgcgccagcggcgtacgcgtttcgtccgcccacttcagcgtcagcgacagcagcagctcgagccccgtcgcgcccggcgtcgcttcgccgaacggcagcagcttctcgtcgtcgtcgaccggcgtgtggtcggagcagatcgcgtcgatcgtcccgtcggcgagcgccacgcgaatcgcttcgcgatcgcgctcgctgcgcagcggcggatcgagccggaactgcgaatcgaagtagccgatgtcgacatcgatcaggtgcacgtgattcacgccgacgtcgcacgtcacgggcagccctcggccttcgccgcgcgcacgagtgcgagaccggccgccgacgacagccgcgcgaggtgcacgcgtgcgcccgtcacgcgcatcaattcgaagatcgtgtgcagcgcgatcgtctcggccgcaaccggcacgccggacagcccgagccgcgacgcaagcgcgccgctcgcggcaacgccgccacggccgatgaatgcgtcctgcgggcgcagccacgtcgtgtagccgtaggtgctcgcatactgcagcgcacgcagcagcacctgcgtgtcgcgcaccggcacgttggcatgcgtgaagccgacgcagccggactcggtcagcgcgaccatctcggtgatcacttcacccttgaggccgaccgtcagcgcgccgagcggatgcacgttcgcctggtggaggttgcgtgcgcggaacttgagcatctcgacgaggcccggctcatcgagcacggggtcggtatccggcgggcagacgagggtcgtgacgccgcccgcgacggccgcggccatttcggacgcgagcgtcgccttgtgctcgtagcccggctcgcgcagccgcgcgcacaggtcgacgaggccgggcgcgacgatcaggcccgatgcgtcgatggtcttctcggcgttgaaaccggccggcgcggcggtgccagcgtcggcaatcgcggcgaccttgccgtccgcgacgaaaacgtcggcctgccgttcggtgccggcgaccgggtcgatcagcgtgccgcctttgatatgaatcttcatgcgctgtctgtgaatgcgttgaatgcgttgagtgcctggatcaggatgcgcgaaagcgggctcagtcgctgttgccggcgacgatgcccatcaccgccatccgcacggcgatgccgaacgtgacctggttgaggatcaccgactgcgggccgtcggcgacctgcgagtcgatctcgacgccgcggttcatcgggccggggtgcatcacgatcgcgtcgggcgcggcgagcgcgaggcgctcgggcgtcaggccccaggtcttgaagtattcctgcgccgacggcagcagcgcgccgctcatccgctcgttctgcaggcgcagcatgatgatcacgtcgacgcccttcagcccttcgtcgaggttgtggaacaccttcacgcccatctgctcgaggccgcccggcagcagcgtgcgcgggccgatcgcgcgcacttccggcacgccgagcgtggtgagcgcgtggatgtcggagcgggcgacgcgcgaatgcaggatgtcgccgacgatcgccacgcgcagcttcgtgaagtcgcgcttgtagtgacggatcgtgtacatgtcgagcaggccctgcgtcgggtgcgcatgacggccgtcgcccgcgttgatcacgtgcacgtgcggtgcgcagtgctcggcgatcaggtacggcgcaccgctcgacgcgtgacgcacgacgaacaggtcggcatgcatcgccgacaggttgttgatcgtgtcgagcagcgattcgcccttgctcgtcgacgacgcattgatgttcaggttcagcacgtcggccgacaggcgcgtcgcggcgatctcgaaggtcgtgcgcgtacgcgtcgagttctcgaagaacaggttgaacacggacttgccgcgcagcagcggcaccttcttcacttcacggtccgtcacgctgacgaactgctcggccgtatcgaggatgtgattgacgatcgagcgcggcaggccctcgatcgacagcaggtgcttcagctcgccgtttttcgtgagctgcggattgcccttcaggaagccgtagcggaaccggtcggggctcgcggccgcagcgggattgccggtgcggccagtggtgtcggtggtcatggtgtgcgtgattccaactatgcaaacgggccgcggtgcaaaccagcggcccgggatacggttcgcgtgccgctcaggcgccgtgcgcctcgacgcgcagcgtgaactgcgcgtcgtcgcgcgcgagcacgagcgtcgcgccggccggcacgtccagcgtgccgcccgcgaagcgcgcggcgaccggcagctcgcggccgccgcgatcggcgagcaccgcgagctcgaccgcggccggacggccatagtcgaacagctcgttgagcgccgcgcgcacggtgcgcccggtatacaacacgtcgtcgacgagcacgatgcgcgcgccgtcgatttcgaacgggagcgacgtcgggctggcctggctgtgcagcccctttttcgcgtaatcgtcgcggtgcagcgcgacgttcacgacgccgaacgccggcgcgccgagatcgcgcgcgaggcgctcggcgagccatgcgccgccgctgtgaatgccggcgagccgcgggccgcccggttcggcgaaagccgtgccgtacgcggcgcggatctggtcgagcaggacgcggtaaagcgcctcggcgtcaatggtgctcatggtcggacaattgatcgagatactgttgaaggatgacgcgcgcggcttcggcatcgagcatctcggcccgagcacggccgcgcacgttgcgctcgcgcagcccggcctcggcctcgaccgacgaataacgctcgtcgacccacgtgacgggcagcccgaagcggccgttcagctggttgccgaagcgcttcgcctgctgcgtcatgtcgtgcggcgtgccgtccggatgcatcggcaggccgacgacgagcgcgtccggccgccattcggccagcaggtcgccgaccgccttgaagcggtgttcgcggttcaggttctggatcacgacgagcgcacgagccgagcgcgtcagcgcattgccgatcgcgacgccgatacgtttttcgccgtagtcgaacgcgagcagcgtcgcatcgcgcgcgctcgcgccactcatgcgtgccctgcttcgccggacagcatcgacgaactgacgccgagcaggccgagcgcagcttcgaagcgctcttcagccggcgtgtcgaacacgatgcgcggatcggcggccacggtcagccagccgttgcgggaaatttcttcctcgagctgcccggcccccagcccgcatgcccgagcgtcagcaggaagcgtttcgggccgttgcccgtcgcgaccgcctcgagcacgtccttcgacgtggtcatctccagcccgccctcgacggacatcgacgagttgtagctcgcgccctccaccggttcatgcagcacgaaaccgcgctcggtctggaccgggccgccgaaatacaccgggatgtgcagcagcggctcgatgtcgagcttcaggtcgatgcggttgaacagcgattcgaggtcgatgtcggtaggacgattgatgacgaggccgagcgcaccgcgctcgctgtgatcgcaaagatagaccaccgttcctgaaaacgtcggatccgccatgttcggcatggcgatcaggaactggttggtgagattgatgcgatcggaaggctttgacatggtttgaattttagcaaagacgccgcggcctgaccgggccgcgatcaacaagcaacgccgcgccgcgctggcaacggcgcgcgcggatcacacggcactctaacacgcgcgcgggcgctgtcggcagcgtgttgcaggcccgcgcggcaagggccgccgccgcgtgttcgtccccttgctcgtcccctgttcgtcaggcccggccgagcgctgcgccgagcgcgccggacgccgcggtgaggtccggcggcgccacgccggccgcgatcttcagcagcgccgcgcgcagcatgtcggacgcgtggccgtgcgcatcgaggccgccgtcggcaagcggcacgccgtgcgccgcacgccgccacgccaggcccagcgtgtcggccaggagcgccgcatggccgagcccgagcgcgcatgcggccgtaccgacccggtaggcagcgccggacgcgtgccatgcggcccccgcgtcggccgcggccggatcggcagcgaggtcggccatcgacgcatcggccgtctgcaggaaatcctcataggcatgcgcattgaccgtcacgacgccaagcgcgcgggtcggcgcggcggcaaccgcatcgtgctcggcccgggcggcatcggcctcccacagcgcctccgatgcgggcgtgccggcgacgtgccagtcgaccgtcagcccgtagtcgtgcagtacgtcgacgagtgcgacatcctcggctgcggcgccgaacagcgcgaaatcgcgccacagcagcgccaccgtctcgcgcacgagttccggcggcgcactgcgccggccctgcgcgtgctcgccgagcagcaaattcgtccgcgcgagaaagcgcttcagctccggcgcgccgctggcgcgcagcgcgcgcacgcacgcggccgcgagccgccagaaatcgtagggatcgtcgcccgccagcacggccagcatcgcgtcgagttcggcgagtgccgcatcaggcgcgccgtgtcccgcgcgcagcacgccaagcagcgcctgttcgtagcgggcacgaatccgggtcgcaaacgcatcgggcaacgcgcgcagcgtggccggcggcaccgcacggccgacgagcgcgagcgcgtcgagcggcgcgctcgcgcgcaggtcggcggcgctttgcgcgcgcaaggcacggaaatgttcgaagagaacgggcgagcaggcgagctcgcgcaggttgtggcggctgacggccgcgcggaaatcgcgcagcgcggcccgccagtcggccgaagtcggctcgacggcgacgagcggcacggcggccgacaactgccccgcgaatcgcgcggccggcagccagccggcttccgccagcacggccgccgcggcggacagcggcgcggccgcgtcgtcgcgacgctcgaatgcgtcggcagccgccgcaagccacgcgtcggccgcgcgcacggccccgccgcgcgggttgggcaatgcgtcagggtggggaacgttcgccggttcgggcctcatgcacacgcgcgcctgtcatcgtcaagccgctcgcgcaggcctcggcgcgcgagcgccggaccgatgcgaggcctgagcggtgtgccgtgggccgagggtccggtcagatctggaccatctcgaagtcttccttgcgggcgccgcattcaggacacgtccagttgatcgggacgtcttcccagcgcgtgcccggggcgatgccctcttcgggcagcccggcttcttcgtcataaatccagccacaaatcaggcacatccagctcttgtattccatcttaagccgcgtcgggaaagtcggtaaattcgggagccatgatggtaccgtgtcggggccggactgcctagcaatcgcgctggagtaaggcgactacgttgcgctgcgctaaaaatccgtcgtgcgggccggattccgccgcataatggctgaaaagtgcggcctgccgggcaacacagggccgaaaacgcccatttcgcctcgccgtccgcatgtccgtcgctttcccgttttctcttgccccatttttacatgtccagcaacgcccctccgatcgtcctcaccttcggcctgtccgatcccaccggcggctccggcctccaagccgatctgatgaccctggcgagcatgggctgtcacggcgtgtccgtcctaacgggctacacggtgcgcgactcggccgcctgcgacgaagtcaccggcctcgatcccgacgtggttgccgcccaggcgcgcatgctgctcgaagacatgccggttgccgcattcaagatcggcgcggcgacgcgtgcggaagtcgtgagcgcgatcgccgaggtcgtcgccgactacgacggcgtgccgctcgtgctcgcgccggacttcacgctcgacgacgaacacgtgctcgccgccgacgacctgcgcgaatcgatcgctgacctgctcgcgccgcaaaccacgttgctggttgccgactacgcgacgctgatcgcgctcgcgcagccggacggcgacgccgaggcgccgaatctcgacgcggccgtgtcgcacctgctgtcgcagggctgcgagtacatcctgtcgtccgagaccggctcgcaccggctcgtcaacacgctgtacggcgaagaaggccagctacgcgaggacatgtgggatcgttcgccgcatcggctgatgggcatcaccgacacgctgggcgcggccatcgcggcactgctcgcgaacggccaggagccgcccgaagcggttcgtgaagcgcaggaatacctgtaccaggccgtgcgtgacgcgttccggcccggcatgggcgcgtatttgcccgaccggttcttctgggcgcgcagcaatgaagacgccgataccccgccggcggtgaaggtcgacccggtgccgaggacgtcgcaccggcattgaaccggacacggcgggcacgtccgccgtcgcggcggactcgcagcgccatccttgccgcacccggccgtcccgcacccgccgccgattcaacggcaccaataaaaagacccgcatcgctgcgggtcttttctttggctggaacgcgcatcgctgcgcgctccggacaccatcgaccgaagtcgattacatgtccatgcccatgccgcccatgccgcccggcatgccgcccggcatcggtgcgtcttccttcggcagttcggcaacagctgcgtccgtcgtcagcagcaggcctgcaaccgaagctgcgttctgcagtgcggtacgcgtgaccttggtcgggtcgacgacgccggcttcgaccatgtcgacgtactcgcccgtcgctgcgttgtagccgtagttgcccgtacctgcagcaactgccgccaccacgacgctggcttcttcgccgccgttcgtgacgatctggcgcagcggctcttccattgcgcgcagcacgatcttgatgccggcgttctggtcggcgttcgcaccggtcaggcctgcgatcgcggtgcgagcgcggatcagcgcaacgccgccacctgccacgatgccttcttccacagctgcgcgcgttgcgtgcagtgcgtcttcgacacgtgccttcttttccttcatttcgacttcggtcgctgcgccgaccttgatcactgcaacaccgccggccagcttggccacgcgctcttgcagcttttcacggtcgtagtccgacgtcgcttcttcgatttgcgcgcgcacttgcttcacgcgtgcttcgatgttcacggcttcgcctgcgccgtcgatgatcgtcgtgttttccttgcccacttcgatgcgcttcgcctggcccagttctgccagcgttgccttctcgagcgtcaggccggtttcttcggcgatcacttggccgcccgtcaggatcgcgatgtcttccagcatcgccttgcgacgatcgccgaagccaggcgccttgaccgcaacggtcttcaggatgccgcggatgttgttcacgaccagcgttgcgagcgcttcgccttcgatgtcttcagcgatgatcagcagcggacggccagccttcgcgacttgctcgagcaccggcagcagatcacggatgttcgacaccttcttgtcgtgcagcagcacgaacgggttgtcgaggacggcgacttgcttttccgggttgttgatgaagtacggcgacaggtaaccgcggtcgaactgcatgccttcgacgacgtcgagttcgtcggccagcgacttgccgtcttcgacggtgatgacgccttccttgccgaccttgtccatcgcttcagcgatgcgatcgccgatcgacgtgtcgctgttcgccgagatcgagccgacctgtgcgatttccttgttcgtcgtgcacggcttgctgatcttcttcagctcgtcgacagccgctgcgactgccttgtcgatgccgcgcttcaggtccatcgggttcatgcccgatgcgacgtacttcatgccttcgcgaacgatcgattgcgcgaggacggttgccgtcgtcgtgccgtcgcctgcgttgtcgctggtcttggaagcaacttccttgaccatttgcgcgcccatgttctggagcttgtccttcagctcgatttccttcgcgaccgacacaccgtccttggtgaccgtcgggccgccgaagctgcgctcgagcaccacgttgcggcccttcggacccagcgtgaccttgactgcgttggcgagaatgttcacgccttcgaccatcttcgaacgggcggaatcgccgaatacgacgtctttagctgccatcttctaactccttgaattcttgggaatatgtaccgtcggtggacgcttacttggcgttgaccacggccatgatgtcttcttcgcgcatgaccagcagttcgttgccgtcgacctttacggtctggcctgcgtacttgccgaacaggacgcgatcgccgaccttcacgtcgagcgcgatcggggcacccttgtcgtcacgcttgcccgggccgacggccaggacttcgccctggtccggcttttcagcagcggcgtcggggatcacgatgcccgaggcggtcttggtttcctgatccaggcgcttgacgatcacgcgatcgtgcaaaggacgaaggttcatattcactcctctcttgactgagattgaagaacgcttagggaatctgcccggcttatcgcccggcagagaattgttagcactctcgtgcagcgagtgctaattatatggacgggttttgacaaattcaagaaggggattgacggttttttcgggccggcgaagcccgctcgacctcgaacgttgctcacccgaacgtgaacccagggcaacctcgacgaaccaggaacaccccgatatgtcctgcaaaaacaatagcttgacataaacccgggcgacagcccgagaaaccgggaagacgccgcgcgccacttgcccgatccgtccccaccggaaaaccacacggctgcgatccctcagggatatcccgcgtatccgggcaaacccaggcaaattatatggggtacgaataccccactgcgcccgcgggaaggaggcaccgccccgcattcgtcccctctagacaagagaagttcatcatcttgctgcgccatggctggcgcacggaatcgcacagaacccggacgaccagcccgtcgacacgtcatgcatcggatccacgaaatcgctggcgcgaaacgggctgcccacgcgataaccgccgagagcagcccggatcaccatcacacaattagacggacgaatctcccggaattgtctaaaccagcgcggaagcagggctctcggcaatcgcacgctgcgggaccgggccggggccgcaaaattctccgccgttgaaaagtcgtcgaccatatcgagccggtagccatgcgtatacacggcactcaattgaagcccgttttccggacgaagcgccaatttttgtcgaagtcgatagatatgcgtgtcgaggctccgcgatgttccatcgagcgctcgcccccacgccagcgtcgacaaggaatcccgggaaagcacgctcccgatgttggtgaacaggaaatttgccagcgcaaattcctttgccgtcaagtcgatgatctttccgtgcacggcgattgtgcgcgccagcgggttcaacacatacgctccgacctcgaccctgctgtcgggtttcttgttgcggccatttcgacgcaacagcgcgttgacgcgagcggccaactcgatctcgcggaacggcttgccgatgtactcgtcggctcctgcgtccagcgcggcggcaacatctgcttcaagcgttctcgcggcaaggaacaaaacgaccggctcatctccgacgttggcccgaatccagtgcagcaaattcaggccgttggcatctggaattcgccaatcgagcacgatgagttcgaccctctcctttttcagaaactgaacagcccgtgtgctatcgcacacccggaaaatttcctgacccgacccgtgcagcgccctttcaagggccgacgcctgatcgtgatccccttccactaacaagatactcataacaccccagccttcgtcgacccgaatgattttcatcgcactccaaatcgatcgcctgaatacacaggtctgaacgtatgttttgtttttgataatgccgaccgattgaaaccaacctcatctcacccctacatcaacctcaaaatccagcgatacacgaccttgcaaccttgcccgtcatcaacttctccaagtacccgctgttccgtgcccaacaccaaagagcggcgtcgacgatgcggattggcagaccgtcgcgagcctgtcaggcaagccggcacctggattgccatttcatgccggcctcgatagcgatcgacgcgtcgagcaaactcatcgcccgccctggcttgaaatggcgcattcacataccatgccactcaaatgttactaacatatcagtaggatatcgagacacctgccagagatcaaaggggtaaacccgttcctcgaacttgcccttttaagtctcgagttgaaaacaagggggacctgactaatatgttagtgatattcttcaggcaaacacttaggcaaatgaacggactgactggcagtaccctggccgaacaagcccacgataaactcgaggaactcatcgtcacgctggagcttgcacccggcagcgtctggtccgaggcctctctcgcagaaaagctgaataccgggagaacgccggttcgcgaggccgcgcaacgactggctgcgtcgcatctccttcagatcgttccacgacacggcatcatgatcaccgtcccgaacattcatgatcagttgctcgtactcgaaacgcgccgtgaactccaacgcctcatcgcgcaacgcgctgcacggcggtcattgccagaggagcgcgaacagatccgcgaaatcgccaaaaactcgacgcggcaggcgaatctcgagacgtcgtcgcctacttgagatgcgtctatgcgatcaatcaactcatcgcgcagttttcacggaatcggttcgccgccgaggccatcgcgccgttacatgccctgtcgcgacgcttttacttcatgtatcacaagcagctggatgatttgccgtcggcgagcctgcagcacacgagagtcgcgcgagcagtcgctgccggtgacgagcaggaagccggacgctcatccgatttgatgatggactatatcgacgcattcacgcgagattgctttactcgcgactttgaaccgcatcactcacgcgtatcggcctgatcgtacttttcggtttcgattcgcgatatcgactcaaggttgcggcctgtcctttcatgcgtcacatggcacgttcgatcccgcgccttcgatgagtcgagcctgcgcctgtgcccggcaaataatgcgcacgctcgctcgtaagcatgccggttttgacgcaacggcatcatcccctgaaggcatcgcatggacaccccgcccatgtcgacccgtcacggagtgccacactcgtcacgccctgccaggccgcggtcaagtggattcccctgaacaacaacgccctcgcttccccggaattccgcatcgttcgatcaatcgatccacctgctcctctcgaacgggttcggagatgtagtatccctggcaatcaatctgcatcatttctctcagccactcgaactgagccctggtttcgacaccctccacgacgacgttcttcttcaagcggctcccaagctcgacgagcgcttcgaccatcgctctcgattcggcactttcatgaacgtcgcgcatgaaggatcgatccagcttgagtgtatcgacagccaggccatgcaatttggtcaacgaccagcaccccgaaccaaaatcatcgatcgcaacgctcgccccaagatctcgaatcgatgacacggccgcggcaagtgcctctatcgggccaggatcgatggactccgtcagttcaatctgaaaattcgcggcacggacggcgtaggaatccagaacgagcgccagtcttcttgccattcccggccgcgtgacttcatgagcgggcaaattgacggacagagacaaatcgtcatagccgagcgcagcccaaccggcgagcacgcgcgcggactcctcgaccacataatcagtgaatcggcatgtcagatgcgaatcttcgacgaggtcaatgaacgccgccggcatcaacacgccgcgctccggatgctgccagcgtatcaatgactcgaatccggacaacaatccggtctgaaggcggagctttggctgataaacgaaaagaactccttccgcgccaatccacgctccgcgtcttcgacaagatcatcggtattgcaacgcacggccgcaccatccacagcgatctccaatgcacgcactcgaaattccggtgcccgccgatacgccttgctcccgctccgggctttcagtcggccgtgcgcgaacatgcaattacttccactgatacagcatgccggcgccgatcaccttctgaccgccgctgaaaccgccgttgatcgacgccttcaggttgtccgtgatgcgcgcctgcatgttgaccgccatcgccttctggccgaggaaggtcgacgtgcccacacccatcccgaagttggcgtcgcgatcgagctgcgggatcgacgccatcgcgccgacggctgcgataccctgcttcgccatctggtcggtctgctgcagttgcgaacccagcgagttgatctgcgcctgctggcccgacagtgccgtcgacaacgtcgtctgcacctgcgtcagctggttcacgttcaccgcgtcggtgccttgcgtacccggcgcgacgttcgtgatctggcgctgctgcgtgtcgctgccgaccgacaccacgttcgagcgaccgccgtcgttcgaattcgcgccgattgccaccgagttcgagccggcagtgacggttggtttgtcggagccggtgccgttcatgtcggcggcgatgccgccggtgttcgtcgtgttcgtcgtcatcaacgtggaaagctgactcaactggttgttgatgttcgtcacgccagtcgacagcgaggccacgctgttgttcgtcgtgctcaggccggtggacagggaactgagaccggccgccgtcgatgtcgacagcgcgttgatcgcggttgatgtcgaggtggacagcgcagacacgttgctattggtcgagctcaggcccgtcgacagcgagttgatacctgtcgacagcgatgcgacgttcgtcgcggtcgacgtcgacaggttgttgaccgcctggttcgtcgcgttcaactggctgccgttgatcgcgtccgtgctggtggccgacacctggccggcagcgacgttcgtgatctggcgttccgcgcccggcgaaccgatgctcaggacgcccaccggactggtgccggcgaccgagtacgcgacaccgccgaccgtgacgctcgacaccgcgaccgcattgccggtgaccgagttcgcgccgagcgcgatcgagttggcgacgttcgcggtggcgttcgatccgaacgcgagcgcgtcggtggcgctggccgtggcgcccgagccgtaggcctgcgcgccgatggcgctggccgtggcctggttgccgagtgcgatcgtgttgtccgcggtggcctggctcgagttgccgagtgcgagcgcgctgttgccggttgccgtgctcgcgttgccgagcgccactgcgccggtaccggtcgccgtgtcgttcgcgcccatcgcgactgcgccggtgcccgtcgcgacgctcgggtcgccgatcgcgaccgcgccgtcgccgctcgcggtattgccggagccgatcgacacggccttgccgcctgttgccgacgcgctttgaccgatcgcgaccgagccgtccgattgtgcgttcgagccgtagccgaccgcgacactgcttgcgcccgcggcagttgcggctacgccggcggccagcgagtagatgcccgtcgctgcgctgttcgcgtagttcgccccttgcgcacctccatcgttgacgctgtagtagtgcgttttcgcggcttcgatcgcggtcgaggtcgacgtggacagcgacgtcatcgaactgttggtcgaactgagccccgtggacaaggagccgatacccgtcgacgtcgaggtggacagcgacaggatcgtgctgttcgtgctgctcaggccggtggacagcgagccgatgctggtcgaagtcgacgtggacagcgaggaaatcgagctgttcgcggatgaaaggcccgtcgaggtcgacgtggacaacgaagaaatcgagctggtggccgacgacaagccggtcgacgtcgaagtcgacagcgacgtgatcgagctgttcgcggacgacagacccgtcgaggtcgacgtggacagcgaagagatcgagctgttcgccgacgacagaccggtcgacgtcgaagtcgacagcgacgtgatcgagctgttggccgatgacagacccgtcgaggtcgaggtggacagcgaagaaatcgagctgctcgccgtcgaaagaccggtcgatgttgacgtcgacagcgacgacaccgtgctatccgttgagctcaggccggtcgacagcgagctgatgcccgtcgaagtcgaggtggacagcgaagaaatcgagctattcgcggacgacagccccgtcgaggtcgacgtggacaacgaagaaatcgagctggtggccgacgacaagccggtcgacgtcgaagtcgacagcgacgtgatcgagctgttcgcggacgacaggcccgtcgaggtcgacgtggacagcgaagatatcgagctgttcgccgacgacaggcccgtcgacgtcgaagtcgacagcgacgtgatcgagctgttggccgatgacaaacccgtcgaagtcgacgtggacagcgaagagatcgagctgttggccgacgacaaacccgtcgacgttgaagtcgacagcgacgacaccgtgctatcggtcgagctcaggcccgtcgacagcgagttgatgcccgtcgaggtcgaggtggacagcgaggagatcgagctgttcgccgacgacagaccggtcgacgtcgaggtcgacagcgacgtgaccgagctgttcgcggacgagagccccgtcgaggtcgacgtggacaacgaggagatcgagctgttggccgacgacaaacccgtcgaggtcgaagtcgacagcgacgacaccgaactatcggtcgaactcaggcccgtcgacaacgagttgatgcccgtcgaagtcgacgtggacagcgaagagatcgagctggtggccgacgacaagccagtcgacgtcgaggtcgacagcgacgacaccgagctatcggtcgagctcaggcccgtcgacagcgagctgatgcccgtcgaagtcgacgtggacagcgaagagatcgagctggtggccgacgacaagccagtcgacgtcgaggtcgacagcgacgacaccgagctatcggtcgagctcaggcccgtcgacagcgagctgatgcccgtcgaggtcgacgtggacagcgaagagatcgaactgttggccgatgacaagccggtcgacgtcgaagtcgacagcgacgacaccgagctgtcggtcgagctcaggcccgtcgacagcgagctgatgcccgtcgaggtcgacgtggacagcgaagaaatcgagctattcgccgacgacagccccgtcgacgtcgaagtcgacaacgacgacaccgagctatccgtcgagctcagaccggtcgacagcgagttgatgcccgtcgaggtcgacgtggacagtgaggagatcgagctgttggccgacgacagaccggtcgacgtcgaggtcgacagcgacgacaccgagctatcggtcgagctcagacccgtcgacagcgagttgatgcccgtcgaggtcgacgtggacaacgaagagatcgagctgttcgccgacgacaagccggtcgacgtcgaagtcgacagcgacgacaccgagctgtcggtcgagctcaggcccgtcgacagcgagctgatgcccgtcgaggtcgacgtggacaacgaagagatcgagctgttcgccgacgacaagccggtcgacgtcgaagtcgacagcgacgacaccgagctgtcggtcgaactcaggcccgtcgacagcgagctgatgcccgtcgaggtcgacgtggacagcgaagaaatcgagctattcgccgacgacagccccgtcgacgtcgaagtcgacaacgacgacaccgagctatccgtcgagctcagaccggtcgacagcgagttgatgcccgtcgaggtcgacgtggacagtgaggagatcgagctgttggccgacgacagaccggtcgacgtcgaggtcgacagcgacgacaccgagctatccgtcgaactcaggcccgtcgacaatgagttgatgcccgtcgaggtcgacgtggacagcgaagaaatcgagctgttcgccgacgacagaccggtcgacgtcgaggtcgacagcgacgacaccgagctatccgtcgaactcaggcccgtcgacaacgagttgatgcccgtcgaggtcgacgtggacagcgaagaaatcgagctgttggccgacgacaagcccgtcgacgtcgaggtcgacagcgacgtgatcgagctgttcgcggacgacagacccgtcgaagtcgaggtcgacaacgaggagattgagctattcgccgacgacagccccgtcgacgtggaagtcgacagcgacgacaccgtgctatcggtcgagctcaggcccgtcgacagcgagttgatgctggtcgaagtcgacgtggacaacgaagaaatcgagctgttcgccgacgacagaccggtcgacgtcgaggtcgacagcgacgtgatcgagctgttcgcggacgagagccccgtcgaggtcgacgtggacaacgaggagatcgagctgttggccgacgacaaacccgtcgaggtcgaagtcgacagcgacgacaccgaactatcggtcgaactcaggcccgtcgacagcgagccgatgcccgtcgaagtcgacgtggacagcgaagaaatcgagctgttggccgacgacaaacccgtcgaggtcgaggtcgacagcgacgacaccgtgctatccgtcgaactcaggcccgtcgacagcgagctgatgcccgtcgaggtcgacgtggacagcgaagaaatcgagctattcgccgacgacaaacccgtcgacgtcgaagtcgacagcgacgacaccgagctatccgtcgagctcagaccggtcgacagcgagttgatgcccgtcgaggtcgacgtggacaacgaagagatcgagctgttggccgacgacagaccggtcgacgtcgaggtcgacagcgacgacaccgagctatccgtcgagctcaggcccgtcgacagcgagttgatgcccgtcgaggtcgacgtggacaacgaagagatcgagctgttcgccgacgacaaacccgtcgacgtggaagtcgacagcgatgacaccgagctattggtcgagctcaggcccgtcgacagcgagccgatgcccgtcgaagtcgacgtggacagcgaagaaatcgagctgttggccgacgacaaacccgtcgacgtcgaggtcgacaacgacgacaccgtactatctgtcgagctcaagcccgtcgacagcgagttgatgcccgtcgaggtcgacgtggacaacgaagagatcgagctgttcgccgacgacagccccgtcgacgtggaagtcgacagcgacgacaccgagctatccgtcgagctcaggcccgtcgacaacgaattgatgcccgtcgaggtcgaggtggacagcgaagaaatcgagctgttcgccgtcgaaagaccggtcgacgtcgaggtcgacagcgacgtgatcgagctgttcgcggaggacagacccgtcgaagtcgaggtcgacaacgaggagattgagctattcgccgacgacagccccgtcgacgtggaagtcgacagcgatgacaccgagctatccgtcgaactcaggccggtcgacagcgagccgatgcccgtcgaagtcgaggtggacagcgaagaaatcgagctgttggccgacgacaagcccgtcgaggtcgacgtggacaacgaggagatcgaactgttcgccgacgacaggcccgtcgacgtcgaggtcgacagcgacgtgatcgagctgttcgcggacgacaaacccgtcgacgtcgaggtcgacagcgacgacaccgagctgttggtcgagctcaggccggtcgacagcgagctgatgcccgtcgaggtcgacgtggacaacgaggagatcgagctgttcgccgacgacaggcccgtcgacgccgaggtcgacagcgacgtgatcgagctgttcgcggacgacagccccgtcgaagtcgacgtcgacagcgaagaaatcgagctggtggccgacgacaagcccgtcgacgtcgaagtcgacagcgacgacaccgtgctattagccgaactcaggccagtggacagcgagctaatgcccgtcgaggtcgacgtggacagcgaagaaatcgaactggtggccgacgacaagcccgtcgacgccgaggtcgacagcgacgtgatcgagctgttcgcggacgacagccccgtcgaagtcgacgtcgacagcgaagaaatcgagctgctggccgacgacaagccggtcgacgtcgaagtcgacagcgtaaacagttggccgccgttgaccgcgtccccgctgccggcggcaacggtaccgttcgcaaggttgatgattttattgctggatacgttgacgttactgccattcaggatgatgcttcccggtgcatacagttcgatcgactgccccggtatggagccggtgacgctcgaacttggcgtcgtcgcgttgttgacagtgatccatgtggtcgacgtgctggcgcccgaattgattcccggccccctgaatagccgcccatgaaaagcacgtcgctgccggtggtacagcccatgttgtagctggttgtcgggcccgtcggaatgagagcagcagtcgatgcattgccacaaacgacaaatgcagcggcatacacgtccggcgacgcgaaggatcctccccaacaacaccacagcagtcaacgcccccactacggcgctcgtcccacccgcccttcgccctttcgcagtttccgatgcggccacataggtgcccgtcttctcgcaccagacattcttgtaaatcttgttcattttgttctccctgttgtactgtccggccgatcggaactcgcaccaaaaacagcggctcttgtgaaagaaacacaatccccgcagccccgcgggagttcatcgtgggcgacttttatgcctttgcacccagccccgtccttcgccgggccggccgctgcggaaaatgtcgcgcagtgtcatgtcggcatagcgccatacgagatgccgaatgctgatttcatctactgctggcaaaaatataaaaagtgcttgctatcgaaacgactacaccgacaatcagcgactcccattcctccgctgcaggcgcgtcatctccatcgcgtgaaaatcatgaaaattatttcgatatatttttaaaataattaatctttttatcgaaaaacatcaccgaacacacagcaacaggaacagtcgccgcgcgcctcaccccgacaatttatatttacccctcaccgtcgacgccaatacccatcttcattaaaagatggatcgtgacccaaacacctcagagattggcgacccttcacaccattacaatttccgacgcaacaccgggagacatgcacacgcgaccgtcgcttcatcgagaaaacccgattgctcaattttcacgatcaaaattggatatctcaaactgcttgcgatccttatcgcgaatccactcaggcgcccgccctactcctgaccacgtcgctccgctgaccgggtcgaaataacgcggccgccgtttcgtcgcacggcgcaggatatcggccgtaaatatatcctcaggagaaaagccaaactcacggacgcaatatctaatctcgagcaaaatcgcctcagcagccgctcgccgctcttcagcaattcgagcctccagattcgcccttctttccaaataccgccgatgagactccaggttgcgcatttatataattacatctcgtaaaacataaaaataagcaccgatcgagtcgacaacacaaaaacactccgccacctgaactcgcactcgcccaacaatccatatgaaacatgctatatcgacgagcaatagcgattgacaacatttgtcacacatcaaccgcgccccaatattcattctgttcataaaagttgacaaaaagaccgctcaagaatgtcactctatttcgcaaatcaatcctgccattcggccatacaacgcccagacaaaatatttcgattagctttcacttaaatctgaaaacacaagctgccccacgcacgagggtatgcacggatttaagcaacacgaaaaaatggttccaatgaaaattcttaccgttgacgacgagccagcacaggctgcgtttatctgcgatgtcctgatcgcagaaaggttcgatgtccgaagcgctacccgcggcgcagaagccatacgcctcctcgaaaccgataccttcaacctgatcgtgctcgactggaacttgccggatatttccgggctggaagtccttgcctggattcgtgcgcgagtcggcagagacctcccgtgttgttcctgacgaatcgagtgcgcgaggaacagcttgtcgttgcgcttgatgcaggcgctgatgactacatggtcaagcctgtccggcgccatgagctgatcgcaagagtccgtgcactcctgcggcgggcctatcccgtgaacgcgacgccgacatcgatcaacatcggtcgttaccgtctggatctcgtgaccgaaaccgtgttcctgagtgacgagccgattaaactgacatcgagagagttcaacgtcgccgtggcgctgtttcaaaattgtggtcgcgcaatgcctcgcgaagcgttgatcaagtcgatatggggacgccatagcgaccacatctccaggacgctcgatacacacatctatcgcgtgcgttccaagctgcgaatcacgcccgaaaacggtgttcgacttcgcgctgtttacaatcacgggtaccggttggagttgctcgattccagtcacacggacgatgcggagtaacggcttcctagagcgctcacgacattcggctctgtgtgcccgccagcgtcgttacagcagcaacatatgcggtttgagttcaagacaggcgcaaagaccgatgctgaagacgccatacgtgatcgatgaatccagctgcgaaccacacgcaaccgggatcgacgacaatctgcagcgatcccggcgctgtcgcggctcgttcggctgcccggtgggcaccgagcgattgcagtcagacaatcgcgtcgtcgcactgaccgtcgctcaagccgacggctggttgcacgatacggcggtcgatatcgatcgtcgacgcacccttgaccatgacttcccgctctgccggtgccgtcaacttccaggcgaacgccgtgacgctcagaactcgataaagggaatgttgcattttcatcctcacatcggaagccacgaatcgcatcgatcgcccccgagtatcaccgcatgaagtctcactctgtgctgcacaaggccggaacttcgcttccggcatcggtacgtacgcaaccggcaccagagacggcgcgagccgccgttaccgagcctgctcacgcggcggcgtgacgatcgacttcgccgagccttgaatcagtcgagacgcaagcggcacaggctcaccatgtttggggcgatcggcaagccaggccacacagacagccagtgcgatcgcgcttccccaaatgtcaacagaacacgcatcttcacttcaccttcgcgggctttgccacctgcgcgatttttcctgcggtgtcggcgccgtttccaggacgatcaccagtgccacgacaagtccgcagatcagcagaccgcacatgccgaacatcgctctattcatttcagcgccaccactgcatcgttaggccgaatgcgccgatcgacccacaccgggaaatctgcgcacctacgcttgaccgcgcctggaagcgtcgactcgattcaaacgcccgatggtcggccgcacgatgcgtgattggggcggtcgcgtcgaccgtggtagcgtcgatcgcaatgaagatgccttggtcacgaggtggcgtaccggtcacgagcgccccgagtctcgatggctgaccggacttttcgacggtccctgaacgcatccccggtggaggcactcgttgccccggaagaggggcgtcatagactcccatgggtgaggccggatttaatgccacaccatatttttattagtaatacaaataatcatactcgcgaattttactccgccaaagacatcgaaacttcagttgactggatcggaatatcgaatattcatgtgctgcatcgaacggtcacaaccggccagcggacactcgacacggtcgtcagaagcgcccggaaaccgtagttcggcacgatccgggagcagttccgattgacccgtttgccaactactcacgccaatacacctcacgcaacatttgacttcatctcgtcgacaaagccgaggccgtgagctccaattcagacaagacgcgttcgattacgtcagtccagtttccacgcgcggtctgggtaaagagtcgcatgccgggataccacggactgtcgtcgcgattgcgcaaccagcgccagcagcccgcgtaccggttcagtaaccacacgcgcttccccatggctgcggccaggtgagcgaccgcggtatcaacggaaatgacaagatccagcgcgtcgatgagggccgctgtatcggcaaagtccctcacctcgtgcatccagtcgactacgtgtggatacttctcgtgagaaagctctttcgaaatgtcatccgccttctgcaagctgatccagtgcgcgtgaggccacgcaagcaatggcgccatcgtatccagatcgatactacgccggcgatcatcgggcgtgcccgaatgccctcccgcccagaccaccccgatgcgtggcaaggtgcgtggctgcaacttcgccaccttcgatgaccattttcgcgaccgtcgccgattcgcgtacaaataaggcagatcggcgggaatgttgtctacttgcgttccgaaggccatcggcagcgacagcagcgggcaataccagtcccactgaagcgggtcgaatgacttgtcgtcgagcagcgtcagatttggccaccgagagcagagcgaatcagtcagcagccggcgcagtggtttcgggcataaaggccaactgcagtgaattgccgaagcgccatttcgagatatcgacaaaagtgcaacgtatcgcccaatccctgctcggccagaacgagcaggcggttttcgccaggcggcagcccttgcccctgccaccgacggatcggcaaagccgggtacttcgcccgggatacgaatcgcccgccagcatggttacccaccggtgttcgaagtatggccaggcctccctatattcaccggcgcgaagcaatgcatatccaagattgccgcaggctacgagattttgggatccaactcgattgctcgacgatacgcactgatcgcgaggtcggtctcgcccaacaggctgagacacacgcccatatagctataggcatccgaacgtgccggatttcgttcaatcgtgcgtcgacaaatatcgatgccgtcttccggtttttcgtccagcaccaaagccagacacaggttgtacaacaacttcgaagtgtccagatccggctggtgatcttcggcaaacgccagaccgcttcgcgcgcttgctgccgcctgcgaaaatgccctcaatcgtgtttgcaccacgctcaggctgttgtagaagatggcattgggagacgcgtcaatagccctcttgaaccagtcctctgcctcctcagccctatcctcggccttacccaacgaaaaagcgatcagcccctcagatgcaggacatcaccacttgaggggcattccttcagaacgtcctcgaccaaccgaagagcgagttcaggctggccagcgttataagcgtcgatggccttgtcgtagcacaactggatatcttcaagattcgattccacagcaactccgatcagcagtccacagcagtgaacgttccgcagcgcagttcggacccggaatatggacgctggatatccattaccgcctcaatgccgatttgccggtgttgcatgggcacgcgtcgaagaccggcgatttccggggcccttccaacgtcgacgtgtcagtttgaaaattcaaccagaccgcgagccgtcgttgaacaaacgttatccagagatcggtcgtgaccggatgccgtccgaaagcatcctgcccagcaaaaacctcgatcagaaaaaggccaagcgtgagcttggcgtcaaatccgagggaagtgctccggtaacagagcattgacgatggtacgcgtccgcacacggcgagatttgaacgattgtcacatccagaaggaggtaagcatttgcggccttcggcgatcaccgtcatcggcctgcgagaaccggtcattcaaaatcatgcgaaccatcgactcaacgacggaagcgtgcctcgtccggaagccttgcttcgacaacacgggccgtccgaatctgaacgagcctcgacatcaaccgccggaacccagccggatgcctcccgtgccccgccccgcggatccatcgcttcgcatcgaagcattcattttcattacgccgatagttacggtttacctccgcactaaacacgccaaacgccctctccgtaagcccctggattacattcggtaatttaatgcgaatcattctcgtttacattgactttcccatttgacactcctacgatgcgccgcgttgcgcttcgcttcgtgccctggccaatcggagccgagcgtccggacagcgatcgacaagcaggactccacactaattagaaccagggatttgatatgaagtttgcgtcgttccagggagacagcgtccgtgcccggatgcgccccgccgcctgcgcggccatccttgcatgcgcgtcgttcgcgagcggcgccgctttcgccgacgtgcccgtcgacgcacaacccgaagcacccgaggccgacctctcgatccaggcgaagccgaccaacatgtggaccggcatctggacgcgccagagcctgctcggcgacatgggcggcatccgcccgtggctcggcaagtacggcgcgacgctgcagatcaccgaaaccagcgaatacctcgcgaacctgcgcggcggcctgaaccgcggcggcgcgtacgacggattaacgacggccacgttgacggtcgacacgcagaaggcgatcggcctggccggcggcacgttcaacgtcagcgcgctgcagatccacggcaccaacctgagcgcgcggaacctcggcacgctcaacaccgcgagcggcatcgaggcgcagggcacgacgcgcctgtgggagctgtggtaccagcagtcgttcctcgacaagcgcgtcgacgtgaagatcggccagcagagcctggaccaggaattcatggtcagcacgtatgcgaacacgttcgtcaacacgatgttcggctggcccgcactgccgtcgtacgacctacccaacggcggccccgcgtatccgctcgcgggcctcggcgtgcgcgtgcgcgcgcagatcacgccgaagctcaccgcgctcgcgggcgtgttcgacggcgacccgctcggcaacaacccgaacaacctcagcggcaccagcttcaacctgcacaacggcacgctctatatcggcgagctgcagtacgcgctgaaccagccgtccgacggcgaaatggacaccggccgctcgaacgggctgccgggcacctacaagatcggcgtctggtatcacaacggccgcttcgcggaccagaacgtgggcaccgacgggctgtcgctcgccgatcccgcgtcgaacggcaacgcgcagctgcgccacggcgactacagcttctacgcggtggccgaccagatgatctggcgccccgacccgaccggcccgcgcagcctcggcgtgttcgcgcgcgtgatgggcgcgccgggcgaccgcaacctggtgagcttctcggccaatgcggggatcgtgctgaaggcgccgttcgaaggccgcgacaacgacagcgtcgggctcggcgtcacgtacatccaggtcggcaaccacgtgaccgacctcgaccaggccgcgcggacgttcgcgaccggcccgtacggcgtgcgcacccgcgagacgacgctcgaagcgacctaccagtaccaggtgaacccgtggtggatcgtccaggccgacgcgcagtacacgttcaacgcgggcgccggccagaacccgagcgacgcgacgcagccgctgcgcaacacgttcgtgctcggcgcgcgtacgacgatcacgttctgagcgacgcgcccacgctacccgtttttcgcgcgccgcccggacggcgcgccctccaggagagtcacatgattcaatccgccccgcttcgccgcctcgcgacgggcgcactggccgccgccgcactgacggccgccgccggcgcactcgccgagccgcaaggtttcctcgagacgctgcatcgccacaccacgctcgtcaacacggtgcccgacaacggcgaccagaacccgtacgcgatcgcggtcgcgccggtgtcggccggcacgatccaggcgggcgacgtgctcgtcgacaacttcaacaacgcggcgaacctgcaaggtaccggcagcacgatcgtctactaccgcccgtcgacgaagcagttgagcctgttcgcatcgatcccgcgcgacctgaaggcgtgcccgggcggcatcggcctgtcgacggcgatgacgatgctcaaatccggctgggtgatcgtcggcagcacgccgagcaacgacggcacgacgaacaccaaggggccggctgcctgatcgtgctcgatccgcagggcaagatcgcatcgacgtggtcgaccccgaacatcaacgacccgtggggcaacatggccgtggtcgaccgcggcgacagcgcgacgctgttcgtcagcatggccggcttcggcgtcggccgcgcggacggcaacccgcccgtctacaagcaggcgaccgtgctgcgcctcgatctcgacgtaccggcgggcaagccgcccgtcatcaagcaggaaacggtcgtcgcgagcggcctcggcgcgcaggccgacaagggcgtgttcctggtcggcccgaccggcctcgcgttgtccggcgaccagaagaagctgtacgtgtcggacgcgatcggcaaccggatcgtcgagatcgacgacccgctcacgcgcgacaccagcgcgggcgtcggtcgccaggtcaccgccgacggtttcctgcgccgcccgctcgcgctcgcgaccgcaccgaacggccacctgctcgcgaccaacgcgcagaacggccaggtcgtcgagatcgacccggtcgtcggcaagcagctctacgcgcgctggatcaacaccgacaaggcgcagtcgcccccggcaacggcaacctgttcggcatcgcgatgacgcccgagggcgacggcttctactacgtcgcggacgacgtcaacacgctgttgctcgcgaagtaacggaacgaaccatggcagacgatcacaaccagccgccccgccccgcacggcgcggcttcctgaaggcgggcggcgcggcggtggccgccggcctcgcggcggcgtcgatgccggccgcgaaggcggcggatgcccccgccgccgcaccggcccccgcgcacgacggcgtcgagccgttctacggccagcaccagagcggcatcgcgacgccgcagcagcgccacgcgtatttcgcggcgctcgacctgacgacggcgcagcgcgcggacgtcatcgcgctgctgaagacctggaccgacgccgccgcgcggatgacgcgcggcgacaccgcgcaaccgctcgccgcgacgggcggcgacgaagtcgcgccggccgacgggggcgacgcgctcggcctcggccccgcgcgcctgaccatcacgttcggcttcgggcccggcctgttcgcgctcgcgggcaaggaccgctacggcctcgcgaagcaacgccccgccgcgctcgtcgacctgccgcgtttcaacggcgaccagttgctgcccgagaaaaccggcggcgacctgttcatccaggcatgcgcggacgacgcgcaggtcgcgttccacgccgtgcgccagctcgtgcggctcggcgcgaaagcgacgcagatgcgctggggccaggccggcttcacgtcgggcaagcccggcgagacgccgcgcaacctgatgggcttcaaggacggcacgatgaatccgccgatgtccgatccggccgcgatgaacgaattcgtgtgggccggcagcgaaggcccggcatggatgaacggcggcacctatacggtcgtgcgccggatccgcatcacgctcgaacactgggacaacacggagctcggcttccaggaacaggtggtcggccgccacaagtacagcggcgcgccgctcggccagaagcacgagttcgaggcgctcgacctcgacgcggccgacaaggacggcaacccggtgatccccgacaactcgcacgcgcgcctcgcatcgccgcaggtcaacaacggcgcgcagatcctgcgccgcgcgtactcgtacaacgacagcacgagcttctacatcgaacgctggccgccatggcgccagcagaccgagtacgacgcggggctgatgttcgtcgcgcaccagcgcgacccgcgcaagggcttcattccgatcaacgagaagctctcgaagctggacatcatgaaccagttcaccacgcacgtcggcagcgcgatcttcgcgtgcccgccgggcgcgcaacccggttcgtacatcggcgccgcgctgttcgacgcatgacgtcgcgccacgcaagccaacgcacacctttccggcccggccggatgcaacctgctgaaaacgacatgaccacttcacccgttagccgcccgctgcggcacctgatttccgcggcggccgccgcgctgatgctgaccggcgcactgcacgccaccggcacgcatgccgcgacgctcacgctgtacaacgcgcaacacgagcaggtcgtgaaccagctcgtcaaggacttcgaagcgcagagcggcatcaccgtgaaggtgcgctcgggcgagggccccgcgctcgccgcgcagatcgtcgcggagggcgaccgcacgccggccgacgtgtacttcaccgaaaactcgccggagctcgtgctgctcgaccgcaagggcctgttcgcgaagaccgacggcgccacgctgcagtcggtgcccgcgcgcttcaacccggccgacggcaactgggtcggcgtactcgcgcgcgagaacgtgctcgtctacaacaccgcgaaaatccagccgcagcagctgcccgcgtcgctgctcgatctcgcgaagcccgaatggaagggcaaggtcggcgtcgcgccgagcgacgcggacttcctgccgctcgtgagcgcggtgctcgcgctgcacggcgaggccgcgacgctgcaatggctgaagggcctgaagaccaacgcgcagatcttcgacgacgacgaaggcgtgacggcggccgtcaaccgcggcggcgtgctgaccggcatcgtcaacaactactactgggatcgcctgcacgccgaactcggcgacaagtcgacgcgcagcgcgatccaccacttcggtcacggcgacgtcggcggtgccgtcaacgtgtccggcgccgcggtgctgaaagcgtcgaagcaccagccggaagcgcagaagttcgtcgcgtatctcgtcagcgagcgtgcgcagaagctgatggcgggcggccatgtcagcttcgagtatccgctgcatccgggcgtcgcccccgatccgatcctgaaaccgttcaacgaactgagcccgccggcgctgacgttcgaacagctcggcgacgacagccaggccggcaagctgctgcgccaggccggcctcctctgagcatgagcgacgccgtgtccggcacggcgcgcaccgcgcgcgacggcgaacgcaccgcgacccggcggcgcccgtcgcgcgcgctcgtcgccgcggccgcatgcgggccgctcgcgatcctgttgccgctcggcttcacgctgtaccgcgcggccaccttcggcgtcgacgatgcgatcgagctgctgtggcgcccgctcgtcggcgagttgctcgtcaacacgctgtcgatcacgctcgccgcgaccctcgcgtgcacgctgctcggcacggcgctcgcgtggttcatcgagcgcaccgacctgccggcccggccgctgtggaccgcgctggcggccgcgccgctcgcggtgccgccgttcatcacgagctatgcgtgggtgtcgctgagcctcgacctgcaggatttcctcggcgcgctgatcgtgctgacctccgcgtacttcccgctcgtctacctgccggtggccgccgcgctgcgcgaactcgaccccgcgctggaggaaagcgcgcgcacgctcggctgctcgccttggcataccttcttccgcgtcgtgctgccgcagttgcgccccgcgctgtgcggcgggatgctgctcgtcgcgctcggcgtgctgtccgagttcggcgcattccagttgctgcgctttcgcacgttcacgaccgagatctatgcggaataccgcaccgcgttcgacggcggcggcgcatcgctgctcggctgcgtgctgatcgcgctgtgcctgctgtgcctcgcgatcgaggcgcgcgcacgcggccatgcgcgctacggtcatacgcaccgcgccgcacgccgcgtcgcgatgcgttatccgctcggcaacctgcgcggccccgtcaccgtcgcgttcgccgcgctcgccgccgcgacgctcggcgtgccgctcgcgatgatcggctactggctcacgcaacagggcgcggccgccgtcacgccggccgacgtgtcgcccgagctgctgtggcaggccacgctcgcgtcgtccggctacggcctgacggcggcggccgtcacgacgctgctcgcgctgccgctcgcgttcctgctggtccgttatccgggccgcgtcgccaccctcctcgagcgcacggcgatgaccgtgcagggcgtgccgggcatcgtcgtcgcgctggcgatcgtgtcgatcacggtgcggctgctgcagccgctctaccagagcgcaccggcgctcgtcgccgcgtacgcgatcctgttcctgccgctcgcggtcgtcagcgtgcgcgccgcgctgtcgcacgtgcaggtccggctcgaggaaaccgcgcgctcgctcggcctcggctggcgcgcgacgctcacgcgcgtcgtgctgccgctcgcggcaccgggcctcggcgcggccgcgacgatggtgttcatctcggtcgtgacggagctcaacgcgacgctgctgctgtcacccatcggcacccgcacgctcgcgacgcaggtgtggagcgatacggcgacgctcgcgttcgccgccgcggcgccctatgcggcgctgctcgtcgcgctgtcgctcggcgcatcgggactgctgttcctgctgctcggccgcgcgtcggtgcgcaactgagcgccgccctttttccccggaaccgcccatgagcgaactacgcatccacggcctgtccaaatcgttcggatcgcataccgtcctgcacgacatcgacctcacggtgcggcgcggctcgcgcctcgcgctgctcggcccgtccggcagcggcaagaccaccctgctgcgcgtgctgtgcggcttcgagcgcgccgagcgcggcaccgtcgaaatcgacgggcgccgcgtggccgcacccgacctgcacctgccgcccgaggtgcgccggatcggttacgtgccgcaggaaggcgcgctgtttccgcatctgtcggtggccgacaacatcgcgttcgggctgccgcgcggcgcggcggcgccatcatcgcgtcgacgaactgctcgagatggtcgggctgcccgcatcgtatgcgagccgcgcgccgcagcaactgtcgggcggccagcagcagcgcgtcgcgctcgcccgcgcgctcgcgccggagccttcgctcgtgatcctcgacgaaccgttctccgcgctcgacacgtcgctgcgccatgaaacgcgcagcgcggtcgcggatgcgctcgccgcggcggacgcgacatcggtgctcgtcacgcacgaccagcccgaggcgatgacgctcggcgacgaagtggcggtgatgtggcacggccgcctcgtacaaacggccgcgccccagacgctgtaccggcagccggtcacgcgcgacgtcgcgtcgttcgtcgggcaggccgtgctgctcgccggccgcgtgcgcagcatgcgcatcgtctgcgcgctcggcgaactgccgctcgtcgcgccgctgcccgacgggccggccgacgcgatgctgcgccccgagcagatcggcatcgtgccggtcacgcaggccgatgccgcgcgcggccatacggcgcgcgtcgaagccgcgcggttcgcgggccaggatgccgacgtggtcgtgcgcctcgatgccgatcccgacgtgctcgtgcgcgcacgcgtgccgggacaccggtgtccggccgtgggcgaacgtgtcgctctggtggtggatggcgcggtgatggcgtacgcgcgctgagcggttggcgcggcgcggcgcggcgcggcgtttagcgtttagcgtttggcgtttggcgtttggcgtttggcgtttggcgtttggcgtttggcgtttggcgtttggcgtttggcgttcggcgttcggcgttcggcgttcggcgttcggcgttcggcgttcggcgttcggcgttcggcgttcggcgttcggcgcttttacacgttcacgcgcattcaggcatcggcgcaacccgcatcccgcaacggccggaaagtccggccgtccgtctcgacggccgcgcccagcagccgcgcgagccctttcgcgccttcgcgcatcacgacgtcgtgattccatcggaacagcggccggcccagcggctccagccggttcatccagcgcacgtgcgtgcggatgtgccagtcgtagcgcacgatcgtgcgtgcgccgtcggcggcgaacgaccagcatccgtcgccctcgatcgcgccgctcgcgcggccttcgagcgcatgacgcggctcgacgcgtcgcacgcgcatgtcgaaggtcagccggtacggcagcgcgcccttccacgtgtaccggtgcagcgcgccgacgccgcgcacgtcgcccggctcgatctcgacggtgcgtacagcgcccttccaccagtcgggccagcggtcgacctggtagatcgcatcccacaccgccgcgagcggcgcgtccacgcgccaggtcgtcgagaaccggtattccgccatgcagcctccggcatgcccgtcaggggcatgagtcagcgcaccgctcagggcgcgaagaagcgttcgggaaacgcgacgtcgatctcgacgtcgtcgagcgtcacggtttcgagcggcacgtcgccatcgtccgcgaagctgacgaccttcagcggaaagccgtcctccgtatccagccacagccggtagcgatgcacgccgtcgaccgcatgcgcggttgcgcccgtaaccgacacgcgcagcgcggtccggccgccgacggcctcctcgccttcgatcaccgtcgagccgccctcctgcagcgcatgaacgttgcgcaacagttcgccgacgtcggaccggtcgacccggtggccgctgcggtcgcgcacgagcgggttggacggcgacagcgtcagcgcgggcggcgcatgcgcgccgaacgggcgcagccgcaccttgccgtcgccgggatcgtacgcgagcaccgcgccgtgatgcggcgatacgaaatccatccggacgaagcccggtttcaggtacgcgtagcggaattccgtatgttcgccgctgcgcgcggacgagcggatcgtcgcgcggtacgagcggacgtggtcgaaatgcgcctgcgcgacggtcacgggatcggcggtcatgctcgctcctatcaggctcgcggccagcaacgcggcgatcacggcgccgcctcgacatcgaggacgccttccatcccgcgctcgcgatggctgctgaaaaacagcagccgatgcgtgcaatagtaggcgaaccggcccggctgcgccggcgtgaagcgaaacgtcttcggcgtcgtgccaagtgccgtgtgcaccgcgatgccggcctgcggcgcatcgatttcgaagctgtgcggcaccaggccgggctcggccgacacggtcagctcgaccggcacgtgcgcccgcacgatcacgtggttcggtcggaagaaatagctgccgccgacgatcgcgacccgctgcacgccgtcggcgtcgacgggcacgcgcacgggtacgtcaccctccgcccgggcaagcgcggtgcccgcggcgagtgccgccagcaacgggatcagcacgagccccttcgtcatcgtcatcttcatctcgtgctccgtaccggcgccgcgcgcatcaccccttccacgcgtcggtctggccgccgagcgcaccgcacgcttcgatcgcgagttcgcgcaggcgccgttcatcgccctggccggacaacgcgtagcccatcccgcgatccgaccagaaatacgtgtagcggtcgccggccgacatcgcccgcggcgcgacgcgccgtgcgtcgtaggccgtcatgtacagcgtcacgcgctcgccgtccgcgcgctggtacatgagttgcgcggccggccccgcgtcgcccgggagcagccgtccgccgagcagcacgtagccgtattcgtcgagcgacggcgcgcgcacgggccgcccgagacgcgcggacagccacccggcgaggcgttccgggtcgcctgctccgacttcgaccggatgttcgcgatcggccacgtacgtcgcgtacgcgacatccgcgcgcgcggcgaacgccggttcgctgtcgagcgcgacccagcccgcatgcagcgcgatgccgatcagcagcccggccgcgagccccgcgagcgcatgggcgatcccgcgccgacgcggcgcgcggcgctgcacgaacagcgcgggcgccgcacccggcagcggaaacagcgcctgcagtgcgtcgcgctgcgcccggtaatgcgcgaatcgttcggcttcctccggatcggcctgcacccgctcgagcatctcgtttcgctcgcgcccggacagctcgccgtccagcaacgcggacagcagttgcgccgacgcatcgtcgtcccgctcgtcgttcgaaggtttgcgcggttcgtccatcatgtcttcccgatcacccgtaacgcgggcgtgccgtgcgccgacggctcgtccgacagcatcgcgcgcatctgcccgcgcgcccgtgcgaggcgcgacatcaccgttcccaccgggacaccgagcacctgtgcggcgtcgcgataactcaactcctcgagcgcgaccagcagcaacacctcgcgctgctcgaccggcagccggtacagcgcgcgctgcacgtcgcgcagcaccagcccgccgatctcgccggccggcgcggccatcgtttgccacggcgccgtcgcatcgtcgaccgcgatctcgtgccgcgcgcgcaactggtcgatgaagcggtgccgcagcagcgtcagcagccacgcgcgcaggttgccgccatcgcgcggcgggcggttcagcgcacgctcgagcgtgtcctgcacgagatcgtccgcccaggcgcggtcgcccgtcagcgcgcgcgcatagcgcgtgagatgcggcagccacaccagcagatccgattcatagctcatcaggatgcctcgcgcaccgccacgcggtcacgggcgcgcaacgtgccacatgccgccgatcccgtcgccgcccgcgtcgccgggcttgcgatcctgcttccagcgatacagcgggcgcccgcgatacgcccattgcttgcggccgtcgtcgcgcgcgacgagactcagcgcacccacggccttgtcgtacgcgtccgcgagcgcgggcggccagttggccgcgcacgcgctgtcgcacgcgctcttgccgggcgcgtcgcgatcgaacacgtagagcgtcatgcgatcttcgtcgaccagcttgccgtcgccggcacggggcggttccgcggcggccggccgcacgatagccgccgtcagcgcggcggcaacgagtatccgtttcatgtcctttctccttggcacggcatcgcgacacggcagcaccggcagggacgatcggcttcgtcgcgaccattatcccgccggccggtgctgccgggattcggtatgtaaacggacgaaggaggccgattattccgcgtcggccgacgaacgccggccgcggccgttcacgcgacgaaagaaagcgcgcccaaaaggacaacgcggcatgacattcctgtcatgccgcgttgcgcgacccgttgcgcacggcggccgatctcgcgccgccgtgcgtgtccggccgtttacctcggcagtgcgcccgtcagcgactggagcagcgacgacaccggtgcgagcgggttgcccggcgcgctgttgcccgaatgcggcgtgaccgacaggcccggcgcggagccgagcgccgtgcccaccgtcgtgccgaccgcgttgacgaccgttgccgtcgcgttgccgcccgtcgtcagcagcgagccaaccgcccccgccgtgccgccggccgcgttcgcgcccgagccaagcaggctgccgcccgccgctgccgtcgaaccggccgcgcccgacagcgcgccggccgcctgcccgagggccaccggaccgttcgcgagtgcgcccgtcaccgaaccgagcacaccggtcagtgcgccggccgggttgctgccgcccgtcaggccgctcacgaggttcgtgatcggtgcgatcgggttgttgcccgccgcgccggacaacgtgccgaccacctggttcacgacgccttgcaccggcgccagcgggttcgacccgctgaggttgccgagcgtgccgaccacctggttcacgacgccctgcaccggcgccagcgggttcgtgccgccgaggttgccgagtgcgcccacgacggagccgaccgcgttacccagtgcgttcgtggccgtgccgaccgcattgctgttgcccagcgtgccgacgacctggttcacgacaccctgcacgggtgccagcggattcgagccaccgaggctgccgagtgcgcccgtcaccgagccgagtgcgccggtcagcgcaccagccgcgttgccgcccgtcggcagcgcgttctgcaggccgttgacgaggttcgtgatcggcgcgatcgggctgccgccaccggcgccggacagcgtgccgacgacctgattcacgacgccttgcaccggcgccagcggattcgagtcgccgagcgtgcccgcaagctgcgtgacgacaccctgcaccggcgccagcgggctgcccgcgccgccgacgttgccgagcgtacccgtgatcgtgttgaccgcgttgctgagcgtgccggccgggttgccgctgccgagcgtaccggtgacctggtcgacgacgttctggatcggggccagcgggttcgagccgccgccgatgccgcccaacgcgcccgtcaccgtgccgagtgcgccggtcagcgcgcctgccgggttgccgccgccgagcgcgcccgtgacctggttcacgacaccttgcaccggagccagcgggttcgagccgccaccgatgccgcccagtgcgcccgtgaccgtaccgagtgcaccggtcaacgcaccagccgggttgccgccgccgagcgcacccgtgacctgattcacgacaccttgcaccggggccagcgggttcgaaccgccgccgatgccgcccaatgcgcccgtgaccgtaccgagtgcgccggtcagtgcaccagccgggttgccgccgccgagcgcgcccgttgcggtaccgagtgcgttgcttagcgtcccggtcgccgtgttcagtgcgccggtcagcgcacccgcgggattgccgccgccgatagcgcccaatgcgccgagcgcccccgtcacgttgccgattgcaccggttaccgtgccggccggattgccagcaccgagctcacccgccacggtaccgagcgcacccgtcaatgcgctggccgggttgccgttattgagcgcagtcgtgacttgattgacgacgccttgaaccgcccccagcgggtacgagccgccgccgataccgcccagtgcgcccgtgaccgtgccgagtgcgccggtcagcgcaccagccgggttgccaccgccgagtgcacccgttacttgattgacgacgccttgaaccggcgccagcggattcgacccgccaccgacattccccagcgcaccggtcaccgtaccgagtgccccgtcaacgcaccagccgggttgccaccgccgagtgcgcccgttacttgattgacgacgccttgaaccggcgccagcggattcgacccgccgccgacgttgcccagcgcgcccgtcaccgtgccgagtgcccccgtcaacgcaccagcgggattgccaccgccgagcgcgcccgttacttgattgacgacaccttgaaccggcgccagcggattcgacccgccgccgacgttgccgagcgcaccggtcaccgtaccgagtgcccccgtcaacgcaccagcgggattgccaccgccgagcgcgcccgttacttgattgacgacaccttgaaccggcgccaacggattcgcgccaccaccgacattccccagcgcaccggtcaccgtaccgagtgcccccgtcaacgcaccagcgggattgccaccgccgagcgcgcccgttacttgattgacgacaccttgaaccggcgccagcggattcgcgccaccgccgacgttgcccagtgcccccgtcgccgtgccaaccgcattgcccaacgcccccgtcgccgtattcagcgcaccggtcaacgcgccggccgggttgccgccgctcagcgcacccgtcacctggttcaccacaccctgaaccggcgcgagcggctgcaccgtgccgccgccaccgctgagtgcacccgtcaccgcccccacggcgcccgacagtgcctggccggggtcgccaagggacgtctggatcgcgcccgccccgcccgccgccacggtgaccgaacccagcggcgacgtccccgtcgcgaccagcccgaccgagacgctgttcgtcggcgggttgacgatcacttgcgggatcggcagcccatcaagggccccgctaccgcggaacccgaagccagcaccccgaacaccgtcgcgaccgacagcgctgcacccgtcaatttcagattttgtcccatctttgtttttccccatctcggttggcacaacgttgataaagcatggggacggattgcacgaagtgtgccaattcgaaaaaccggattgattcgtctgtccattagcgatcaataacgctttttaatcgatttcagacgaaaagcatgaccccggcatcgcaatcatctgatgaaaaagggcatcggagcacggatgtaacgtaacgtttgcgagccccgtggtaacgtgttccggtacattccgcgtaacaccggaacgcgccgccaggcgcggtgcatcagaccgtcacgagcgactgccgattacgcatttcagcaaaatgaaaatgcattgataaatcgccgatttgctgattttctttatttggcgatcatctttcttgccgattacgcagatcatttccgattgcgcgatttccggtaatccggatagcagaatgaaacattgtaaaggccgcgtcgcaaccggcgcgcgcgcgaggctgcgcgcgccgccggatcagccgaagcgtgcgggccggtacggatggggatcgatataggtcggcgcgcccgtcatcatttcggcgagcaggcgcccggtcgcggggccgagcgtgagcccgtggtgacaatggccgaacgcgaaccacaggtggcgatggcgcggcgcgggcccgatcaccgggcgcatgtcgggcgtgcacggccgcatcccgagccacggctcgggatcaagccgctcgccgatgccgaacgcgtcgcgcgccagcggctccgcacgcgcgagctgcacgccggtcggcggtgcgccgcgcagcgcgatctcgacgccggtcgtgagccgcaggcggccgccttccatcggcgcgacgacgaaaccttcctcggtatcgcacaccggcacgttcaacggcgcgcgcgtcggccggtagtgcatgtggtaaccgcgcttcgcgcgcagcggaatccggtagccgagcggcgcgaacacgtgatcggaccacggcccgagcgcgaccaccgccgagcgcgccgagatcggcccgtgttcggtaccgacctgccagccgtcctccacctgcacgagcgtcttggcatcgccgagcacgaacttgccgccgtcgcgctcgaacaaccgggcgtaggccttggtcagcccgcccgggctcgacacggtcttcgggtcctgccagtggaatgcgccgcagaacgcgtcgctgacgccgggctccgtcgcgcgcaacgcacgtgcgtcgagcaccgtcatccgcagcccgtgcgcgtcggccacgcgctgctgcacgcgcgtttccgcatcgaacagcgcgggcgaacggaacgcttcgatccacccgccgtcgtgcacgagcggctgcgcatcggtacgcgcgagcagcgcgtcgtgctcgacgacgctcgccgcgacgagcggcagcaggtcgcgcgcggcggccgcgagccgctgcggcgacgattcgcgccagaagcgcgcgagccagcccgcatacgcgggcagcgcgcggtagtcccagtagagatcgaccgagcggttgcgcgcatagcgcagcaaagtgccgagccggcgcggaaacgcgtacggcacgaccgacgagcgttcgatcagccccgcattcccgtggctcgtttcctcgccgggcgcacgccggtcgacgagcgcgacgcgcaacccgcgatcctgcagatgcagcgccgacgacacgccgacgatgccggcccccagaacgatgacgtcgaaatccatggttccccgtactgcgtcgagattcgatgcggcacgcaccggcccggcggccggtgcgcggcggtcattacttcgcgacgatgtcgcgcttgaagtacttctgcgacagcgcgccgagcgtgccgtccttcttcagcgcgtcgagcgcgccgacgatcttcgcctgcagcgccttgtcgttcttgcgcatcccgaagcccgtgccttcgcccagcgttgccggatccttcagcggctcgccgacgatctggtagtcgcggccggccggcttgtcgaggaaaccctcctgcgcggtctgcgcttcctgcacggccgcgtcgagacgacccgcgacgagatcggcgtagatctggtcctgatcctggtacgacacgacggccacgcccgcgttggcccagtgcgccttcaggaaatcctcctgcgacgagccctgcagcacgccgacgtgcttgccgcgcaggctcgcgacgtcgggccgcagcggcgagccgtgcttcgcgaccatcacgatcggcaccacgtagatcgccggcgtgaagtcgatgctctgcttgcgcttcgcggtgatgttcatcgccgaattgatcgcatcgaacttgcgcgcctgcagcgccggaatcaggccgtcgaacgaattctcgacccacacgcatttcatgttcagcttcgcgcacaccgcgttgccgatgtcgacgtcgaaaccctgcagctgaccggccggcgtcttgctctcgaacggcggataggcggcttcgatcccgaagcgcaacgtggtctgttcggcgtgggccgtgacggccgcacaggcgagcgccgcagcggcgcagagggagagcttccagttcatgacggtccttccgttctggattgaggcgatgaagatcggtacacgacggccgcggccggacgccggatcggcattcgaagcaggcggtcgccacacggcgacgggtcgtgtcctgcacgcgaaatatagactcaaagtctacgatagactataggggatacgagaatcgtgccccgatacgcggcatctgaaattcgcccgacatcgaaaacacccttgatttatcgatgtttttcccaaatctcgcgatgaaacacagtcccgaaaagaaaaattctcccgatttcgtttgtctatattagacttttcgtccatcacgaacactgccggacacgtcgatcgagacagtccagtccggccccgaccggagatgacctcatgacgcaaaccgccccgaccctgccgctgaccgtcgacgaagccgcggtgcgcgcggccctgccgtcgctcgacgtgctcggtacgctgcgcagcatgttcgcgtcgctcgacgcggcgcgcgcggtgcagccgccgcaaacgctcacgctgtttcccgagcaggccggcgacttcatcacgtatctgggcgcgcttgccgacgcgcaggtgttcggcgcgaagctgtcgccgtatgtcgtgacgggcggcaagcccatcgtcaccgcgtggaccgcgctgatgtcgatgcgcacgggccagccgctgatgtggtgcgacgcgggcctgctgacggtcgagcgcacggccggcacgaccgcgctcgcggtcgattgtctcgcgccgggcaacgcgcgccatctcgcgatcgtcggcgcgggcgcggtcggcctcgcgcacctgcggcacaccgcgggactgcgcgactgggagacgatccgcgtgtactcgcccgcgctcgccggcgatgcggcgcagcaggcggcgcttgcgcagctcgacccgcgcgcacgcgccgccgcgagcgtcgaagcctgcgtgcgcgacgcggacgtcgtgatgctgtgcacgtcgtcgggcacgcccgtgctcggcgacgggatgctcgcgcgccccgcgctcgtcacgtcgatcagcacgaacgtcgcgcgcgcgcacgagatcccgcccgcctggctgcccggcatggacgtgtactgcgactaccggcacacgacgccagcgagcgccggcgaaatgcagatcgcgacggccgagcacggctgggaagccgcacggatcgccggcgacctgcccgcgctcgtcgccggcacctgccccgcaccgtcgtacgcgcgtcacgcattcttccgctcgatcggcctcgggctcgaggacatcgcgatcgcgcacgcgctgtacgcgcacctgacgcgcgcatgagcggcacgcgagcgcggggccgatacaatggcgcaaccgccgcggcggccgcgcgcgggcgcacgggcatgccggccaccggcacgccgcctcgccggcccgatgggctgcccggcctccgcccacccgagatggcgacaccgatgcgcaagaagaaatccccgtcaaagacctgctgctcacccgttatgcgccgatcgccgacggtatcgccgcgctgttcttcccgtacgcggaagtcgtgatccacgacctgcacgaccagaccgtgctgtatctcgcgaacaacctgtcgaagcgcgaggtcggcgacgattccgcgctggaggaaatcgatcattccgcgcgcgagcgcgtgatcggcccgtacgagaagctgaactgggacggccggcggatgcgctgcgtgagcaacgtgctgttcgacgacgaaggccacccggccgggatgatgtgcatcaacttcaacatcgcggtgttcgacgaggtgcgcgcgacgctcgacctgttcatcaagggtgcgggcgtggtcgcgcagccggacgagctgttccgcgacgactggcaggagcgcatcaacacgttcctgcacggctggctgcgcgagcggcaggtcgggctgaacgggctcacgcgcgagcaccggcgcgagctcgtcgaagcgctgtacgcggagggcgcgttccgcggcaagagcgcggcgaactacgtcgcgaatgtgctcgggatgggccgcgcgacggtctacaaacacctcaagcacctgaaggaaacgcagggcgacgcgtaagggaaacgcggggcgggcgggttcgcccgttcgccgggacaacgaaacgcctgttcgtcggaacgcgcggcggcggcccgtatcggccgtcgctatcggtgcgccgcttccgtgtctatgcttcgtgatgcggcgggcgcccgtttcacgcgcccgcccggcctggacgaagcgtcgaagcacaaagtgatatagtcccggttacattttttgctgcccggaatcgcccatgacgaccgctcccgccccgattgcccgcccgaccctgaccgtcgaaatctggtccgacctgatctgcccgtggtgctggatcggcaagcgccgcttcgacgaggcgctcgccgcgttcgcgcacgccgagcgcgtcgacgtcgcgctgcgcgcataccggctgatgccgggccagccggtcgagccggtcgaggcgatgctcgccggcaagtaccggatgtcacccgcgcaggtcgaccagatgctgcgccaggtgaccgaggcggccgcgagcgtcgggctgcgttacgacctgcccggcacgctcgtcggcgacacgctcgacggccaccggctcgtgaagctcgcggaagcgacgggccgcgcgcacgcgctgaccgagcggctgtaccgcgcgtatttctgcgagcacggttcgctgttcgatcacgccgagctgaccgaattcgcggtcgaagcggggctcgagcgcgcggccgtcgaagacgtgctgcgcagcgacctgtaccgcgacgaagtcgaagccgacatcgcccgcgccgcgcagatcggcgggcgcggcgtgccgctgttcgtgttcggcggccgttacgcggtgtcgggcgcgcagccggccgacgcgttcgcgcaggcgctcgaccaggcatggcgcgacggcatcgtcgaactcgacggcagcgacgcggccgcatgcggccccgacggctgcgaactgccggcgcgcgcgtaacgcccgtcgcatccgtcacgcgcgtcccgcccggacgcgcgactacgcatcgctcctgccacaaaccggcaggaagcccgcgccgagggggcctacaatgcatcctttcaaataactatcagaaggctgcaagcccatgacccacgggatccacggcgagaagcgctggtacgcgctgatcgtcctctgcctcggcgtgctgatgatcgtgctcgacagcacgatcgtgaacgttgcgctgccgtcgatcagcaccgacctccatttcaccgaaacggccctcgtgtgggtcgtcaacgcgtacctgctgacgttcggcggctgcctgctgctcggcggccggctcggcgacctgtatggccagcggcgcatgttcctcgccggcctcgtcgtcttcacgctcgcgtcgctcgcatgcggcgtcgcccaatcgcagacgatgctgatcgccgcgcgcgcggtgcagggctcggcggcgcggtggtgtcggccgtgtcgctgtcgctgatcatgaatctcttcaccgaacccggcgaacgcgcccgcgcgatgggcgtgtacggcttcgtctgcgcgggcggcggcagcatcggcgtgctgctcggcgggctgctgacgagttcgctgtcgtggcactggatcttcctcgtcaacctgccgatcggcatcgccgtctatgcgatgtgcgtcgcgctgctgccgcgcctgcgcgcgccggccggcaccgcacggctcgacgtcgcgggcgcggtcaccgtgaccgcgtcgctgatgctggcggtctacgggatcgtcggcggcaacgaagccggctggctgtcgacgcagaccgtcgtgctgatcggcgcggccgtcgcgctgctcgccctgttcatcgcgatcgaggcgcgcgccgcgcatccgctgatgccgctcacgctgttcgccgcgcgcaacgtcgcgctcgcgaacgtgatcggcgtgctgtgggcggccgcgatgttcgcgtggttcttcctgtccgcgctgtacatgcagcgtgtgctcggctacgggccgctgcaggtcggtctcgcgttcctgccggcgaacctgatcatggccgcgttctcgctcgggctgtccgcgcgcatcgtgatgcgcttcgggatccgcggcccgatcgcggccggcctgctgatcgcggcctgcggcctcgccctgttttcgcgcgcgccggtggacggcggcttcgtctggcacgtgctgcccggcatgacgctgctcggcatcggcgcgggcgtcgcgttcaacccgatgctgctcgccgcgatgagcgacgtcgatccggccgattccgggctcgcgtcggggatcgtcaacaccgcgttcatgatgggcggcgcactcggcctcgccgtgctcgcgagcctcgcggccgcccgcaccgacgtgctcgcggccgcgaacgccgcgccgctcgacgcactgaacggcggctaccatgcggctttcgcgttcggcgcggcattcgctgccgccgccgcgctgatcgggctcgcgctgcgcatccggcggcaggacgccgtcgaaggcgccggccccgcgatgcactgacgccgacgagccgcaggcggcggacgaatccggccgtttgcatcgaacctggggcgcgcaccgtcgcgcccttttacttcttccgggtgccgcgcaccgcccgtcctgtcgtggctggccggagccggccatcacgttgtgcctgccccgttcaaacgcccgtttcaccgccgcctgccgcccgcgccttcccggccgatttttaacgcagtcgtacaccgacccgccacatttgcgacaatggcggactttgacccacgcgccgctaccgccgaacgccgcataaccgcctccttccgatgtcgcttccccatatcgatctgctgtactcgttgtccggcctgttcgtcggcatcctcgtcggcctgaccggcgtcggcggtggttcgttgatgacgccgatcctcgtgctgctgttcggcgtccaccctgcgacggcggtcggcaccgacctgctctatgcggccgcgaccaaggctaccggcacgctcgtccacggcctgaagggttcgatcgactggcgcatcacgggccggctcgcgacaggcagcgtgccggccgcggccatcacgctgtggtggctgcacacgcacgggatgaacacgccgggcaccgcgcggatgatccagctcgtgctcggcgtcgcgctgctgctcacgtcgctcgcgctgatcttccggccgcagctcaccgcgttcgccgcgcgcaacccgctcgcgccgaaccccgcgcgcacgctgtggtcgaccgtgctgacgggcgccgtgctcggcgtgctcgtgtcgatgacgtcggtcggtgccggcgcgatcggcgtcaccgtgctcctgctgctgtatccgatgctcgcgacgacccgcatcgtcgggtccgacatcgcgcacgcggtgccgctcacgctggtcgccggcatgggccactggctgctcggctcggtcgactggtcgatgctgctgtcgctgctgctcggctcgttgccgggcatcgtgctcggcagcctgctgtcggcgcgcgcacccgagcggctgctgcgcaacctgctcgccgcgacgctcgtcgcggtcggcgtaaggctcgtactcgcgtaggcaggcgccgatcccgcccttcacccgcggttgcgccttttcccggccagcgcatccgacgcgcggcgccctccgctgccgataaaaacagcccgaccggcctgcgccgatcgggctgtcgtccgtccggggcggctcgagccgcccgctccgcttactgcccctgctgctgcagtttctgctgcttgagctgctgcgtgcgcgcctgcagcttcagcacccgctgcagggcggtgcggttcgcgaggatcccgtcgtagaagttggcgagatcgcccttcagcgcggtccgcgacgcgtcgttcaggtagatcatgtggcccgacgggtagttcttgatcgtcaggttctgcgccttgagcgtcgggtcgagcggcatctgcgcgagcgtcagctccgtctggtggaacggcgtgacggcgtcgaaatagccgttcgccgacagcaccttcaggtccgggttcacgctcatcgtcgacgccaggtcgccggccgtgtacagcgtgttgccgccgcccttgttcgcgccggtcgggtcggtatggctgaagtcccagttgttgaagacctggtcgttcaggtccacgaacgacgacgtcgacgtgtacttgaggtcggtgttgatgtagctgttccacagcaccgtgtacgcgccgccgacgttcgtgatcgacggatcgttgctgcccgagttcggcaggatgtacggcgcgatgcccttgcccgtgaagttcgcgcgaccgtcgtactggccgatctgcgtgcccggaacgagcgtcaggaagaacgtgtacggcgggttgtcgtccgacgacggcacgttgccgagcgcggccgggttgccgaacgtctggatcagcgacgtcgggtccgtgccgatgtacgcacccatctgctgcgcggtctgcaggttcaggttcagccgcacgttcacgaagccgccgtcctgcggattcggcttctgcgcgagcggcgcgagcgtgttgtccgcgtagttgcgggcctggatcatgtacgcgtcgagatcggtcggcgtcgggttgagcgtcgtcttcttccagtagaacgcgtcggccgcgagtgtcgggaacgtgcccggcgcggacaacgcattcgcgtagtcgaggatcgacgactgcagcgtgatcccgttcaggtcgatgccgtcctcgtgcagcacccacgacacgaccgcgctgcgcgcggtgccgtacgactcgccgtacaggaatttcggcgaattccagcgcgaatacttggtcaggtagcgctggatgaagcggtcgatcgagcgggcgtcctggtcggtgccccagaagtccttgttcttcgccggggcgatcgccgtcgaataaccggtgccgaccgggttgatgaacacgaggtcggtacggtcgagcaggctgtccgggttgtcgagcagcttgtacggcgcgggcggcgtgaagttcgggaacgacgactgcaggcgcttcggcccgtacgagccgagcagcaggtagaccgacgacgagccggggccgccgttgtagaagaacgtgaccgggcgcggcttcgacgggtccggattgtcctgcgtgtacgcgacgtagaacatcttcgcgttcggcgccgaggtgaccgggtcgatcgtcgtcaggtggcccgtggtggccgtgtacttgatggtcttgccgccgatcgtgaccgaacggtggacgacggccgccccttccgtggaatccgtgaccgcgtcgttcggcccggtgccgtacacgtcgttgtcgacgtacggctggtcggccgccgcggccgttgcgctggtgttggccgacgtgctggcgccggccgacgtcgcagccgcggcggcagccgaagcagccgggctcggcccgtcgtcgccgccgcacccgtgacgagcagcgccgcggccgcggctgcggcgagcggcacgctcagtgtcgttccgaatagcgcgaaaccgtctttcaaggacttccgtgtcgtcattattgcctctcgaacagaacgataaataccgccggtcgcaaaggatcatttgcgccggcgctccgcaccaggaatgcattcgttatgcgacgcactccgagtttttaccggatcggtgaataccgatcggcacgatttaccccacccatgtttttgcaaccgcacaatggaatcaattccattgcaaacggcaattcaataatccgcagcaatacgaattcattgcgcgaatttgcatgcacacaaaatcgacggcaaaaacaccccgcaaggcccgcccgacaagggcgcctcgcttggaacagacgaacgatcccctcggcgagataccgattaatcgcagaatagcgatcaaccgcgactcgagccgatttaacaaaatcgaaaggatcgattaactaaacggaaaggattatcttcgtatctgtaatttattaaattaagtgaaaataccggcgcatattagggttctgatttaccgccgtaaagtaagaatttgttacagcgctcgccattcggacaaaagccaatccgggaccgattccattcgcacaaaggaaaaagccggacggctgtccggcttcgtgcgggcggcgcggcgggcgccgtcagagcggcacgtcgatcgtgccggcgccggtcgtgatcgcgttcgcccccggcgcggccgagatcggcggcaggttcgcgctcgtcagcgcgggcgcggcgcccggcgtgccgccgcgcggcaccgtgcggatcacctgcgacggcggcagcggcgcaccgttcttcaggtgccgccacatcaggttcagcgcctgcacgttgtagtagtgaaccggcacgaagcgcgtgtcgaagcccggcaccggcaggaacgcgtcgaagtgctggccgttcgtcacctcgtagaacacgagccggctgcgcccgccttcgctgatgccgttctgcgcgacgtacgcgcgcgatgcgtggttcacgggcaccagcgcatcgctgcggccctggacgatgatcgccggcttgccctgcaggttcgcgttcacgcgcaccgcatcgacgttcgcgggcatcccgagcatcccgttcgtccagagccggcgcaggcacagcgcgcccgcgaagctcgcatcgggtgtcgcaagccggtggtcgatacccgcgcccgtgttgaacacgaggtcgatgccggccgtcggcggcacgccgttgccgacgccgaatacggccggcatcggcgatgtggccggcgcggcgacggcgcccgtcgccgggttcgtcgtcgcgaagctgaaattgcacaggttgtcggtgacgcgcgagcgcgtgtacgcgttcgcatacgtgacggcgatcgccggaatcgcctgcgaatcccacatcggcgcttgcagcaggtcggaatcggcaaggtagccggccgcgtggagctgcgcgagcgcgtcggcggcctggctttgcgtatcggccccgacacgagcccggccgcggcgagcgtcgcgcagcgctgcgtgcggatcgactgcgtggtcgccgccggcagcgcgctcaggtacggcgcaccggcgagcgacgccgacgcggccgcgcacggctgaagcaggttcgcgagggtcgcgtagtcggccagcggccggccgaacgacggcaccggctggccgcccgagcgcacgaccgcgttcggcgccatccgcacgttgatttgcggctcgccgaccacgaccgcggtgatccagccgcgattgtcctgctcggccgccgcgagcgacgcgccgccgccgttgctgaccgacgcggcgatcgtcgtgatgtcgcccgcgcgatagcgcacgccgtgatgcgagctgtcgatcagcgggccgaactgctcgttgagcgcccagtacgcgaactcgaccgactgcagcgtcacgcgcccccagtcctgctcgggattctgctgcgaatgcgcgtgcttgaacgcatagcggttcgggaagcgggaattgaaggtggcgagatcgccgctcgtcacgttcgcggtgaacaggctcgcggtgccggccagcaccgcgttggcgagcgtgccgtcgatcagcgtgacggtgtccgacatgagttcgtgcgcgccgttgccgccgcccttgtcgttgtaggcaaccgcgcagccgcgcttgagcgcccattcgccggccgcggaaatcgcgccgtacacgccgcgcgagcccgacgacgttgcggtgacgatgcacggctgcgcgggattgaagctggcgggcacctgcacgagcagcgtcacgttcttgctgccgctgccgtcgtcggagtatgcgagatattcagtgccggggatcttgccttcgccgagcgtggcgttgccgtcgagatcgacgttcggccccagaagcggccgtagccgccgttcgcgctcatgtcgacgagcgcgcggtaattcgaccagatcgcgaggcggcgcagctcggcgcccgtcggccgggcggcgttcgcgaagcccggcgcggtggccgagccgaggcccgtcttgccgaggccggctgtcagcaggtcgtcgctcgcgccgtcataggctgtcgtgcgcacgctgccggacacgaaaccgggcaaccggttgcgctcggccgattcgtcgccgttgcaggcgccgagtagcgcgatcgcggccagcgccgcgccgaaaaccatccgcctgccccacccgagcctcgtcatcgccgccctctcgatatcgttatcggtccgccgccgcttcatgcggcttgcggcctctcaagcgcaaacgggccccggcatgccggggcccgcctggaaacgggcgcacgcggcgctcgcgcgccgccgcccggcatcactgctgctgaaccgtcagcttgttcgtgaccgacgtcacgcccgccacgcccttggctgcggcttcggccttgtcgatctggtcctgggccggcatcgtgccttccagcgtgatcgcgccgcccttcgaacgcacgacgaggttcgacacgttgacgcccgattccttcgaaatcgccttgcgcaccgtatagccgagcttgcggttcgccttcttcgcggttttcgcggcggccttcggcgcgctggtcgctgccgcgggcgcttccgttgccgccgcatcgctcgactgcgcatacacgctgcccgacagacaggccgccacggcggcgacacccaacgctctcaacacgatcgacttcatgctatctccttatcactccggaacggccgtgcacagtacggccggatacccaaaacagccggcccgcgcgcgaacgggcgggacagccggtgttttccacggcgatacgagagaggcaagacgggctggcggacggcgcacgcgagagcgggccggccgggccggacagccgccggccggacgcgcccggtctcattgcgtgccgggtcgcgcgcgaatcggcgcggctgcgtcgcacaatgtaatccagcgcccgcggaagcgcaaagcttttgacgcggcggcccccgccgctgtcgtcgcgccgctgcgccgcactcgcgcacgcaccgcgaaaccgggtaccatcgccgcgagaatccgcatcgtccgcgccgaccgtcaccgatacgtcacgccagcgtcatccgccgcccccatgaagccagcccgcccccgcccgcctcgccgcatcctcgcccgcttcgtcgcggtgtcgtggcgcgacctcgcgctgtcgatcggccccaccgtgctgctcgccgccacggccgtctggctcgcggtcaagctgatccagccggccccgccgtccacgctcgtgatctcgtccgggccgcccggcagcacgtactggaacgccgcgcagaaatacaagacgatcctcgcgaagaacggcgtcacgctcgacgtccagtcatccgaagggtccgcccagaacctcgcgcggctgtcgaacccgaacgcgccggtcgacgtgggcttcgtgcagagcggcatcggcccgaaggagcgcgacgaacacctcgtgtcgctcggcagcatcggctacgtgccgctcgcgatcatgtaccgcggcccggtcgtcgcgcgcctgtccgacttcaagggcaagcggctcgcgctcggcgcggaaggcagcggcgcgcgcgaactgagcctcgcgctgctgaagatgaacggcatcgtgccgggcgggtcgaccgagctgctgccgaccgccggcgaggatgcggccaccgcgctgctcgacggcaagatcgacgcggcattcctgtccggcgactcgacgcagatcccggtgatggcgaagctgttccgcgcaccgggcgtgcacgtgtattcgttcacgcaggccgaggcgtacgcgcggcgcttccctacctgaccgcgatcacgctgccgatgggcgtctacgatctcggccgcaacctgccgcccgccgacatccacacggtcgcgccgaccatcgagctggtcgcacgcgactcgctgcaccccgcgctgtccgacctgctgatcgaggctgcgcgcgaggtgcacggccacgcgacgatcctgcagcacgcgggcgaattcccgtcgtccgtcacgcgcggcttcccgctgtccgacgacgccgcgcgctactacaaatccggcaagaccttcctgtaccggcggctgccgttctgggtcgcgagcctcgtcgaccggctgctcgtcgtggtcgtgccgctgatcgtcgtgctgatccccgggctgcggctcgtgccgtcgctgtacggctggcgcgtgcgctcgcgcatctaccgctggtacggcgcgctgatcgcgctcgagcgccgcgcgctcggcgagcacacggccgaggagcgcgtgcagctgctcgacgaactcgacgacatcgaggaagccgtgaaccggatgaagatgccgctctcctatgcgggccagttctacgtgctgcgggagcacatcggcttcgtgcgcgaacggctcaccgcgcacgaccacgacacgccggccggcccgccgggcgccggcggcccgccgcaggcacgtgccgacgccgcgccgccggccggcacgcccctcgggcgactcccggttccgcttgaccggacgatccgcgatcattgccgcatgcgtgcaccgccgcgtaacatggaggccgccgccagacgccgcacgccccatccactggagatcgacatgacaaccggcctcgatatcgcccagcccgcctggttcttcgacttcgtgtcgccgttctcctacctgctcctcgaacagcacgacaagtggccggacgtgccgttcgaacccgtcgccgtgtcgctgcccgacctgcagcggcactggggcagcgccccagcgccgacgtgccggccaagcgcgtgttcacgtaccgtcacgcgctgttccgcgccgagcagctcggtatccgcttcaagatgccgcccgcgcacccgttcgagtccgacaaggtgctgcgcctcgcgatcgcgctgcgcgccgacatcgcgaccgtgctggagatgttccgcttcatctggcgcgacggcaacgatccgtcgacgccggaagggttcgcggcattgtgcgagcgggtcggcgtcggccacggcgacgagctgatcgaattcgaggagaccgccgcgcaactggcacgcaacaacgccgacgcgatcgcgctcggggtgttcggcgtgccgacgttctggatgaaccagcagctgttctggggcgaggatgcgctgccgatggtgctgtactgcgcgcgcacgccgaactggctcgaatcgcgcgaggtcaagcggatcagcgcgctgccgaagggccgcgcgtgatggccggtatcacgcacggcaacgcgcgattacggtaacgttacgcgtcacccgaatcacccccaccgatggaagacgacgaccgtaccgcctcgctcgatatctggctcgtgcgtgtgctgcgcacgctgctgctcgagcgcagcgtcacgcaggccgcgctgcggctgaaccagacccagcccgcgatcagcaccgcgctgcgcaagctgcgcgagacgctgaacgacccgatcctcgtgcgcggcaaatccggcatggtgccgaccgaatacggcgcgtcgctgctcgaggccgcgcagcgcgcgctgcgcgaggtcgatttcatcgcgacgccgcacggcgacttcgatccgtcgtccgcacggcgcacgttccgcgtcgccgcgcccgattacctgaacgatttcttcatgccgacgctgatcgagcgctttcgcgacgcggcgccgcatgcgcacctggagatcgattcgctgaatcccgcgctcgatcacgcgggcgcgctcgaatccggcgcgctcgatctcgtgatcggcaactggccgaagcccgacccgcagttcgcacgccaggacctgttctccgacacgatcgtgtgcctgatgcgcgatgcgcacccgctcgcgcgcgggccgctcacgcgcgaagcatacgcgtcggccgcgcacgtcgcgccgacgccgtacaccggcgacaagcgcaacgcgatcgagatcggccttgcccgcgcgcacctcacgcggcgcatcgtgacgacgcttccgtacttcgggatcgtgccgcaggtgctgctgcaatcggacctgatcttcacgacgacgcgccgcttcgcgacgcattacgcgcagttgctgccgctcgtcgtcgtcacgccgccggtgccgtttccgcgcatcaagagctacctgctcacgcacccgcaacccgaccggccgaccgacatcgcgtggctgtgcgcgctgatgcagagcgtgtccgacgagctgacggtcgcccgcggccgcaagcgctgagctgagctgagctgagccggcgcggccgttcaggccgttcagccgttcagccgttcagccgttcagccgttcagccgttcaggccgctcagccgctcaggccgtacagaaggtttcctgcagatgggtccagcgcacgacgcccgccgcgtcgcgttcgaacacggcggtcgcgcggcgcgcgggcagctcgcccgaggccgcgtgctgcgcctcgagataggtgagcgtcgcatgcgacgcgtcggcggcgagcacgcggatgtccgacagcgtgatgcgcagccccggcttcgcgccggcgagcttcgcgaacagcgcgcgcgtgccgtcgtggtcgacctcgcggccgtcggtcaggatcatcgtgaaatcggcggagaacgaagcgagcagcgcgtcgagcgccccgggcgcggtatcgacgccggacaaccagcgctcgatggcgacgaggctcgcatcgagcgtgtcgagataaacctggtgatcggacatggtgcgtgcacggtaaggcgcggcccggtgccgcgcgtcgtcgtgcagtgtatgcaaaaacgcgcggccatgcgctggccgcgcggtgctatcgcgcgcaggacacgtcgtcgcgcgcacgccccgtcgcggcggccttcacgtccgccaccggcatgcccgagcgcgcctgcagcagctccgcgcacacggccaccgcgatcgcgcccggcgtcttgtcgacgatgcccgcgacgccgatcgggcacaccatctcgacgagccgcgccggatcgacgccgcgcgcggcaagccggcgctcgaacttcacgcgcttgatgcgcgagccgatcatcccgaagtacgcatagtcgcgccgccgcatgatctgcgcggcgagcgagaagtcgagcgcgtggttgtgcgtcatcacgaggaaatatgcgccgggcggcgccgcgtcgacgacggcctccggcgtgtcggtcggctccggctgcacgttcggcggacattcgtccggaaacagctcgtcgcgcgtgtcgacccactgcacgacgcacggcagcgcgccgagcagcgtgacgagcgcgtgaccgacgtgcccggcgccgaacagcacgatgtgcatcggcgccggcgtgccgctcgcgcggttgcgctggccggtgccctgcgcgaacgccgggggcggcgcggtgcgaagcgaacgtgcggcgccgttcatgtcagcctccgccgggccgccccagggaggctgaccgcccccatcggaagcagcgaacgaagcgagcgtgggagccgtttcatctcagcctgcctgaccggcgcgcgccgcacgcaccgcgctgaccgcgcgcaggatcgactcgccggtggccggcgcgtcgagcggcgggttcacctggtagtcgccgaccgcggccaccgcgtcgcgcaccgcgaagaacaccgagaacggcagcagcagcggcggctcgccgacggccttcgaacggtggatgctgtcctcgacgttgcggttcttgaacagctgcacgttgaactcgggcggcgtgtcgttcaccgtcgggatcttgtacgtcgacggcgcatgcgtcatcagcttgccgcccttgttccaccacagctcctcggtcgtcagccagcccatccctggatgaacgcgccttcgacctggccgatgtcgagcgccgggttcagcgatgcgcccacgtcgtgcagcgcatcgacgcgcagcgtgcgcatctcgcccgtcagcgtgtcgatcacgacttccgacacggccgcgccgtacgagtagtagtagaacggccggccctgcagcttcgactgatcccagtacagcttcggcgtcgcgtagaaaccgtcggaccacagctgcacgcgcgcgaggtacgccttcgcgaccacgtcgccgaacggcacgccgttgccgccgacccacacgaagtcgttgccgaacttcacgtcggccgcatcgaccttgccgtcgccgaactgcttcgccgcgaacaccgcgagccgctcgcgcagctggcgcgccgcatcctgcgcggccttgccgttcaggtccgagcccgtggaggcagccgtcgcggacgtgttcgcgaccttgctggtgtcggtcgccgtcacgcggacccggccgaagcggatgccgagctcgtgcgcgacgacctgcgcgaccttcgtgttgagcccctgccccatctccgtgccgccgtggttcacgagcaccgagccgtcggtatagatgtgcaccagcgcgccggcctggttgaagtgcgtgacgttgaacgcgatgccgaacttcaccggcgtgagcgcgatgcccttcttcagcaccgtgttacgtgcattgaattcgcgcacgcccgcgcgccgcgcgcggtagtcgctcgtcgcctcgagttcgccgagcagctcctgcagcacgttgtcctcgaccgtctgcccgtacggcgtcacgttgcgttcggtcttgccgtacaggttcgcgtagcgcacgtcgagcggatcgcgatcgagcgaacgcgcgatgtcgtcgaggatgtactcgatcgcgaacgcgccctgcgggccgccgaaacctcggaacgcggtgttcgactgcgtgttggtcttgccgcagtaaccggcgatgttcacgtcgccgagccagtacgcgttgtcgaaatggcataccgcgcgcgtcatcaccgggcccgacaggtcggccgagaagccgcagcgcgacgtcatgtcgagcgcgacgccgtcgatgcggccgtcgtcgtcgtaaccgacgtcgaagcggtaatggaagtcgtgccgcttgccggtgatcatcatgtcgtcgtcgcgatccggacgcagcttcaccgggcacagcagcttccacgcggcaagcgccgcgcagcacgcgaacaggcccgactgcgattccttgccgccgaacccgccgcccatccggcggcattcgacgagcacgttgtgcgacgcgacgccgagcacgtgcgcgacgaggtgctgcatctcgctcgggtgctgcgtcgagcagtacacgtgcatcccgtcgtcgtccttcggcaccgcgtacgcgatctgcccttcgaggtagaactgctcctggccgccgagcagcatttcgcccgactcgcggtgcggcgcgacggcgagccgtgcggccgcgtcgccgcgcgcgagcttcagcggcgggatcacgtaggtttcagccgcgcgcgcttcctgcgcggtgagaatcgccggcaactcctcgtagtcgacctgtgcgcggcgcgcggcgagccgcgcggtttcatgcgacgtcgcgacgacgatgaacatcggctggccgacgaactgcacgatgcccttcgcgagcaccgggtcgtcgtggatgatcgggccgcaatcgttgacgcccgggatgtcgtcggccgtgaacacggcgaccacgcccggcgtcgcgcgcaccgcgtcgaagttcatcgacacgatcttcgcgtgcggcttcgccgacaggccgagcgccgcgtgcagcgtgcccgcgacgatcgggatgtcgtcggtgtaggtggcacgtccgctgacgtgcaggtgcgcggattcgtgcgcgcgcgagacgtgaacctgcgcggcgtcggcttgcggatcgagggtgttcaggaacggttctgcttgctggttcatgttcggggttctccgtcttcagacgcgcgccgcgtcggtgccggtttcggcagccacttcacgcacattcagggcttgcggcggcagcgggtcgtgcgggcgcgtctccagccagaatcggtacatcaggttcttcgcggtatcgaggcgatacgtgctcgtcgcgcgcatgtcggacagcggctggtagtcgcgctcgagcgcctgcatcgcggcctgcgcggtggcttcgtgccattgcgcgccgtcgagcaggctttccgtgtgcgtcgcccgcttcggcgtcgcggccatcccgccgaacgcgatgcgcggctcgcggatcgtgtcgccgtccgcgatgaacgcgaacgccgcgcacacggccgagatgtcggagtcgaaccgcttcgacagcttgtacgtgcggaactgcagcttcgcgcgcgcgccggtgcgggtcggcaccttcaggccgacgacgaattcgtgcggcgccatgtccttctgctggtagcccgtgtacagcgcctcgagcggcagctcgcgcaccgtgtcgccgccgcgcagcaccacgcgcgcgccgagcgcgatcaggcccggcatcgaatcgccgatcggcgagccgttcgcgacgttgccgccgatcgtgccggcattgcggatcggcagcgacgcgaagcgcttccacatttcggtcagctccggatacgtgccggccagcgccgcatacccgttctcgaccgtcacgcccgcaccgatctcgatccagtcgtcgccgtgcacgacgcgctgcagttcggcgatctggccgacgtagatcaggtcgtcgagccggcgcatctgcttcgtgacccacaagccgatgtcggtgctgcccgccagaatgcgcgcgtcgggccgctcggccttcagcgcggccagcgcatcgagcgtgcgcggcgccgcgaagcgcgcgccgtcgagcgtcgtgtagtcgaacgtgtcgtcgcgcttgagcgacgcgagcgtgcgggccagcgcagccgtgtcgaccggcgccgacggcgccggcccatcgaacatctgcacggccgcgtcgacgatcggccggtagccggtgcagcggcacaggttgccggtcagcgcatcggcgatctcggtgcgcgtcggtacgcccttcgccttcgcgcacgcgctgccgcagccttcatggccgtgcttctcgtacagcgcccacatcgacatcacgaagccgggcgtgcagaacccgcattgcgaaccgtggcagtcgaccatcgcctgctgcaccggatgcagcgcgccgtccggctgacgcaggtcctcgaccgtgagcagcgccttgccgtcgagcgtcggcaggaactggatgcatgcgttgacggccttgaactcgaccgcgccggtgtcggtcagctcgccgacgacgaccgtacatgcgccgcagtcgccttccgcgcagccttccttggtgccggtgcaatgcgcgtcctcgcgcaggtattgcagcacggtgcgggtgacgtccgcgccgctgacttcgcggatcgcgtgacgatggtagaagcggatcggctcactcatgtctcgagggttcttcaaatgggggcaaggcggcctgcgcagtgcgctcgaccgacgtttttctgacagtttgcacgctatcaccatcaaatttcgcaacccatagcccatcacgcatggggcccatataactgccgcgatatgaacgccgggaacgccggggagcgccgggaccgcccgcagccctttccgcacggtgccctgcacccgttcccgacgccttcgacaccgtccgccatcgtcaaaaacggggcgcgattaactaaatggtacctgcgtgaaaaccggttccatgggaaaatcccgattccctttttcgccgtcttccgttcgcttcgttcattcgttccgaccccatgtcaaccgattccgccacaccgccgcgcagcgggttcgcggtcacgctgcaaatcgtgtccgtcgtctgcttcacgttcatctgctacctgaccatcggcctgccgctcgcggtgctgccgggcttcgtccatgacgacctcggtttttccgcgatcgtcgcgggcggcgcgatcagcgtccagtatttcgcgacgctcgcatcgcggccgctcgccgggcgcttcgccgatacgctcgggccgaagcagacggtgctgcgcgggctggtcggctgcggggtgtcgggcgtgctgctgctcgtcgcgctgctgctcgcgcactggccggtcgcgagcctcgtgctgctggtcgcgagccggctcgtgctcggcgtcggcgagagcctgtgcggcaccggcgcgatcctgtggggcatcggccgggtcggcgtcacgcacaacgcgaaggtcatctcgtggaacgggatcgccacctacggcgcactcgcgctcggcgcgccggtcggcgtcgcgatcgcgcatacgctgaatccggcgctgatcggcgtgatcgtgatcgcgctcgccgcgaccggcttctatctcgcgcgcctgatcgattccgtgccgctcgtgcacggcgagcggatgtcgtatgcgagcgtgttcacgcgcgtgctgccgcacggcctcggcctcgcgctcggctcggccggcttcggctcgatcgccaccttcgtcacgctgtactacgccgcgcgccactggccgaacgccgcactgtcgctgaccgtgttcggcacgctgttcatcggcgcgcgcctgctgttcgcgaacacgatcaagacgtacggcggcttccgcgtcgcgatcgtgtcgttcgcgttcgaatgctcgggcctcgtgctgctgtggctcgcgccggtgccgcacgtcgcgctcgtcggcgccgcgctgacgggcttcggcttcgcgctgatcttcccggcactcggcgtcgaggccgtcgcgctcgtgccgcccgcgagccgcggcgcggcgctgtccgcgtactcggtgttcctcgacctgtcgctcggcatcacgggcccgctcgccggctatgtcgcgggcgcgttcggttatccgcaggtattcctgttcgcggcggtggccgccgccgcgggcgtcgcgctgtcgatggtgctgtaccagcggcaggcgcgggttgcggagagcggcgcggcggcatgagcgtgctgcgtgttgcatggcgtcgggtcgcgcatatcgcgtcgcccgcccccaagaaaacgcccgcatcgcgcgggcatttttgctggccagtacggcagcagcgctcacgccgtcctcagaaacagcctccgcgtcaggtcgaacgcgaccaggttgccggccaccaccagcagcagcccgaccaccgcgagcggcgaccactggtaaccctcgaacaccgtcgacaccgccagcgcgacgatcgggaacagcaccgtgcagtacgcggcacgctccggcccgatccggccgacgagggtcaggtaggcggtgaatccgatcaccgagcccggcacggccaggtagacgagcgcgccgagataacgcgggctcgtgtcgagcgtgaacggcaagccggccgctgcgctgccgacggtcaggatcgccgcgccgatcagcatcgcccagccgttggtcgcgagcgggtgcagtcccatcgactgcatccggctcgacagcaggttgccggccgagaagcacatcgtgcccgccagcgcgatcgcgagccccgtccaggtcgcgtggtcgtcgagatggccggccatctgctgccagaacaggcatgcgatgccggtcaggccgagcagcgcgccggcgatcgccgacggccgcagcgggcggcccatgaacagccggccgttgatcgaattcaacagcggcgcggtcgagaagatcaccgcgacaaggccgctcggtacgacctgttccgcgtagtagaagcacaggaagttcaggcagaacagcgcgaagccctgcgccagcaggaaacgccacgcttcgcgcggcgggcgcaccggccggcgcatcacgcgcagcagcgcgaacagcacggcggccgcgagccagaagcgccaggcgatcgacacgggcggcggcacggagccgagctgccacttgatcgcgatccaggtggtgccccagatcagcacggtgacgaaataaagcgacaggttcatggcggcaacgatccaaaaagcgggtgaaacgggactccgactatgccgccgcccggcgcgcgccgattgtccggaattgcggtcttttcgccgccgcccgcagcgccgcccgcccgcttatactcggcccatcatgagcctcaccctttccgcgcccccatcgaccaccccgccgccctggccggcggcgatctgccgttcggcctgcagtcggtctgccgcacgctcgccgacgcgaacgcgacgctcgagcgcttcgcgtggctcggcgatcatctcgcgatcgccgaatggacgcggatcaccgacgaaagcgagacgatctacgagcagccgggccaccacacgctgtcgtgctacctcgacggcggctaccagacggaacgccagcgcgtgccgcgctacggcgcgccgagcctgctgtgcgcgctgccgggcgaccatgaatcgcgctggtgggtgcgcggcgagatgcacttcatccacctgtatttcctgcccgagcacttcacgcagcgcgcgatccgcgaactcgatcgcgagccgcgcgagctgaagctcgccgaccgcacttacttcgaggatgcgcgcgtcgcctccctgctgcgctcgctcgcactggacggctggaacgatgccgacgagcggctgcgcgtgaacgaaaccgcgcacgaggtgctgagcctgctgctgcgcgggcagagcacgacccgcaccgacacgtcgttccgcggcgggctcgcgccggccgtgcgccgccgtgtgcgcgactacatcgacacgtacctgacgcaaccgctgacgctcggcgaactcgccgacgtcgccgcgctgtccgagtaccatttctcgcggatgttccggttgtcgttcggccgggcgccgcacgcgtgggtggccgagcaacggctggcgcgggcgcgcgagctgttgcgcacgacggcgctgccgctcgcacagatcgcggccgactgcggctatgcgaacgccggccacttcagccatcgcttccgcgacgctcacggtacgacgccgaatacctaccggcgtgcgatgcagggccgctgagcgcggccccggcgcggcttacgcgccgcgtcgcgacagttcctgttcgagcgccgcgacgccggccggcaggtcgaccggcaccttcaggtcgaccatcgtgcggccgaacgcatgcagcgtacggaacaggttgtgttcacggcactgctcgcccatctgtccgatccgcacgatcggcaacccgaacgagcccgagatctcgacctggtactgcttcgagatgtggccgcagaccatccccggcgtcagcccttccggcgtctcgatcccgacgaccgagttcagccggcaatccttcggcgcatagagcctgagccccatcgactcgacgcctgcctgcagcgcgagcgagcagcgcaggtggcgcgcgaagcggctttcgagcgtctccgcgcagacgagccgcagcgcttcgtgcagcgcgagcacgcccgacacgggcgccgtgtagtgatagcccgcgttgtgccagaaattctccgcgagcgccatgtcgaggcaccagtgcgcgttcggttcggggcgctgcttcatccggttccacgcggcgtcggagaacgcgatcagcgacacgcccgggatcgacgacagccccttctggccgccagtgatcaccgcgtcgatgccccacgcgtccatctcgagcggcatcgtcgacagcgtgcacaccgcgtcgaccacgaccagcgcaccggccgccttcgcgagcgccgcgatgtcgcgcaggtcgcggttccacacggtgttcgacgtctcgccctgcacgatcgtgacgatctcgggccgctcgcgcgcgatcgcgtccgcgatctcgtcgaggctcgcgaccgcgcgatcggccacttcgagcgtcgcgacgtcggcgccgacgcgcgtggccatctcggccatccgcgcactgaagaagccattgcggatcgacagcacgcgggtaccgcgccacgcgaggttcgagatcgccatttccatcgcggccgaaccggggcccgcgacgccgagcacccacttcgtgcgggtctggaacacgtagcgcgccatctccttcacctgctcgatgatcttcgccatcgtcgcgccgaggtggttgatcacgatcgtgttcgccttcgcgacggcggccgggatcggaaccgggccggccccatcatcagcagcggttcttcgggcaggatcgcgtcgagcggcacgacgacgggacagggaatcggcgagtaatcgatggacatggcaggtaaaaggtgaggaaaggaagtgcacggacgctcgccgcgcagcatggcgaactgatcgatcattccgtgttccgccgcctcgcgcaagaggcacgcacggccggacagcgcaacgctggcccggtcgccggaccgggccagccagccgtgcgcgtgccgcacgccagccattcgaaatgagaaacgattgcgggccgggttgtgaaacggttccattcgtacgccaggcgcccgattttctccgtcaataacacaacgaatcgtcgaaaccgccggttcaacgcgacttctgtatcaaaaaaatagaccgaatccaccctaaaaatcgcttcacggaatccggcacgcaaaacagacgtgcggccccaaaaacatccattacttctgcatgtattggggcacgctttcctcaataccggaacaagcgtgccagaatagcgatcaacccattgattaacataagaaatactcgaccaaccgagcttactctaataccctgccgtctttgaacggcaggcatcgatacagcaccgcgtttaacgcgttactccctatttcgattttccgcaacccgccccttttctcaggttgacggatatcgcttctgtattgaacaatcgtctgcggaatcgaaaaacgatttttcgatacaaaggaaaactgggtgccgcgcgatacgctttcgaggttgcgcggcgaaaagcatcaaccataatcaatcaaccgggccagaaatacgcaagccatgaaccagattcagaccatgcgtgtattcgtctgcgtcgccgagcagcagagcttccggcgcgcggcgcaccatctcggcgtgtccaatgcactcgtcacgcgttcgatcgcgatgctcgagggccacctgaacacacggctgatccaccgcaccacgcgcaacctgtcgcttaccgaggccggcgtgcgctacctcgacgggtgccgtgcgctgctcgaggaattcgaccacctcgaatcgtccgtcgcgcatgccgtgcgcgaaccggccggcacgctgcgcgtcgtcgcgtcgggcctgctgtcgccgcttgcactgacgccgctcgtcagcagcttccggcaccgctaccccgagttgcgcgtgcagctgaccgtctccgaggggccgctcgacgtgctcgattcgggttacgacgtcggcatcgtcacgggcaaccggctcgacggcaacccgacgctgatcggccacgcgctcgcgccgaacccgttcgtcgcgtgcgcggcaccggcctatctcgagcgacgcggcgagccgcgcttgcccgacgacctgccgggccacgactgggtcacgctcgcatcgcaccagcatgcgcccgcgtggcaactggtcggccacgacggcatcgcgcattccgtcacggtgcgcccgacctgcacggtcaaccagctcgcgctcgtccaggcggccgccgtggccggcgccggcatcgcggtgctgcccgagccgtgcgtcgccgacgcgctcgcgagcggcacgctcgtgcggctgatggccggctaccggatcgacgatcccgacacgcaactgtcgctcgtctacccgaaccgccagtacgtaccggcccgcacgcgcagcttcgtcgagcacgcgctcgaccacttcagtgcgcagccggcccgcgaacgaaccgactacggcttcctgcggccgccgcgcgggcccgaccgctccgacatcgtcacgggcctgcaaaactgcgcgcgtcagccttcggaggtgcagcgtgcgcgtgatcctgttcagcagccggcagtacgacgacgattcgttcgctgccgccaaccggcagttcggctatcggctgcacttccagccgtcgcacctcgacgcggaaaccgcgatcctcgcgcacggttatgaggtcgtctgcccgttcgtcaacgacaccgtcgacgcggccgtgctcgaacggctggccgacggcggcacgcgcctgatcgcgctgcgctcggcgggcttcaaccatgtcgacctggccgccgccgagcggctcggcatcacggtcgtgcgcgtgcccgcctattcgccgcacgcggtggccgagcacgcggtcgcgctgatcctcgcgctcaaccgccgcctgccgcgcgcggtggcgcgcacccgcgaaggcgacttctcgctgaacggcctgctcggcttcgacttgcacggcaagaccgtcggcgtgatcggtaccggcatcatcggcagcgtgttcgcgaagatcatgatgggcttcgggatgcatgtgctcgcgcactcggtgccgccgtacaacgacgaactgatcgcgttcggcgcgcgttatgtcgagctcgacgagctgctgcaccacgccgacatcgtcagcctgcactgcccgctgctgccgtcgacgcaccacctgatcaacgaacggacgctcgcgcggatgaagcatggcgcgatgctgatcaacaccgggcgcggcggcctcgtcgatgcgcaggcgctggtcgatgcgctcaagagcggccagctcggccatctcgggctcgacgtgtacgaagaggaaagcgggctcttcttcgaggatcactccgacctgccgctgcaggacgacgtgctcgcccgcctgctgacgttccccaacgtgatcgtcacgtcccaccaggcgttcttcacgcgcgaagcgctggccgagatcgcgcacacgacgctgctgaacatcgaggcgtggcatgcgggcacgccgcagaacgtcgtgaccgcgaatcgctgacaaaccgacgaaaacggctcatttgacggttgccggcgccaccgcaatcgtttgcttgtggccatcgccgcaatcgaagcgcgtttcatcaacaatttcgcgctttgtttcgactgatgtaacgattccggtgcgccgtctgctatcgttgcgccgacgttatcccgcccctcccgctcatgcgtttcgacgactccgacatcgccgccgtctaccgcgccattttcgaacggcgcgacatgcgccacttcacgccggcgcccgtcgatcccgccgtgctcgcgcgcctgctgcgcgcggcgcatcacgcgccgagcgtcggcttcatgcagccgtggcgcttcatccgcatcaccgatcccgcgctgcgcaccgagatccacgcgctggtcgaggccgagcgccgcgcgaccgccgacgcactcggcgagcgccaggacgaattcatgcggctgaaagtcgaaggcgtgcgcgaatgcggcgagttgctgatcgtcgcgctcgccgacggccgcgagcgtcacgtgttcggccgccgcacgctgccggaaatggatctcgcgtccgccgcgtgcgcgatccagaacatgtggctcgcggcccgcgccgaagggctcgggatgggctgggtctcgctgttcgacgtcgacgcgctgcgcgcgctgctgcgcatgcccgatggcgcgaaaccgatcgccgtgctgtgcgtcgggcacgtcgatgcgttctatgcgaagccgatgctcgagcaggagcgttgggccgcacggatgccgatcgaagcgtgcctgttcgaaaacggctgggacgatccggccccgatcgatgccgccggcgcgccttcgtcgcgcgcggacgcgacagcggcccccgactcggcaatcacaccgggcgcgtcgaccacgggcgtcgacggctccccgaacgcatcgcctgacgtgtacgcggtcgccggcatcgtgccggcaccggcacattcaccgcggcaagccctgttgaatcccacactgtgagcttcacgcgcgcagcctcgtcgcacgccggcaacatccgttttggccccaagcataggggttttcactgaagtagaatcgcggctgtcgttcgccttcccgcccgcccgtcccgcgcatcctgcgccagcccgagcggcggcttttcccgagcccaccgcgatgcccttacctcttttcgccctcgccgtcgccgcatttggaatcggtaccaccgaattcgtgatcatggggctgctgcccaacgtcgcgcgcgatctcggcgtgtcgatcccggccgccgggatgctcgtgtcgggttacgcgctcggcgtgacgatcggtgcgccgatcctcgcgatcgtcaccgcgaagatgccgcgcaagcgcgcgctgatgggcctgatcggattgttcatcgcgggcaacctgttctgcgcgatcgcaccgggctacgcggtgctgatggccgcgcgcgtcgtcaccgcgttctgccacggcgcgttcttcgggatcggctcggtggtcgcgagcaacctcgtcgcgccgaaccgacgcgcacaggcgatcgccctgatgttcaccggcctcacgctcgcgaacgtgctcggcgtgccgctcggcaccgcgctcggtcaggcattcggctggcgcgcgacgttctgggccgtcaccggcatcggcatcgccgcggccgccgcgctcgcggtgtgcctgccgaggaacctcgcgatgcccgacaccagcatcacgcgcgaattcagcgtgctgaagcacccgcaggtgctgatggtgctcggcatcagcgtgctcgcgtcggcaagcctgttcagcgtgttcacgtacatcacgccgatcctcgaggacgtgacgggcttctccccgcgccaggtcacctacgtgctgctgctgttcggcctcgggctgacggtgggcggcacgctcggcggcaagctcgccgactggcgccggatgccgtcgctgatcgcgacgctcgcgctgatcggcgtggttctcgcgctgttcgcgggcacgatgcacctgccgttcgccgcgctcgcgacgatcttcgtgtggggcatcctcgcgttcgcgatcgtgccgccgctgcagatcctgatcgtcgaccgcgcaagcgatgcgccgaacctcgcatcgacgctgaaccagggcgcgttcaacctcggcaacgcaaccggcgcgtggctcggcgggatggcgatcggctccggcgtgtcgctcgtgagcctgccgtgggtcggcgtcgcgatggccgtcgccgcgctggcgctcacgctgtggtcggcgtcgctcgaacgccgcccggtgaccgtgccgaccgaatacgtgtaacgccgccccgcgcgcattcgttgcgcgcgcaacgccagcaacaccatccgaacctgatggccttcatggacctttcaaggtccgcggtgtagcatcccggccgatgaaagccattctgaatcgcgatttcctcgcgctgatcctgagcgtcgcggtcgtcggcctcggcaccggcgccacgctgccgctcaccgcgctcgcgctgaccgaggccgggcacggcaccaatgtcgtcggcatgctgaccgccgcgcaggccctcggcggcctcgcgatcgtcccgttcgtcaccgcgctcgcacgccacatcggctcgcgccgcgcgatcgtcgtatcggtcgtgctgctcgcggcagccacggcgctgatgcagttcacgtcgaacctgatcctgtggggcgcgctgcgcgtgctgtgcggcgccgcgctgatgctgctgttcacgatcggcgaggcgtgggtcaaccagctcgccgacgattcgacgcgcggccgcgtcgtcgcgatctatgcgaccaatttcacgctgttccagatggcggggcccgtgctcgtgagccagatcgccggtgcgacgagcatccgcttcgcgctctgcggcgcgctgttcctgctcgcgctgccgacgctcgcgacgatccggcgcgcgccgctcgccggcgacgacgcgcatcacgaagcccacggccgctggctcgacgtgctgccgcgcatgcccgcgctgatcatcggcaccggtttcttcgccctgttcgatacgctcgcgctatcgctgctgccgctctacgcgatggatcacggcgtcgcgagcgccacggccgtgctgctcgcgtcgatcatgctgttcggcgataccgcgatgcagttcccgatcggctggctcgcggacaagctcggccgcgaacgcgtgcacctcggtgcgggctggatcgtgctggccggcctgccgctgctgccgctcgtcatcgcgaacccgtggctgtgctggccgctgctgttcgtgctcggcgcggcggccggcagcatctacacgctgtcgctcgtcgcgtgcggcgaacgcttccgcggcgcggcgctcgtcaccgcgagttcgctcgtgtcggcgtcgtggagcgccgcgagcttcggcggcccgctggtcgccggcgcgttgatggagcaactgggcagcaacgcgctggtcggcgtgctggtcgtctgtgtcgccgcgttcgtcgcggccgcgctgtggagcgccgcgccgcgttgcagcgcgcggtctgatatcggcgctgtcgatgtcgatgtcgcaaacgcaaacattgacgctctcactcggcgccccacacggacgcacacgcgccgccccgggctgccaaacgaaaacggcccgcgcaatgcgggccgccctgtccttccagacgacttgttgcgtgtcgcgccgcgcccgtcacgcgctccgcgcgggcaggatcttgccggcacacgtgccgaagccgacgcgatagccgtcgccctggcaccatccggcgagcgtgagctcgtcgccgtcctcgatgaacgcgcggctgccgccgccgttcagcgcaaccggctccttgccgttccacgtcagttcgagcaggctgccgaacgaatccttcgtcggcccgctgatcgtgcccgaacccatcaggtcacccacgcgcgtgttgcagccggccaccgtgtgatgcgcgagctgctgcgccatcgtccagtacatgtgcctgaaattcgtgcggcagatcgacgtcgcctgcgccgccccttccgcgcgcagcgtcacttcgagcgcgatgtcgaacgcatgcttgcccgcgtgccgcagatacgcgagcggctgcggcgactgctcgggctgcgcgacgcggaacggttcgagcgcatcgagcgtgacgatccacggcgagatcgtcgtcgcgaaggtcttcgcgttgaacgggccgagcggcacgtattcccactgctggatgtcgcgcgcgctccagtcgttcagcagcaccatcccgaagatatgtgcttccgcgtcctcgcacgcgatcggctcgccgagcgcattgccgcggccgacgatgaagccggtctccagctcgatgtcgagcttgcggcacgcgccgaacaccggacgctcctggtcgggcagcttcagttgcccgttcgggcgccgcaccggcgtgccgctcacgaccaccgacgacgcacgtccgttatagccgatcggcatctccgaccagttcggcagcagcgcgttcttcggatcgcggaacatcgaaccgacgttggtcgcatgctccttcgacgaatagaaatcggtgtagccgggaatctcgaccggcagatgcagcgtcgcgtcgcgctgcgcgacgagcacctgcgcgcgcagcgccgcatcgtcacgcagccgcgggttgtcgcgcgagaacaggtccgacagctgcacgcgcacgctgcgccatgcgtcgcggccgagcgcgatgaacggattgagcgtcggcgcggcgaacacgtcggcgccggccggtagcgtcacgagccccgcgcgtgcgagcgcggcgagatcgacgacccggtcgccgagcgcgacgccggcgcggcgcgccgtctgcttcgcatcgctgaagatcccgaacggcaggttctggatcgggaaatcgcaggcgggatcgttcgccgtctcgacccagctcttgcgggccgggtcgagcgtcgcgcgccagtcttgggtatcgctcatctttgctccgggttgaagtgtttcctgatgccttgccaacattcgaagtagtcggcctgcagctgcgccgtgtcgagcgcgtagcgcgtcggccggatcagcgtgcgggtttcgaacatgaacgccatcgtcgcgtcgaccttgtgcggcttgctcgtatcgctcgcggacgccttctcgaacgtgtccgcgtcgggcccgtggcccgacatgcagttgtgcaggctcgcgccgcccggcacgaagccttcggccttcgcgtcgtacgcgccgtgcacgagccccatgaactcgctcgcgacgttgcggtggaaccagggcgggcggaacgtatcctcggccgcgagccagcgcggcgggaagatcacgaagtcgatcgtgtcgacgcccggcgtgtcgctctgcgactgcagcaccaggaagatcgacggatcgggatggtcgtagctgatcgagccgatcgtgttgaacaagcgcaggtcgtatttgtacggcgcgtagttgccgtgccatgcaacgacgtcgagcggcgaatggccgatgtccgcgcgccacagccggccgttcagcttcgcgatcagctcgaacgcgccttcgcggtcttcgtaagcggcgtgcggcgtcaggaagtcgcgcgggttcgcgagaccgttcgagccaatcgggccgagatccggcagacgcagcagcgcgccgaagttttcgcagatgtagccgcgcgcatcgccatccggcagcgcgacggagaaacgcacaccgcgcgggatcaccgcgatctcgaacggctcgacgtcgagccggccgaattccgtcgcgatgaacaggcgcccctgctgcggcacgatcagcagttcgccgtccgcgctgtagaaaaagcggtcctgcatcgagcggttcgccgcgtacaggtggatcgcgcaaccgttcatcgcggcggccgacccgttgccggccatcgtcaccagcccttcgacgaaatcggtcggctcgaccggcatcggcagcgggtcccagcgcagctggttcggcggcgtcggcggcacgtcggccgagtcgccgaattccgacacgagccgctgcgggcccgcgtacggctcgaacggccgatgcacggccgccgggcggatgcggtacagccacgagcggcggttgtggccacgcggcgcggtaaacgcggtgcccgacagttgctccgcatacagcccgtacggcgcgcgctgcggcgagttgcggccgtgcggcagcgcgccgggcagtgcctcggtcgcgaattcgttcgcgaaaccgctcaggtagccggcgtttgccggtttcgacaggtcaagcgtcatcgtttcctttctccctcaattcgtggcggcggtcggcgcctgcacgccgttgcgccgcgttacgcccgcaagcccgaggacgaacagcgccgagcacagcacgggcaccgcggccgcgtggaacagcgcgccgttcgaccagttgagcgcaatcagttgcccgccgacgagcggcccgagcaccgagccgatccggccgatgccgaggctccagccgatgcccgtcgagcgcagcgacgtcgggtaatactggcccgcgagcgcgttcacggccggctgcccgccgaccacgcagaacccgcccgcgaacacgaccgccagcagccacggcagcgcatgcgcgaccgagccgatcagcccgaccgacaccgcggcacatgcaaagcaggcgaacagcacgcgcacgaagccgtagcgttcgatgaaccagccgagcgacagcgtgccgatcacgccgcccgtctgcagcaccgtgccgacgatcacggccgtacccggcgaataaccggcatcgcgcatcaccgtcggcagccagttcgacaggaaatacaggtcgatcaggttcatgaagctgatcgcccacagcagcagcgtgaccggcaggcggccatggctgaacagctcggcgaccggcgcgccggtcgcggcccgctcgcgcacgacgagccgcatgttcgcatcgatgccggcctgcggcgcgaaacccgcgagccagtcgcgcgcctgcgcgacgcgccctttcagcaccaggaactgcagcgactcgggcagccgcgcgaccatcgcgatcgtgagcacgagcggcaccgcgccgccgacgaagaacaccgagcgccagccgagcgccggaatcagcgcggcgctgatgaagccgccgagcgccgcgccgagcgtgaagccgcacgacacgatcatcatccgcttcacgcgatgcgcggccgggctgaactcgccgaccagcgccatcgcgttcggcatgatgcaaccgaggccgaggcccgtgacgaaacgcagcgccatcagcaccgggatcgaacccgcgaacggcgtcgcgagcatcgtcaccgcgaagaacagcgtcgagccgatcagcaccgggcgccgcccgatccggtcggccagcaccgacagcccgagcgcgccgagcagcatcccgaacaggcttgcgctgaacaccggcccgagcgcctgtttcggcacgccccattcggcaatcacgctcggggcgacgtagcccatcgcctgcgcatcgaacccgtcgatcacgaggcacagcccgcacagcacgagcagcatccagtgaaagcccgggcgatgggtctcgtcgatcacgtgctcgacttcgagcacgcgtgcgtcggccggcgccgcgctcattgcgcgacctcggcggccggatgcacgggcggcgtcacgccctggcgcgcgagcgccatcgcttcgcgcagcacgtcggcgtcgccgatctggttcgcgagcagcaggatcagcttcgcgttgacgagctggctgtcggcgtcggacaggtcgcgatgcatgtcgatcagcgcttcgtagaacgcgtccgggtcggccaggcgcgggcgggtgtcgagtgagggcatgacggagtctccggtgtctttatcgtattcagcgtgcgcaggtcgcacgcgccagtgcgtcggcaagcgcctgacgctcgagcgtgcgcatgcgggcgcagacatgctggtcggggcgcagcaggtagaacgtgcctggcttcgcgtcgtagcgttgcgcggcgaaaccgtcgacgtcctccacgacgtcgacacccgcgaccggctgcgcgtgcccggccggcacgacgagcacgggccgcaccggcagcgcgaggccgtcgagcgcctgcgcgagcgcgcccgcatcgcccggcagcccgaacagcacgccggtgaagccgctgcccagatgctgcagcagccagcccgacgcgccctgcgcacgcaccggcgcatcggctgccgccgcgcccgggcgcatcgcgcccgcgaatgcgtcgccattgcggtccggcgtgttcagcggcgaatcggccagcaccgccggcaccgacaggcggccgctgttcacgagcttgcgcgcgaactcgcagtcgcgcgcgagcgtcagcgtcgcgtcgcggaatacgcgcgacaccgggcttttcggcgtggtgaagtccgtcgagcgcgtcgagttgcggatgttctcgtcggccgcgaactcgcgctcgctcgcatacgtatcgagcaggctgtcggccgaacggccgtcgagcacgagtttcagcttccaggcgaggttgtcggcgtcctgcacgccgctgttcgcgccgcgcgcgccgaacggcgacacgccgtgcgcggagtcgcccgcgaacagcacgcggccgtggcggaacgtatccatccgctggcagcggaacgtatagacgctcacccattcgagctcgaactcgacgtccggcccgagcagcgcgcgcacgcgcgggatcacgcgctccggctgcttctcggcgaccggatcggcatcccagccgagctggaagtcgatgcgccacacgttgtcgggctggcgatgcagcagcaccgactgattggggtggaacggcgggtcgaaccagaaccagcgctcggtcggaaactccgccttcatcttcacgtcggcgatcaggaagcggtccttgaacgtgcggccgcggctttcgaggcccatcatcgtgcgcatcgggctgcgcgagccgtcggccgcgatcacgtactgcgcgcgcagcgtcgcggtgccttccggcgtctcgatcgtcagcaccgcgtgttcggccgcctgctcgatgcccgtcaccttgtgcttccagcggatatcgatgttcggcagctcgaacgcgcgatcggccagataaccttcgacgtagtactgttgcagattgatgaacgcggggcgcgcatgcccttcctcgggcagcaggtcgaatgcgtacagttgctcgtcctgcaggaataccttgccgacgtgccagctgacgcccttgtcgacgaagcgctcgccgcagccgagccggtcgaagatctcgagcgtgcgcttcgcgaagcagatcgcgcgcgagccggtggagagcgtgtcgtcgtcgtcgagcagcacgacgggcacgccctgctgcgcgaggtcgatcgccgccgcgagacccaccgggcccgcgccgacgacgatcaccgggtgaacggtcgcgtcctgcgcacgcggacggtattcgaacttcagcgtctggtaatcgatgctcatggtcgccgtccgccctcaaccctgccgggcgggcgccggctcgcccgtcatcccgcccgtcgcctgccggcgcgccgcgccgccgtcccgcgtgccattcctgtcaaccgccacgtctcgctccttgcttcctgttgattcgcgaacggcgccgtttcgcggcgcccgcctgccgcatttcttgatcggcgacaaattctggatttacgaatagtaaaaccaattacgaatagtaaaatcaacgtaaaccctaggcgaaggctcggagacgggataaccatataagtgaaacgccgagccgaccttggccggcactgctaatatcaagctacgaggcggcccgttcggccgccgtttttccttcttacgccgatgattccgcccaccattcccgagctggtcgcccgtgccgggcaactgccgtacctgcgggatcacctcgcgctcgccgatggcggcaccgcaagcgcgaacctgcccgagcgcacgctcggcagcgcctacgaaccgatctacgacgtgacgatgccgggcgcaccacaatcgacgtcgttcgccgacgccatcgagcgctatggcgacgagctcggcttccaggccgtgacggtcgtcacgggcgcgccgcacgatccggtcgactcggccgtcgacgaccagacgctcgtggcgatcgaccgcctgtcgcgcgcgctgcacgcgatcaatttcttcggcgcccagcgccacgggctgttgttcctgcgcgtgcacgaacgcctgctgaagagcgtgaagtacgaccacggcaagcatttctcgtcggtgctgcagcgcttcgggctgccggccgagcggatcgtgatcgagctgccggcggtcgcggtcgcgcacaagaccttcctcggctacctgacacgcagctatcagcatcacggcttcaaggtggcggacaagctgcccgacccgggccgcatcctcgcggtcgaatcggacatggcgcgccccgactacatcaagatggatgcgggcatcgcgttgcgcgacggatggtcaaggcgctcgtcgcgtatgcgcagcgcgtgcggattccgctgatcttcgacggcgtcgtcgacgaaacgcagtgcgagctgctgcgccagcacgacgtgcggttcatgcaggggccggtgttcgcgaaggtcgtgacagcctgaacggatgaggtagccggcgcacgcggggagcggcgcgccggatgcgcggcggggtgtggcgccgcttgaagcaggatgaagcgatcgggtggccgggcgcgacccgcggctcgacgcctgcccgtcagggcagacggttaccgcctacgcgcttccgccatcgtcgtacttgggcagatcgtcgtcgatctcgatgcccgggaaacgatccgcataccagacgtgccaggccggccgtagccgcgacggctcatcgagcgtggcgtaattgatctcgaccgttttcggcgcgtcgatcagccggtattcgagctgcgcgccgcaacggccgcagaagcgccgctcgccccacgcgctcgacgcgtagacggtcggttcgccctgcaggtattcgaacgcgtcgatcggcaccgatgccgatgcgacgaccgccgcaccggtcgtgcgctggcagagccggcagtggcagaagccggcgtcggtcgggacctgggcgatacggtagcggatcgcgccgcacgcgcatccgccttccatggattccgggtgagacatcgcagacctcgtcgtcgggaagctggcaaacgatgatgagcgcggttcgagcgcggcacaagagacggcggcagccgcagcccgccgtcaccatcccctcacctttaccggcaacgacacggttgcggtgcgagggcaacgcgcgccgcatttctcaggccgtctgcccgagccgctgcgcgagcgccttcagcttcggcccgacctgcgtgcgaaacacctcctcgtccatcgacgatgcggggccgttgcagctcaggatcagccagcgcccctcgcgcggctcgcgaaacggcacggccgccgcgttgacgtccatgtgccacgcccggaacgaataacagcaaccgcccgccgagaactcggccaccgcgtgctgcgcggcggcgacgagcgcatcggcgtcggccgcgccgccggccgcgcggtgcagctccgcatagagcgcgcggcgcacgtcctccggctgcacggccaggtacgcgcgccccatcgagctcgtcagcatcgacagccgcgaaccgggtgcgagcccgagcgtcagcgcggtctcgctgcggatcgtctccagatagatcatgtcgagcccgtcgcggcagccgagcgacacggccgcgccgatgtcgcgcgcgagcgcctgcatgtgcggccgcgcgaggtcgagcgtccccgagccggacagcagcgcgtagccgagcgacagcacgccggcgtcgagcgcatactttccgagcgtctcgtcgtagcgcaggtagccgagcacggtcagcgtataggcgagccggttcacggtcgccttcggcagcccggtgcgctccgcgaagtcgcggttgccgagcatcgtctcgccgggccggaatgcgcgcagcaggtcgagcccgcgcgcgagcgcgacgacgaacttgcgctcgtcaatcgtggtttcgtcgatggttgaaagtgtcatctggtgctacactgggttcgatttgcaaaacattgttccgcacagcggaacatcagtcaagcgaacttttggcatggggcccggctagaagaccggaccgaccgctaagcatggggccagagtaagcgctgaagcgccaactctgcccgacaggagatgagacgatgagtgctgcaacttttcattgggacgatccgctgctgctcgaccagcaactgaccgaagaagagcggatggtgcgcgacgcggcgcaggcgtatgcgcaggacaagctcgccccgcgcgtcaccgaagcgttccgccacgagcgcaccgacgccgaaatcttccgcgagatgggcgaagtcggcctgctcggcccgacgattcccgaggaatacggcggccccggcctcaattacgtgagctacggactgatcgcgcgcgaagtcgaacgcgtcgattcgggctaccggtcgatgatgtccgtccagtcgtcgctcgtgatggtgccgatttacgaattcggctccgacgcacagaagcagaaatacctgccgaaactcgcgaccggtgaatggatcggctgcttcgggctgaccgagccgaaccatggctcagacccgggcagcatggtcacccgcgcgaagaaggtgcccggcggctattcgctgtccggcgcgaagatgtggatcacgaactcgccgatcgccgacgtgttcgtcgtgtgggcgaagctcgaggagaacggcaaggacgcgatccgcggcttcatcctcgagaagggctggaagggcctgtcggcgcccgcgatccacggcaaggtcgggctgcgcgcatcgatcaccggcgagatcgtcctcgacgaggtgttcgtaccggaagagaacctgatgccgaacgtgagcggcctgcgcggcccgttcacgtgcctgaactcggcccgctacgggatcgcgtggggcgcgctgggcgccgccgaatcgtgctggcacaccgcacgccagtacgtgctcgaccgccagcagttcggccggccgctcgccgcgaaccagttgatccagaagaagctcgcggacatgcagaccgaaatcacgctcggcctgcaaggcgtgctgcgcctcggccggatgaaggacgaaggcacggcggccgttgaaatcacgtcgatcatgaagcgcaactcgtgcggcaaggcgctcgacatcgcccggctcgcgcgcgacatgctcggcggcaacggcatctccgacgaattcggcgtcgcgcgccacctcgtgaacctcgaagtggtcaacacgtacgaaggcacgcacgacatccacgcgctgatcctcggccgcgcgcagacgggcatccaggcgttcttctgaccggccggatgcggcgcgcccggcagccacgccgcgccgcgcacgcataaagacacggcccgcccggcatcactgccgggcgggccgtttttcatcgggtccgcgctccgggccggcggcccggtatcgcgctcacgtgccgccgatgcttacttgttcggctgcggcgtgaggcgcagatacggacgcactgcgttgaagcccttcgggaagcgcttcttcagctcttccggatcctgcagcgacggcacgatcacgacgtcgtcgccatccttccagttgccgggcgtcgcgaccttgtagttgtcggtcagttgcagcgaatcgatcacgcgcagcacttcgtcgaagttgcgccccgtgctggccggatacgtgatgatgagccgcaccttcttgttcgggtcgatcacgaacagcgaacgcaccgtcagcgtttcgttcgcgttcgggtggatcatgtcgtacagttgcgaaaccttgcggtccgcatcggcgatgatcgggaagccgacgaccgtcgactgcgtttcgttgatgtcgttgatccagcccttgtgcgattcgacaccgtcgaccgacagcgcgatcaccttcacgttgcgcttctcgaattcgcccttcagcttcgaggtcagcccgagttcggtcgtgcataccggcgtgtagtcggccggatgggagaacaggacaccccagccgtcacccagccactcgtgaaacttgatcgggcccaggctcgattcctgctcgaaatccggtgcgatgtcgccaagacgcagactcatgatgttccctcctcgaacgatgctggttgaaaccgcgcccgggtcggcgcgggaaagtgtgtcagcttacgggaagcaatggggcatgcgaacgattattccgtttgatattcatactttttgtcatttttgcccggtgtcggtgcagcgcgggcagccctgcgggaaacttttcaccccgtttgccgctctgttgatcattacaagtcgtttaccatgcggtcttgcgctgccgtcgtgtgtcttcccggctcgccagcaggcaggcgtttcgctacgatgtgaacctgcagcatgacagcatgaagggagttgcaatgtcggaaatcaacaaggagaaactgatgtcggatatcaaaaccgttctctcggacgccgaagacctgctcaagcaagctgcgagcagcacgggcgaccgtgcggccgagctgcgcgagaaagccatgtcgcgcctgaagcaggccaaggaaaggcagccgacgtccaggtcgtcgtggtcgagaaaggcaagaaggccgcacgcgcgaccgacgattacgtgcacgagcatccgtggacgtcgatcggcgtcgccgccggcgtcggcgtgctgatcggcctgctgatcaaccgcaagtaacgcgccctgcgtcgttccgtcccgcgggccgcttcacgcggcctgcgggcgtcgaagccagccggcggtttccgccggccggctttgtcctagctgcacactgcacgcgcacgcacctcacccatgacgacagacaccacctcgcagccgtccggccaggaccgctgcgccgcctcgtcggctccgcgatcgggcttttgcaaacgcgcctcgaactggtgggcatcgagcttgccgaggagaaggagcgcctgatgggcgtgctgttcctcgggctcgccgcgatgatgctcgcgacgatggcactcatcagcctgaccgtactcgtcgcgatcgcgttctgggatacctaccgctggcagtcgctcgcggcgatcaccgcgctctatgccgcaggcgggatcacgtgcgcactgaaagcccgttcgggcctgcgcgacgcgccgaccgtattcgaggcgacgctcgccgaactcgagaaagaccgcgaactgttccgcggcaagccgtgaacgcagtcgcgctcacccctcccacctacttcgccgacgcgccatgagccagaacgtcacgggcaattcccccgctcccattcgtcgcgatcgaactggagcgcgtcgcagcatcgcgcgctccgcaaggaactgctgatcctgcgatccgaagtcgagcggctcgaactcgcggaagccgccggcgaaatgcgccaggccgtcacgcgcttcagctggctcaaggtgttcatccccggcctgtccagcaacaagttcagccagtccgccaagaacctgaacgcgagcctcggccagctcgtcaaccagtatccgatgctgagttcgctcgcatcgctcgtgctcgccaaacccgttcgctcgctgctgcgcgagcgcggggcccgcgctgaagtggggcaccctcggtttcgctgcatgggaggtctaccggatctggaaggcgtcccgcgacgagcgcgggctcgacgcgcacgacgactgatcgtcgccatcctgcgcgcccggccatccgccgtggcgcgcctttcattcgaactcaacgcacaccccagcacgcggcgacctgttcgtcgacggcatcacttcggacattgcccttcgtgccgtccgagcgcagcgtgaatgcgccgcatgcatcgccgtgcatcgggccggtgtcgagcggaatggcttccagctcatagctcacgggcgaatcgtcgccgtccggccgccggagcgccagacgatagaccgcgcgcccgtccggcggcgcttgcgcgagcgccgcgggcaatgccgaaggcggccccctccagtgtttcgagatattgggccgcccggtacagcgcggcgactgccgatgcgcgatgagcgcgcgccacatgctcgcgatacgacgggatgccccatccggccagcaccgcgacgatcgcgagcacgatcatcagctcgatcagcgtgaatcccgccgagcgtcgcacggataggcgaccgctcatcgaagcaccgtcgcgacgtgacgccagcgcaaggcgacgatgtatccgtcgcggatcgcgacctgatgctgcagccagacggcgctcgatgcatgcgcaccgacaccgcgcgcggtgaccacgtacgcacgggcatcggccggcccggccccgcgccacgcttcgatcaggcatcgcggcggttgcacgaccgccggccatcctgcgaacggctcgaacgcttcggccgccgccagcgccggcgtgcgccgccacgcgtcgggctccgcgtgcgactcgccttcgcttacgtagggcgccgagccccggcgcaatcgcgcggtgcacgcggcaagcgcggcatcggccgcgtgaaatgcgaccagccgatcggacaacgcgcgcgtgcggcgcgattccgtcagtgcagcttcgaaccacgtgcctgtcagcgccgcaaccgccgcgccgaccgcgatcaccgcaggcaatgcaaggcccgcttcgcgacgccgatcgcagatggttgaccgcaagcgcatgtgcaacactcgccgtctcgacgccagggcctccgcacccgcagcccgccgcgggtcttcgccacttgtcgcgacacgctcgtgcgggttgcctgccgcgacgcatgccgaccgctgcggcacgtgccgccccgctccgttcatcgcagcacctcgcggtcatccgttgcatcgcgcggcgtatcgtcgaacgcgcccgcgacattcctcaatgcgacgatgcgatcgagcgtcatgcgcgcgcggccgtcttgtgcaacgacggtgcggccatcgcagtcgacgtgccgcgccggctcgcccgacggttcaccgcgcgcccgcacgcagacatgcacggccacgacctcgtgccagtcgtcgacgcgcatggcatcggcatcgacgaactgcgtgccgccgcgacgaagatagcgcacccgcaactgatcgattcccgacacgaccggctgtggcgtgcccggacggccgtttccttcgcaatacagttcgggctcgcccgtcgacggactaacgtgcacatcgaagcggttctccaccggcgcacgttcgccggccccgccgataccctgcccgaggcaatccggcacctggccgctaacggtgggccacgtcgacacggcgtcgccgacataccggatcagcagcgcatccgatgcagcgcgcacgggctcgcaccgtacttgcgcgccacttccctcacacgcgccatcgaacagccgaacaccggcggcaacgacgacacgcccctgcatcgagcggccggaatcctgccatctggatctgctggccgatcagcatcagtgcggtgccggccgcatcgcgcatccggaacccgtcgtccgcacgccgctgggcgatgcgctgcgcgtggagcagcgcaacggccgccgcgagcacgagcagaccgaccgtcatcgcaatcaatacttcaagcagcgtatgcgcacgcatgcggcgatcagcgttcatcggcgtcagtctcccgatacggaatccggacgcaagaaggcggctgcgccggcctgcccgtcgcatcgcatcgcggcccggtagccgaatgaccgccgcgccagccgacaaccgcgtagctggcgccacccggcccatcgccacgcatcatcgcgccgccgggcagcgacgctgcggcccgcgccgcgaggccgtcgtcagcctgcgcggctacgtgcaagcgctcgatacgcgcatcagccagccacagcgcgcgctcacgccagatcgtcgcgcgctgcgcacgcgccatcgcaagctggctgcccgccacggccagcattacggccgcgaggagcgcgacggccagcatcgcttcgagcaacgacgtgccgcgcattgcgttgcgcatcatgacactcacgccgcctcgcagcggccggcgacaacccgcgcccggccgcctgccgcaatccgcacgcaacgcgacgcacgtgtggcgtcagcctccgatatgtcgcgccgtggactcaattcgaaccgccggataccaccgattgcctgaccgaccggcggcgcaaacgcgagatcgtgcgccgcacccgcgacagccacttcggcatcgcgcggatagcgcctcagcacgcgtgactgcccgtcgacctgcccgctgacgatccagtcgcacgaccattcggccggatcgcaccgttcacccacacgcaaacaggtgccgccgctcccggccctgcacagcgtgacgcgcacgccgaggcgcatcgcctcggtacgcgcaaacgacagcgcgccgagcagcgcgcgcgagcgtgcatccacacgttcacgcatgcgccactgatcgaacgcgggcgccgcatggagcgcgagcccggccgccagcgagagcgcgaccatcagctcgacgagcgtgaacccgcccgagcggcgcaacacatttttcaggggtaaagcgtgcagtcccatcgcagccgtccttcgccaaggtgatgcgacgactgtagcgacgcgtgcggacgcgcgccatttgccgaacggccgactggcggcatgcgatcgcggccgacacaatcggcgcgaactgatccaacggagaagacgatgaacggacgcagcgcgtcagcgcttacgcggagtcttggcgggagaggcgcgacggaactcttcgatcacgtcggcaaattcggaaacgtcctcgaaccggcgatacaccgatgcgaagcggacataagcgatcgtatcgaggccgcgcaactcgttcatcacgagttcgccgagcttctcgctacgcacttcgcgctcgcctgtcgcgagcagttgatactcgatgcgggcgaccgccgcgtcgatcgcgtcggcagcaaccggccgcttgcgcagcgcgagttgcatgctggcgacgatcttgcgacggtcgaattccgtgcggctgccgtccttcttcacgacgaacggcagggacaactcgacccgctcgtacgtcgtgaagcgcttgtcgcaagccgagcagcgacggcgccgccggatcgcggcgccatcttcggacacgcgcgagtccacgacctgcgtgtcgtcatgccggcagaacgggcagcgcatcgtcgatcagcgatagaccgggaaacgcttggtcagctcggcgacctgcgcgcgcacgcgctcgatcgtcgctgcatcttccgggttttccagcacgtcagcgatcaggttgcccacctgttccgcttccgccggaccgaacccgcgcgtcgtcatcgccggcgagcccaggcgcacgccgctcgtcacgaacggcttttccggatcgttcgggatcgcgttcttgttgaccgtgatgtgcgcggcgccgagcgcggcttccgctgccttgcccgtgatgttcttcgcgcgcaggtcgaccagcatcacgtggctttccgtgcggcccgacacgatgcgaaggccgcgcttcaccagcgtttcagccagcacgcgtgcgttctcgaccaccttctcctggtacgccttgaattccggcgacagggcttccttgaacgccaccgccttgcccgcgatcacgtgcatcagcgggccgccctggatccccgggaagatcgccgaattgatcggcttctcgtactccgccttcatcaggatcacgccgccgcgcgggccgcgcaggctcttgtgcgtcgtcgtcgtcacgaagtccgcgtgcggcaccgggttcgggtacacgcctgccgcgatcaggccggcgtagtgcgccatgtcgaccatcaggtacgcaccgaccgacttcgcgatcttcgccagacgctcgaaatcgatcttcagcgagaatgccgacgcgcccgcgacgatcagcttcggcttgtgttcctgcgcaagcttctcggccgcttcgtagtcgatgtcttcgttctcgttcaggccgtagctcaccacgttgaaccacttgcccgacatgttcaccggcgaaccgtgcgtcaggtggccgccgtgcgcgaggctcatgcccatgatcgtgtcgcccggcttgagcatcgcgaagaacacgccctggttcgcctgcgaacccgagttcggctgcacgttcgccgcttccgcgccgaacagctgcttcacgcgatcgatcgccagctgctcgaccacgtccacgtattcgcagccgccgtagtagcgcttgcccggatagccttccgcgtacttgttcgtgagctgcgaaccctgcgcggccatcaccgccgggctcgtgtagttttccgacgcgatcagctcgatgtgatcttcctggcggcggttttcctgctcgatcgcagcaaagatttcgggatcgacgttcgcgatggtgctttgggctctgtcaaacatacggtttccgttaagtgtgtacaggttgaccgaagtggccgagtacggtgcgctgctggcgggaccagctcgacgtggcggaggaatccgtatgacgcgaggcaggacagccaccggcgatgcacgcgacggcgcacaacggctgcccaggcgaacggcaaaaacggcgccccgcgcttcacggtgggatgctccaccttgaacccgaagggttctatcgccagtcacgcaggggtgatgagcgcgttagtgtattggatgcgtcatgaataggcaaccgcacggcggtgcgcccggagcaattggggccagactctacgcgcccgtgccggaacgctttgccgccttgccgcggtgcggcattctcagtaggcttgcgggatatcacccgctattttgtcttcgaccaggagcagcaatgatcgtgttcgtcacaggcgcgtccgccggcttcggcgccgccatcgcccgtgcctttgtcaacggaggccaccgcgtcgtcgcgaccgcgcgtcgcaaggatcgtctcgatgcgctcgccgccgaactcggcgattcccttctgccgctcgagctcgacgtacgcgatcgcgcggccgtcgaggccgtaccggccgcccttcccgccgaattcgcggcgatcgacgtgctcgtcaacaacgccggcctcgcgctcggcgtcgagccggcccaaaaggccagcctcgacgaatggcacacgatgatcgacacgaactgcacgggcctcgtcacggtcacgcacgcgctgctgcccggcatgatcgagcgcggccgcggccatatcttcaatcttggctcggtcgcgggttcgtacccttatgccggcggaaacgtctacggggcgaccaaggctttcgtcagacaattcagcctgaacctgcgcgccgacctgctcggcacgccgttgcgcgtcaccgacgtcgagcccggcctgtgcggcggcaccgaattctcgaacgttcgttatcgcggcgacaacgaaaaagcggcgaacgtctacaacaacgtccagccgctcatgcccgaggacattgccgacacgatctactggatcgcgacgcgcccggcgcatgtcaacgtcaacacgatcgagctgatgccgatcgcgcaagcacccggcggcccgaccgtccaccgcggctgaagccccgcgggccggccctccgggccggcccgcagtgtgctgccgcatactacattccgttacgaatcggttacgaatcaggctcctgccttccggtagaatgcgcgccatgacccagcctacccgctcccggaagcgccctccggcttcatctggccggtgcgcgtgtactacgaggataccgacgcaggcggcatcgtcttctatgccaactacctgaagttcttcgaacgcgcccgcaccgagtggctgcgcgcatgcggcatcgaccagcatcggctcgccgacgagaccggtgcgatcttcgtcgtccgcagcacgtcgctcgactaccgcgcaccggcgcgactcgacgacaccctcgcgatcacgagccggcccggacgcatcggccgcgcatcggtggagttcacgcaggaagcctggtgtggagacacgctgctcgtggccgggcacatccgcctcggttgcgtcgaccgtaccggcatccggcccgcggcgatcccgccggccgtgctcgacgcgctggaacgcgggcccgtcatcgacgacggacagactgcactgtcaacgaagctcgcatgagcgccgtttagacaccgcctatgaacttgcctttctgattcgatactaagcaaggttcggcgccaggcatggccggcgcgccgcgccgcacgcataccgggcgccccgaagggacgttactcaaacctctatgaacacttctcaagacctgtcgatcatttccctcgtcctcaatgcgagcgtgctggcccaggccgtgatggggctgctgctgctgctgtcgctgatgtcgtggaccttcatcttccgcaagtggttcgcgatccgccgcgcacgcgcgcagaccgaacgcttcgagaaggacttctggtcgggcggcgacctgcaggcgctgtaccagagcgcagccaacaaccgccacacgatcggcgcgctcgagcggatcttcgaatcgggcatgcgcgagttcctgaaggcgaaggaaaagcgcatcagcgatccgggcctcgtgctcgacggcgcacgccgcgcgatgcgcgcgtcgttccagcgtgaaatggacgtgctcgaagcgaacctcgcgttcctcgcgtcggtcggctcggtcagcccgtacatcggcctgttcggcacggtctggggatcatgaattcgttccgcggcctcgcgaacgtgcagcaggccacgctcgcgaacgtcgcgccaggcatcgccgaggcgctcgtcgccaccgcgatcggcctgttcgccgcgattccggcagtggtcgcgtacaaccgctacgcgcacgatatcgaccgcctcgcgatccgcttcgagaccttcatcgaagagttctcgaacatcctgcagcgtcaggcccagtaaggagcgcgccatggcaggaagccccatccgatccagcatgcgcggcggccgctcgcgccgtgcaatggccgacatcaacgtcgtgccgtacatcgacgtgatgctggtgctgctcgtgatcttcatggtcaccgcaccgctcgtcgccccgtcgatcatcaacctgccgaccgtcggcaacgccgcgccgcaggagcagacaccgcccgtcgtcgtcaacatcaaggccgatcgcacgatgagcgtcaagtacaagggcgactcgggcgcgacccaggaagacacgatgacgaaggccgagctcgacagcttcatcgtggcccggcaggccgatcatcccgaccagccggtcgtgatcgcggccgacaagaccgtgcagtacgatgcagtcatgaccgtgatgtccgatctgaaggcgcgcggcgtcaagcgcgtcggcctcctcgtcaaatcgcaatgaaccggcagcaatccacgcgcagctccgcctacccgcctcagcctccccgcgagcgcggtacctggcgcgcattcgcgctcgccgcgctgatgcacgtgctgctcgcgctgttcctctatcacggcgtgcagtggcagaacagcacgccggccggcgccgaagccgagctatggaccgaggtgcccgacgtgcccgcgccgcggcccgtcgtcacgcccacgccgcccgtgaaggtcgcgccgcccgctccccgtgcgcgacgagcaggccgacatcgcgctgcagcagaagaagcggcagcaggaagcggccgcgcgtgaagcgctgctcgagcagcagcgccgcgcacagcagttgaaggcgcaacaggaagaggaagcccggcgtgccgcgcagcaggcagccgcactcgccgcgcaaaaggccgcggaacgcgaccggcagaaacaggccgacaagctcaagcaacagcagcttgccgaacagcagaagcttgagcagcagaagctcgaacagcagaaactccagcagcagaagcaggcgcagctcgaagcgcagcaggcggcgaaggcgaaggccgacgcggccgcgaaggcaaaggcggaagcccaggccaaggcgaaggccgaagccacggcacgcgcgaaggccaatgcggcggcgaacgcgaagctcgaccgcgagcgcagcgcgcgcctcgcgcagatgcagggcctgtccggcgccggtgaaggcggcggcgaaggcctcgcgaaagcggcaccggcacgggctccggcggcaatgccgcgacgcccggctatgccgacaaggtgcgccgccgcgtcaagccgaacatcgtttggggcggcgagcgggcaggcctgaccaccgtcgtcaagattcggtgcacgccgtccggtgacgtattgagcgcatcggtctcccgctccagcgggaattcggggtgggatcaagccgtggtcaatgcgatccacgcatcggtcccgttgccgcccgattctaacggtcgtaccccgtcggacattacgattaccttcaaggcggcggagtgaaacgaaatgcgcttacactccgggcgtcgctgtcggacgggaacgaatcgggtatttttactgtctctgccgttgcgcagcgatccaagccatacgggaagcaagaagcatgagtttgatgacaaagctaggtttcagggcactcgtggcctcgtgtctgattacggcgggcagcgccgctaacgcccaggtcaacgtgctgatcaccggtgtcgggtcgacccagttccctatcgccaccgcgaatttcgcgaacgaggcaaacctgccgcagcaggtcacgtcgatcgtccgcgccgacctcgcccgcagcggcaaattcaccaacatcgacgcaggcagcacgcccgtgccggagaccgcatcggtcgatctcggcgcatggaaggcgaagggcgccaatgcgttcgtcgccggcagcgtgaaccgcgaagcgaacggccagtacaaggtcaacttcatcctatacgacaccgtgaagcagcaaagcctcggcggcctgtcgctgacggccaccgacaccacgctgcgcacggccggccacaagatcgccgactacatctaccagaagctgctcggcgtgcgcggcgtgttcgccacgcgcctgtcgtacgtgatcaagaccggtaaccgctaccagttgcagatctcggattcggacggccagaacgcgcgcatcgcgctgtcgagcaccgagccgatcatctcgccgtcgtggtcgccgagcggcacgaaggtcgcgtacgtgtcgttcgagcgcaagaagccgatcgtctacatccacgacctgccgaccggccgccgctacatcgtctccgaccagaagggcaacaacagcgcaccggcatggtcgccggacagcaacacgctggccgtcgcgctgtcgctgacgggcaatacgcaaatctattcggtcaattcgacgggcggcggcctgcgccgcctcacgcagagcagctcgatcgacaccgagccgttctactcgccggacggccgctggatctacttcacgagcgatcgcggcggtgcgccgcagatctaccggatgcccgcacagggcgaaagcgccggcgccgcgcagcgcgtgaccttcaccggcagctacaacacgagtccgcgtatcagcccggacggcaagctgctcgcttacatctcccgcacgggcgggggcttcaagctgtacgttcaggatctgcaatcgggcgcggcgaacgccatcacgaatacgaatcgcgacgaatcgccgagcttcgcggcaaacggccagtaccttctgtacgctacccagtcgggtggtcgcaatgttctggcagcagtgccctccgacggcagcgcgccgccgcaaatcctgtccgtccagggcggctccgtacgtgagccgtcgtggggcccttcatgcaatgaccacaaggagagtaaccatgatgtcgaataaagctcgtctggccctggccgtgatgatgatcagcgcgctcgcagcgtgcaagtcgggcgtgaagctcgacgacaaggccaacaacgcgggtgcggtcagcacgcagccgagcgccgacaacgtcgcgcaagtgaacgtcgatccgctgaacgacccgaacagcccgctcgcgaagcgcagcatctacttcgacttcgacagctattcggtgaaggacgactaccagtcgctgatgcagcagcacgcccagtacctgaagagccacccgcagcgccacgtgctgatccagggcaacaccgacgaacgcggcacgagcgagtacaacctcgcgctgggccagaagcgtgcggaagccgtccgtcgtgcgatggcactgctcggcgtgaacgattcgcagatggaagccgtgagcctcggcaaggaaaagccgcaggcaacgggtcacgacgaagcatcgtgggcgcagaaccgtcgcgccgacctcgtctaccaacagtaagtaacggaagaatcgccgtatgacgcaccgtgtatccctgctgcgcgttgccgcagcattctgcgtcgctggcgcggcgtggtcggtcgcgccggcgcacgccggcgtgttcgacgacaacgaagcgcgccgcgccgtgctcgatctgcgcaccaagaccgacaacctggccagccagttgtcggccgcccagcgtacgatcctcgatcaatccggccgtctcgaccagctgaaccagcaggtcgcgacgctgcgcggcgagaacgaggatctgacgaaccggctgacgacgctcgaacggcagcagaaggagtactaccaggatctcgacacgcggctcaagaagttcgagccgcagcaggcgacgatcgatggtgtcgaaggcaccgtgcagccgggtgaaacggatgcgctcaatgcggcgcaacagcagttccgcaacggcaacttcaaggcggccgcggcttcgttccgcgcgttcatcgcgaagtatccgcagagcccctaccagccgaccgcgcagtactggtacggcaatgcgcaatacgcactgcgcgactaccgcggttcgactgcgacgtggcaagggatcgtcagcaagttcccgcagcatccgcgcgcggccgatgccctcgtggcgatcggcacgaaccagctcgagcaaggccagaaggcggccgcgaagaagacgttcgagcaggtcgtttcgcagtacgccgggtcgaatgctgcacagacagcgcaaggcaagcttgaaacgatcaaataattatcgcggcgggttgttgacagcccgacactccgtcgctataatcttttgctctttgggtcgttgcccaagttgttcaagcaacgaaccgacaggtttcaagaacgtggggtggtaactcagttggttagagtatctgacttttaatcagagagtcgagggttcgagtccctcccaccctaccaactatctttgatagtgcaaataaagcctcccaagcggaggctttttgcgtctgtcgcatccgtgtcgatagcaggcatctccgcgatgcctgccgcactactcggcgccctccccggcttcggcagaagcgactttcccttcaagccggcgcaaagaaacgccatcgtgaacgcgatcgagatgatcggctcgagccacatgttcgtgaacgtgtcgactgttgcgctggcttgcggcctggccgggtcgtagcgcaccggcaccgtgtcaccgaacgccatcgtcacgaagcttcccggaaacgatacgcgttcgccgcttttcgtcacgaactcgatcaacgggtgacgcgcgccgtgcgtcaaccggacgaccgtcccctgcacggcaacggacgatccgataaccgcgagccccgttcgtcgaacgtttccgcacccccacaccgccaggatcgtgccgatcgccagcgccacgcaattgaacctcgcaggcttgtcgaccatcatgttcccggtatcgatccgctcatgattcccgccccgtccacgcgtcaacgcacgctgacgtcgcgcagcacctcgccatatcccgcatacagattgccgtcaggcagcaactgccgctgcacgagctgccgatgcacggccggcaggtgatggaacggcatccgcgtgaacaggtgatgctcgatgtgaaaatgaatcgcgtgcgggccgaacaggaacgtctgccacgaacgccgggcgatcgtgcgcgcgttgcggctctggtcggcacctgccggcagccccgcgtgctcgaagatcgcgcgcacctgcccggcgagcggcagcagcgtgacggacggcacgatccacaacgtgacgtacagcagcggatgtccggcccacgcgagcgcaccgagcagcacaccgttgcctgcgagcatcgacacgacctcccacgcggcatacgcgcgcgacttcccgaccttcggcaacacatgggcgaactcgccgcgtgcgagcttcacgacactcgtcacgtagccgatcccgcacgcgtacgcgaacaggcggccgatcaggcgcctgcgcgtcaccggatagtcatgcacgccgaacagcagcgcgacgggatcgtccggctgcatcggcgcgcgatggtgcttcagatggcctgcacgatacgtacgcagcgacagccacagcgggccggccgcgaacagctggcccagcgcgtcgttgacgcgccggttccgcgccagcaacccgtgcgcgccttcgtgcatcatgaccgcgagcgccagctggctgcgcgcgatcacgatcgcggccaacgcgtacacgagcggatacgcaaacgcgatcgcaacggcgaacgcagcggcaatcaacagccagtcgcccgccagcgccgcaccgacacgcgccgcgctcacgcgaaacaacgcgggatcgggcacgaaccgcgcaagctcggcattcggcccggccgggtgaacacgggtatccatcaagcgagcctcctgcgcagcgaacgccgctcgacccacagcgcactgaccatcgcgagcgccacgccgcccagtacatcggcgaccgtatgctgcttgagcgtcagcgtcgacgtgcagatcagcaggccgaccgtcacggtcacgagccgccgccggtccgccagcatccggcaggccagacacgtcaccgcgacgtgcaggctcggaaagccgttcgccgcgagatcgagctgccacatgcgcgcgaggcggtggcgtacgaacgcgttgccgatctccgcgacgtcgggtctcggcacggcttccggaaacagcagaaaacacacgacaccgagcacgaacgcgatcagcaccgcttccttgaacgcggcgaacgcgggcggccgggcatacccggcaagcgcaatcacgaacggaaagaagccgacatagacgaaccacgaccacgcgatgaacggaatccgtgcatcgatcgccgtggcgaacacatggcgcggcgtgacgccgcgctccagcagaaagaagatcgcgaggccggctgccatgccgaacgtcgcggccagcatctgccggatatcgggccggcgatcgtcacgaaacgacagcgaattcatcgtggcgccggcgcctcgcatcgcgtatccgcatcggccacctgcgtacaaggtcgcagcgcgaggaggcgcgacgtccacgcgtccacgcgcgcacgcgcatgctcgcggccggcgatcgtccctgcctgcgtaccgggatcgcgcatcagctcggccgcggcctgcccgacttcccgccggaacgcggccgcatcgccgcgccatgtgacaacgcggtgcacgagttgcaggcgtgcggcgcgtgcggcgttgctcgcctgctcgggctggtcggactgcacgagcaggatcgggcggcgatacacgcgtgcgatcgacagcgcggccatgccgggtgccgacacgatcagtggtgcatgggcggcccgcgtcacccagtcggcatcgacgccggtccagccgtcgtgccccgcatagccctcgcccacacggtgtgcggcgagccccgcgtcgcgcatgccggccgacaacgcatcggcgagcgcgatatcgcggaaatgcggattcagatagacggctgcggcggccggctccgaggccggccgttcggcaacgatcggcaccggagtcggcagccggcaatgcgcgtgggcccgccggacttcgtcggcggcatcgtatgcgaaatcgtgttcgatgcagcaccgcgccgaatcgatctgccagtcgacgatccgtgcgaaagcgcgcgccagcacacgcggcagccgcacatcgaaattcgcggtcaacgcgcggcgcaggctgccgccgtacacgtgcacgacgcggcgccgccagcccggcatcgcgcccatgaacagcagcgccggatgaaacgaatcgttgatcacgagatcggcatcgcggccgatcgcacgcagccgcgcgatgtcgcgcagcatgcgcgtcggccggaacacgtaatgcgcgacattgcgatcggtcgcatcgcgcagcatgttctgccgctcgtcgaactgcaccgcgtagtgacgggacagcacggctgcgtcgatgtcgaacgcggccagaaacgcccgccccgcatcggacgtcgtcagcacgtcgacctgcgcgccggccgcgcgcaacgcatgcacgagcagttgtgcgcgcatcaggtggccgcgcgcgtcggccgtcgcgagatagacgatccgcggcatcatgcgcgcggacgaagcgactggagccagccggccgcatacatcgccagcgcacccgtcacgccgaaaccggcttcgatcgcgcggatctcgtccagcaacgcggcgagccgcgcaacctcggacggcgcgacgagacggcgcagcgtgtccgcgcagagccggacgtgccgcgtctcgtccgcgagcacgcgcgagcagcggatacagcggatgggcagcgccgatcgttgcgcagtggcgcgcgagcacgcgcatcgccatctgctccgcgcacagccccgtcgcataggccggcacgagcacgccttgcgcgaaatgcggcgcatggcgctgcgcgagccggcgccaccgcatgatcttgcgccggctcagccagtccggcgcggtcgacggcgcgacgccgcgtgcgcgcagcgcatcggcgaacgcggccgcgtggcggcgttcgtccgcgagatgctgctcgatccgaggcgcgagccagtccggcggctggccggtccagtcctcgtgcaacgcgcactcggtcgcttcctcgccgatcaggtacatgcgcagcacccagcgctcgccatgcgtgctgcgatgaagccgccggatcgccgcccgcttgatgcgatcgacgaggtacgcacgcacccgtgccgcaccgcgcggcgcgggcgcatcgagacagtcgaagcgcccatcgggcgacgccggcggcgacgcgggcagctcgcctgccgcggtcatgccggcacccccgtgcggacgcggatttcgtcgcggatgccgcggcggcggccggatcgcgacgccatccgaggatcaggccgatgaagctctcctgcatgaacgcatgcgcggacgcggtcgcccccgcgaatgcctcctcgcggccgttcacgcgcagataaccgttgccgtcgcgcgcgccgaattcgatccggtcgctcttgcggaaaccgcgctcgcgcacgtctttcagcagcgcactgccgtcgagaccgaacaggaacagctcgcgctgcgcgacccataccggaatgtgattgctcagtgcgtcgaaacggatcgaccacgtgcccgatgccagggcgcgatcgacgtccgcatcgtgcggcgcgctcgacgtgaagctcgcgcgcgcgaccgacttcgtcaggccaccgacgccgagtgcgatcgtgatgtcgtccgcggacggctgcttcggatcggtcgcgctcaccttcacgagatgccgcgcgagccgcgacgccagcgacggatgcgcgaacagcgccagcgtttcgtccggcgtgagcacgtcgtgctcgccatcgccctccttcacgcgcacgcgatacggatcgatccggacatcggtgaacgtgccgtgcacgggcgcatggacatacacgtcacggtcccatttcgcgccgtcgcgacgcagcagcacgtgaacgctcaacggcacgcgccggccgtcgcggtcgacgcccgtaccctgaagcagcacgtcgccgagcacgtccttcgtgcggcgcgtcgcatcgctcgagaagacgatcgcgtgcgcatcggtatcgatgctcgcgtgaacgtcgggcgcatcgagcgcgacgcgattgcagtcggcggcggccgcgttcgcgaacgggcaaccgctttgcgaagcgaagtggtagatcccgcgccccgcgtgatcgaccggcgcggcatgggcgccggcactggcggcaaacagggcgatgcaggcaacacgggtggcgagagaaggcatggtcgtggtcggaatgaaggcagggtgcggcgtgtcgtggccgcgcgcgatgcgcggcaccggttcaatgacggtgataggacaacgcgtcgagatcgcgccgggccgaagcgcgcccggcgagaccgaaaccgcgcgcgagcgcaccgagcgtatcgacggcggacgccgcgatcgtgacgccgacggccgcgagataacgaatggcgccgagccgcggcagctgctggcgatcgagcgcgcgcaggctgtagccgagccgcatcgccatcacgcagaacgggccgagcgggccgctgcgtccgagccactgccatccgcgcggcaggtacgcgttcacgagatacggcgtcagcccgacgctgtcctcgccgcgcatccagcgcagcttcagcgattcgcgatgcgtgtccggcagccgatgttcagtatgcgcggccggcgcgaattcgacggccacgccggccgcctgcatccgcagccccatcacctggcaatgcgcgcgatagacgccgtcgagcggctcgtagcgaaattgcgcgaacacgtcgcgccggaacgcgacgttgttcgcgtagaagttgcgcgtcgcgccggcgcgcagcgggctcgggaaatacatgaaatcgatcgacgtcagcgcgatgccgagcacgttcggcgcatagctggtgcgccccgccaccgcgacgggtgcatcgccggcttcgcgtgcaaacggcgcgagcaggtgctcgagccagtcgtcggccgggcggcaatcggcgtcgccgaacacgacgatgtcgcagcgatccgcgtcgacgcgatcgaacccgtcgttcttcgcatcgtagtagccggtgctcgcaccgatctcgacgaagtcgatcgggcagccggccagcgcgacgatctccgcgcacgcatcggccggcagcccgtcgtgcgtgatgatccattgcgcgagtgccgcgggcggcacggtctgcttcgacagcgccgaaacgaggcgcttcaggctatcgacggcctgcgcgaggccggcaccgccgcgcaggttgttcgtttccagcacgagcgcggccctcgccgccacggcgtgagccgccgtgcgcgtgcgcggcgaggtttccgtgatgtccggcatcctgaatgtctccatcgtcatgcgcgacggcatggatgaaacgaatgggcggcgagcccgcgcgcattggcggatgcgggtcgcccgcgaccgtcgtcgcaaaacgggcggcccggaaggcgcccgcttcgcgtgtggtcactcctggacggacggcgccgattcggcgtcggtatagcgcggcttcgcgttctgcaggtcgcgcgtgttcttctgcacggccaccgaaccgaacagcgcgagcacgaacgacatcgcgtagaagcctttctcgctcagttgcagcgtcgcattgaagaggccgacgatcagcagcgcgatcgacagcagcagcgcgatccagctgaggccgtagtagatgccggtgacggaatgccttccgcgcggtcgcgcacgctcttctgcagcgagatcgccgcgtagaggccgaacaccagcacggtgaagtagtagcccttctcgttgagctgcatgccggcgttccagagaccgatcaggaatgccgcgaaaccggcgagcagcgcggcccacgacgcggccacgaacgcgaacgacggttgctggatggtggtctggttcattgctttgccctctctttcttcttgttcgaaatcgttttcgttgaactgcgtttcgcgcatggtagcagctttggcacgcggcaagacggcttgcttgcagtcttacgattcgcgccgcgcgcgtcgccagcgccccggcgtcgtgccgagcaccgcgcgaaacgccttgccgaacgcggcttccgactggtaaccgaccgcctgcccgatctccgcctgcccgcgctgcgtgtcctgcagcagcgcgcacgcatgcatcatccggatctgcgcgacgaacgcgccgacgctcattccggcccgctcgcggaaatgccgggcgtacgtcgcacgcgacatcgccgatgtgtcgccgagcgactcgaccgtccacggcttctccggcgcctgcaatacggcctgtaccgacgggccgagccgcgcatcggcagcgagcgcaagccagccggacggcacgcgcgcgccacgaccgtatgcgcgcaacgcatacgcgagcagcgcctggccgagtgcgttcacgatcgcgccggcgcccggctgcccattcgacgcctcggtgcgcagcacgctcgtcagcagttgcagcggcgcgaaccccgacgcctcgcgcagcccgacatgcagcacgtgcggcagcgtccgcatcagcagctcgcccgcgccgcgcgcatagacgaaccgtccgcagagcagatccacgctcgcgccgcccggttcggccggatcgagattcgtcttgaccggcagcaccgcgccgccgccggcgccgtgttcgcgcagcgccgcaaccggcctcgaccggcccgcaccagcgtcgagcagctcgtgcgcgccgcccgcgggcagcagcacgaaatcgccgtcggcgagctgcagcgtgcgcccttccgcggtatgcagccggcacgttccggccagcaccaggtgaaacgccgcctcgcccggcggcagcgggtcgtgcggcatcgcgaacggcccgccgagcaggcagcgcacgtcgagctcgacatggctgcggcccagcgacagcagttgacttagggcatccatgagacgattgcgctaaaaattgacactctagcgtatcgaaaccctcagcgcgaacgatcagaataaccctgcatcgcccgagatcgcggcgcccgccgccttcctcacctcttctcgaaaaggacgcatcatgctgaactggaacgaataccggaaggaactctcgacgcgcatcggcgacatcgccaagctgtcgccggacacgctggccggctaccaggcgctggccggcgccggtgccaagacgggccatctcgacgcaaaaacgcgcgagctgatcgcgctcgcggtggcggtcacgacacgctgcgacggttgtatcgccgtgcacaccgccgaagcgaccaagcatggcgcgacgaaggaggaagtggcggaagcgcttggcgtcgcgattgcgctgaacgcgggtgcggcgctcgtctattcggcgcgcgtgatggacgcgctcggcgactgaacctgacggccgcggcgctgccgtcgcgtgacggcgcccggctgcatggctgcatgtctgcccggttgcgcaccgcgcatccgggcaaatgacgtatgaagattggccagcgtacctgcccgaatggcgggccgggcgcccgcgggcgaggatgcgccgcgaagtcggctaccatgcgcgaacgatccatcgtgaaggagcgcttcatgtgccgctggctcgcctatacgggtaatccgatccatctggagaccgtgctgttccgcgcgaagcattcgctgatcgaccagagcctgcattcggagctgggggcgacgaccaccaacggcgacggcttcggcatcggctggtacgggcgccccgacgaactcccgttccgctaccgctccgtgcatcccgcgtggaacgaccgcaacctgcgcgaagccgcacgcgcgatccgctcgcggatgttcatcgcgcatatccgcgcggctaccgacacgccggtacaggaaaccaactgccacccgttccgccacggccgctggctgttcgcgcacaacgggctgatccgcgacttccacaagctgcgccgcgacctgacgatgaaggtcgatcccgcgctgttcccgacgctcgaaggctcgaccgactccgaactgatgttccgcctcgcgctgacctacggcctcgagcagatgccgctgcccgcgctcgagcgaatggtcggcatggtcgaggaaacggccgcacggcaccgcgtggccgaaccgctcaacatgacgatctgcgcgaccgacggcgagcggatcatcgcggtgcgttattcgagcgaacggcagtcgcgttcgctgttccacagcacgtcgttcaagcacctccatgagctgtatccgcacaacccgcgcatcgccgaagccggcgacgacgcgttcatggtcgtgtccgagccgctcgtcgacctgcgcggcgcgtgggaggaagtgccggagagcatggcgatcgtcgcgcagggtgctgatgtgcagcagcggccgttcagtccgcggcggaaatagcgcggcaggctgccatacgcgccgtcaggcgcggcgcgaaaccgcatccgcaccgaatcaagtccggcgggcagccggcgcgaacgggcgcgcggccgcggcagtgcggtgaacccgagccgttcgtacagcgcgcgggcccgcacgttgcgggtcagcacgtcgaggacgacatcgcggctgccgtcggccggcaatgcccccgcgtccagcgcgtcgcggaacaaggcactgaagatccccgtgccgcgctgtcgctcgtcggttgcgcaatgcgcgacgagaatctgcgaacgcttcggcgccggaatttccgtttcgagaatcagcccgcgcaacaactgccccatcgtgcggcgcacgccgaagaagcgcgccagtgcccacacgacatgcacgtcgtcgaacatcgtccgttgcccgtcgtgaatcgccatcacggcgagcacggtgccgtcttcaccgaccgcgacgcgatgccggcgccacgagaagcgcccatggcgcgaccggaatgcctgctgcaggaaagcgatgcagcgcgcatcgctttcgccgagaaaaacccgaattccgccacgccggacgcaaacacgagcggcccgcacgacgccgcgtcattcgcctcggccgcacgaaaccgcacgcgctcgccggcacgcggagccgcttgcgcgaacgcaccggccagcgtcatgcgctgcgccccgcgagtcgcgacaacacggcgaccgtccggctgatctgttccggctcgtgcgtcgagcagatgaagaagcgcaggcgcgcagccttttcctcgacggccggatagaagatcggctgcacgttgatcccttcgtcgaacatcgcattggcccattgcgcggccttcagcgagctcccgtgatcaccggcacgaccgcgaacccggcactcgtgccggtattcagcccggcggcgcgcgcttcgttcaggaactgccgcccgcgcgcctgaagttgcgcgacgcgcccaggttcggcctgcaagcgctcgagcgcggccagcgacgcttcggcgagcgtcggcgccagcccgacgctgtacaggaagcccggcgccagatggcgcagcatgtcgacgagcggctggcagccggcgatgaagccgccgcagccggccagcgtcttgctcatcgtgcccatccacatgtcgacctggtagggcgcgacgccgcaatgctcgcggatgcccttgccggtcgcgccgagcacgccgagcgaatgcgcctcgtcgaccagcaggaatgcaccgtggcgcgttttcacgtcgacgaagcgctgcaggtcaggaaatcgccgtccatgctgtacagcccttcgatcgcgatcagcacgtgccggtattcgcggcgtacgcgcgcgagcagctcgtcgagcgcctgccagtcgttgtgcgcgaaactcagccgcttcgcgccgctcagctgcgcgccctgcacgatgctgttgtgcgcgagcgcatcgtggacgatcaggtcgcccgggccgaacagtgcgccgatcacggtcacgttcgtcgcgtggccgctcacgaacgcgacgcagtcgtcggtttcgtagaacgtggccaacgcacgttcgagatcgcgctgcaccgggcgttcgcccgcgaccatccggctcgccgatgccgacgtgccgtaccggtcgatcgcggccttcgcgcgcgcggacacgtccggatcgccagccaggccgaggtagttgtagttcgcgaagttcaggtattcgcgcccgccgatctgcgtcgtcgcaccggcgacgccgtcgtgcacgcggaaaaacggcgagtcgacgcgcagcttctcgcccatctcgcgcatgatccggacctgctgatactgcggcatcgattcgaagcggctgcgcgccgatgcggtctgcgctgcctgcgtgccgggcacgcccggtgccgcggcagcatccgtcgcgcgctccagctgccgtttcagcgctttcgccgccagttgctggcgaagatgctctcccagtgccattgcttccttcgcttaatctcgaaaagacgctatgttacgccgcgcgtcatgaaaagacgtggtgtcacgcgtcggaaaactcggcccactgccacgcgtcgggtgcggccagcagcgcgtcgaccagccggaaattcatctcgtggctcggccgcaacgcgctcacgcgcgccagcagcggcgcgccggccatcgcgagatcgccgaccaggtcgagcacgcggtgccggacgaattcatccggcaagcgcatcccgcccagcacgcggctgccgacgatggatgcggtacacgacggccgtgcgccgcgcaggatcggcacgccgcgcagatagccggcgacgatcgccggcacggcccatttcacgcgcccgtacgagcgcgacggcgcgatttcggtttcgaatgcggccggcgtcagcgcaccgtcccaatgcatgtcgccgaagccgcgcaggtcgttgcgcacgctcagttcgtaacgcggcgccggctcgacccgcatttcgcgccgctggtcaccttcgccgtccgtgacgacgacgggccgcagcacgcggatgaagcgtttcggcgcatcgagcgcgacccggccgcacgcgcggatggcgtccacccacggcgtggcgctgccgtcgagaatcggcacttcctcggcgtcgatctcgacgaccgcgtgatcgatctcgcatgcgagcagcgacgcgagcagatgctcgatcgtgcgaacgccgacgccgtcgggattgcgcagcatcgtgcagagcggctgagcgcggcgcagcgcgggatcgaccggcagcgtcgcgagcgtgcgcccctgcgcgacgcgacgaaacacgattcccgtcacgccgtcttccggccgcgcgggcaggatccgcacacccacccggcgccccgtgtgcagcccgtgaccgtcgatcgccagcggacctgccagcgtgccctggcgcgtcgcccagccggacggcgcgctcatcgcgcgacctccagcgtcggcgacacctggcccgccacgggcgccgcccgcgtatcgagcatcgcgcgcgcttcgccttcgatcgcgtgtttcgcggcaagcgccgcgacggcctcctgagcggcatcggtcgccgccccggcgtcggacgcgtcggccgacgcgccgatcgaatcgacgatgcgtccggccagcgtcgtcaccgacgcgccctcggcaatcgccatcaccgacagcttgacctcgaacgcttcctcgaccgccaggccgagttccatccccatcagcgaatccatgcccatgtcgagcaccgacttgtcgagcgcgatgcgatccggcgtcatgtgcaggatccgcgcgatctgcgcctgcagcgtccgggcaaccagcgcgatcgcttcgtcgcgcggcaaggccagcacttcttcccgcaactgcgtgccgccgtcgcgcgcatcgccgcccttcgcatgcgattgcagcagcgaataccggcgtgccttcgcggcgggcatcccgcgcgccacggcatgccagtcgagccggaccacggcttcgccggccgcgcccgcgaccagcgcgcgctcgagcgcggccatcgcctcgtcggacgtgatcgatgcaccgccgatccgcgactgcaacgcctcgcgcgtatccgcgtggcgcgcgaggaagccgacgtcctcgagcgggccccaggccatgaacgtgccgggcaacccggccgcgcggcgatgttcgacgagcgcctcgaggaaagtgttggccgcgacgtagttcgactgccccggattgccgagataggtcgtcgccgacgaatagacgacgaacaggtcgagcggcagcgcgcgtgtcgcgcggtgcaggttccacgcgccggccaccttcggggcgagcaccgcggccatgcgcgcatcgtcgagattgcgcacgaggccgtcatcgatcgacatcgcggaatgcagcacgcccttgagcgggctgccgcgccgcgcgatcgcggcaatcatcgcatcgaccgccgcggcatcggtcacatcgcacgagacgacatcgaccgtgacgccgagcgtcgcgcgccagcgctcgacctcctcgcgggccgcaccggcaagctcgccggaacggctcgccagcgtcagccggcgagcgccgcgctcgaccatccagcgcgcgctcgcaaagccgagcccgcccgtgccgccgaccaccaggtacgtgccgtgcggatcgagcgcgagcgagcccgcgcgcgtgacgccgcgcgtcggggccggcgtgccggacggataggtcacgagtaccttgccgatctggcgcgcctgctgcatgtagcggaatgcatcttcggcccgttcagcggggaacgcgcgatacggcagcggatgcagcacacctgccgcgaacagcgccatcacttcgccgaacaggcgttcggtcagctccggcaacgcccccatcaactggtcggcatcgatgccgaaatagctgatgttgttgcggaacggccgcagcccgatgtggctgttttcgtagaaatcgcgcttgccgagttcgaggaaacgaccgaacggacgcagcgtgtcgatgctgcgcaccatggcttcgccggcgagcgaattcagcacgatgtcgatgccctgcccgcccgtcagcacgcgaatgtcgtcggcgaacgcgaggctgcgcgaatcgagcacgtggtcggcaccgagcaagcgcacgaactcgcgcttctcgtcgctgccggccgtcgcgaacacttccgcgccgaagtggcgcgcaagctggatcgcggcgatcccgacgccgcccgcgccgccgtgcacgagcacgcgctcgccgcgacgcaggcgcgcgagttcgacgagtgcgtaatacgcggtgaagaacgtggtcggcacggtcgccgcttcctcgaacgtcagacgctcaggtttcagcgcgatcgcctgcgcgcgcgtcctgacgcgcgtcgcgaacgaagccggcgcgaagccgagaatcgcatcgcccggcgcgaatgccgtcacggcgccgcccacgcggacgacgcggccggacagttccatgccgatcgtcgcgcccgcgaaaccggtctcgaccgcctcatcggacaagagccccatcgcatacatcacgtcgcggaaattgaggccggtcgcaacgggctcgatttccacctcgtccgcgcccagctcactttccggcaacgcgaaccattcgagattgcgcaacgagcccggtgcatcgaacgcgagcacggccgcacgcgcgatcgcgccgtcgctgcgggccgcagcctgcgcggccgtcagcatgcgcggcaccagacgcccgtgtgcgcccaggacgacttcttcctcgactgccgagccggtcagctcgcgaatcagtgcgtcggaaatcccgtccaccacgcgatcgacgtcgatcaggcggcacgcgagttcgggatgctcgttcgccagcacgcgaccgaggccccacagcgttgcctgttccggatgcgcattcgcggccccggcgaacggcgcgccgccgcgcgtgacgacggtcaagcgcgtggccgcgttcggctgcccgccgagcgcgcggacgagcgcggccagcgcgatcgcgccgtgacgctgcgcagccatcaggccgtcgcccgtcgccgattcggccagcggcgtttccggtgcgcagaacaccacgtgcgccggctgcccggccggcaacgacgcgatcgcgtcggccgcatgcgtgatgtccacgatgtcggccgggtaacccgcgcgcgccagcgcatcggccagctgcccgccgaaaccgccggccgcacccggcgcgtgcatcacgagccattgttcgttgcgtgcgagcgtatcgagatcgctcgggtcgtcggtgcgttgcgcagcagcggcgctcgcggggttgcgcgcgatgacgaacgtcggcgtaccgtccagatcgagcgattgctcgacgtgccgcacgacgtcgacgtagcccgcgcgtgcgagggctgcctcgagatccgccggcgccagcggcgcgggggcagcggcttccgtcgacgttgcctgcgaggcgaacacgatgtcggagaagcggccgtggcgcgactcggccagcagcagcagtccgcccggcgccagccacgaccgcatcgcattcagtgcatcgaccacatcatgacgatcgctcagcgcgcgattcgcgacgatcaggtcgtaaggcccggcgtcatcggccgacagcgacagccgctcgcccgactgcagtgccaccgtgcgcaccgccgcttccgcatccgtgtcgaacccggccagctggccggccgtcgccgcgatcgtgtggtcgcagcgcgcggcagcgagatgcatgccgagcgtctgcagcacgtcgccgtccgtcgcgcccagttcgagcacgcgtagccggcgcgccggctgccatgcatcgaccgcctgctcgacgctggcggtcagcaacgcgtgcacgtgctgccacgtcggcgacgcggcaaggagctgctcgaccaagctgtgcccggtcggcgacagcaagcgcgcgccatccttcgcgccgcccagcacgtcgggcaacgccgcgccgcaatgcgcgagcagcgtcagttcggccacgtgccccggcgattcggccagcagcccgcgccacagctcgtcgagcggcggcaacgccgcacacgctgcgtcgtcgcgcacgagcagcgcgccgtcgcgatgagcgagaccatcctcgaccagcatgtcggcaagacgcgcggccagcgccgcatgcccggccgccggctgccacgtgccggcgaatgcgccgagcgcatcgaacgcgcggagcgcgtagaggctcgccagcacgtcgagcagcggcaggatttcggttagatgctgcgtccggcggacgtcgttaccggtcgcctccagccgcgcgacggcctgcgcgagcaacgcgtcgggggccggcaaaccggctgcatcgacgtcgccgggcagcggcatgtcttcaaggcgatagacgaagcgtgcaggcaggttctgccgacggccgacgagatcgacgcgccggaaccggcaaccgccgagccgcgcgacgatcgcgccccgcgcgtcgaggaattcgaaatgcgcgacgatcgaatgcgggctgtgccggtcgatctgcacgcgcacccgctcgaccgtgtcgccgcgcagatagtcgacccggccgatctgcaccggcacgtaagccggatgctcgccttcgcgtgcgtacgccgccagcaaggcgaacagcggatgaaacccgctgtccatcagcgccggatgcagcagatacgcggacaaggcccgcgcatcgccgcatgcggccggcgcggcgacgtccgccagcgccgcgccgtcactcgcggcaacccgcacggtgcgaacccagcggaacgccggcccgtagccgaggccgatggccgcggtgtttgcgtacagcgtgtcgccgtcggccgcgggcagcgcgagcagacgatcgagcgcggcggacggcacgacgctcgtatcgccgagcgcgttgccgctttccagcatccgcccggtcacgttcagcgtccacgcgctgtcggacatccggtcgcgcgtctcgatcgtgaaggtcgcggtgcgcggctcgatcacgagccggaacagtttcgcctgctgcggctggaatacgacaggcgtgcggatctcgacgttttcgagtgccgcatccggtgtatcgaagaacgtccgtgccgcggcgagggccatttccacgtaacccgcgcccgggaacgccacgccgccgtcgacgacgtgatcggccagcatcggcagcttcgccggatcgagctggttttcccacgcgaatgcgtgctcatgcaggcgatagccgagcagcggatgctcgcggcggcgattgacgaggccatagccttcgacggtcggcgtcagccagaagcggtcgcgctgccacggatagaacggcaacgcggcgcgcgattcgcccggcgcgaagcggtcgggatcgacgctcgcgccgtgcgcgatcgccgcgagaatcgcctgccgcagcgtcgccgcgctgccgtgaccgcgcttgagcgtcggcagcgccatgccggttgcgccggcggccgtgagcgcctgcttgacgtacgtacgcaggatcgagtgcggcgaaacctcgacgaacaggcgcacgccctgctcgatcagatgcgcgatgccgtcgccgaagcgcaccggctcacgaatattgcgccaccagtagcgcgcgtcgagctcggtgccggcaagcgcgccgccggtcacggtcgacacgtacgtgccgttgcccaactgcggccgcaggctcgccagttcggccagcacgaccggttcgatgcgatccatgtggctgctgtggaacgcgtagtcgagatccagcatctggaagaacttgccgctgccgcgcagcgccgcctccagtgcctgcagaccctgcagctcgcccgcgagcgtcaccgcatcggggctgttgatgccggcgatctcgacacggcgcgcaagcccgtggcgcgcgatcagttcgcgcgccgctgcatcgccgatgcctacggccgccatccggccgctgccgcgcgtcatcgcctgcgcgcggctgcggatcttgatcacgcgcaccgcatcggcgagcgacagcgcgcccgtcacccacgctgcggcaatctcgccgacgctatggccgatcgccgcgtcgtaacgcatcccgtgcgcgtcgatcacgcggatcatgccgacctggatcgcgaacagcagcggctgcgcgttctccgtcgcggcgagccattcggcgccctggccggccagccattccgcgctcgggccaccgcgcatcacgtcgaccagcgacgggctgccgtcggcgcaccacagcgcgtcgacttcgtcgagcgccgcgcggaagacggcgttctcggcataaagctcgttgcccatcccgacccactggcagccgttgcccgagaagacgagcgcggtgcgtggcgtgtcggccggagcctggccggtcgccacgcaggcgggcaacccttccggtgccggctgggccagcgccgcgagtgccgcacggccttcggccgcgtcggccggcgcgacgatcgcgcgatgctcgagccattggcggcgacgtgcggccgcggcggcaagcgcctgccagtcgccgccgttgtcgagcatcgacagatagcggcccgcgagcgcaccgagtgcattcgcgctgcgcgcggtcaggacgagcggagacaactgcgcgtgagtcggctcgggcgcggccgccgacgcctcgtttgcagccggcgcctcggtcagcacgacgtgtgcgttcgtcccgccgaagccgaacgagttgacgccgaccgtcagcggcgcgtcgcccgcatcgagcggcatgaagcgatcgacgacacgcagacgcccgccgtcgaaatcgatgcccgggttgggcgtgacgaaatgcagcgagcgcggtaccgcgcgatgcttcaggcacagcacggccttcagcagcccggccatgccggacgccgtttcgaggtggccgatgttggtcttcaccgaaccgatgagcagcggacgatcggccgggcgctcgcccgacacgacgtcgatcagcgcacgcgcctcgatcggatcgccgaccgccgtgccggtgccgtgcgcctcgagatacgccagggactgcggatcgatgcccgcgcgcgcgtagacgctgcgcagcagcgatgcttgcgcggccgcgcccggcacgctgataccgcccggcgagtggccgaccgagttcacgccggagccggcgatcaccgcatggatcgtgtcgccgtcggcgagcgcgcgatcgagcggcttaagcagcacgaacgcgccgccttccgagcggacataaccgtcgccggtcgcatcgaacgcgcggcaacggccgcgcggcgacaacatcgacgccttggagaagctgacgaaaccgaacggatgcagcagcaggttgacgccgcccgcgagcgccacgtcggcttcgccggattgcagcgccttgacggcctggtggagcgcgacgagcgacgacgagcaggccgtgtcgacggacatgctcgggccgcgcaggtcgaacaggtaggacacgcggttcgacgcgatactcagggtgttgccggtcgccgaatacggatcgatcacgttcagatcgtccatgttgcggttgccgtaatccatgctggcggcgccgacgaagacgccgcagttgctgccgcgcatgtcggccgggcgcacgcccgcgtcctcgaacgcttcccatgcgagttcgagcagcaggcgctgctggggtccatctgggccgcttcgcgcggggaaatgccgaagaacgcggcatcgaagccggcgacgttgtcgacgacgccggccgagaacgtgtagctcttgcccggttcgcgcttgacgggtgctggtagaaatcggtgccgaagcgatcggcggggatttcggtcactgcgtcgcgttcgtcgcgcagcagttgccagaagtcgccaagatcgttagcgccccgggaaaccgacaagccaccccaattattgcaatcttactgttcatcttttatgtcgctttctcggatgcgcacggctgttgcgtgcggtttccgtcatcttgtaccacatgcagcagtgccgatccgagttcctcggccgccagatttcggcattctggggtatctacgccgtaattccgccaaatgaagtagtcgctgtgttgcggattaacgccgagcttctcgaagacatgaggcaaggcgggaacgtggtcgccgtaaaagcaaacgactgtttcacgatcactggtgcgcaaataatcgagcaagcgcccgatcatcgcgtctgcattttcaatgtgccgtaaatatgccgtcaagtcgcgccaagaggcgtcttcgccaagagtatgcctcgaagacgattcaccaggcaaaacctgttcgaggtgcagcgggccgtggttttccatcgtcatcgcgaagatgaaacgcggtttctcgccctcgctttccagcgccgcgatcactgcatccagcacggctgcatcggagatatacggaccggcacgcgacgcatcgacaaagtattcgatgtcgagaaatgtgttgaatccgagcaacggaaagactcgattgcggccaaagaagtcgccgtagtacggatgaatcgccagcgtttcgtaaccgccacgaccaaaccagcttgcgatcgacgcgcacgcacggcgcacgaacgcatacggataaaagcgcgcatagccgaggcgctcgaacggcaggccggtcagcattgaaaattccgtgcgcatcgtatttgcgccccatgccggtaccgaaagctcgccgtagcaaactgcttcgcgtcttgctcgatcaaattgggaaagcattgcaggcgcaattgccggtgaaatgcgtcgcacgtcgaacagcgattcgctctggatcacgatgacgtcggggcgcttccccgacttaccggcgacgaacggccccgattcgaccacgcgtcggaaggcttcgaacgtcgcgggccgcatgccgttcagcaagtatgcgatgaagactgcgaaaaagccgtgacggcgctgatcttccttggcatcgagtgccaatggcaagcgagcggcaaagtatcgcgccagtaagaatgtaaagacgacaacggccgccaacgcgaacgccggacgcggcgtgatcggcgcctcgccgagatagcccgcgacgacgagcacgatccctgcgccaatcgccacgaccttgcctgcgctcaggaacggcagatagagccgcgggtgcgagaaaagctggctgaagaggctgagatcggtaaaaacgaacggttcgcgcagagattcgtacttggcgttactgacgaccgcgacgagcccgaccagcgcgaccgcgacggacgaagaaaagatcggacgcgcggtgacaagcaacatcagcgccgcaaggaacacgacggaaagcacgtgcaagagcagcgcatccgcgcgacgccgcaacggagcacgcggaactgcgatcagatccggcagaaacgacacaccagccgcaacggcgaacggagcccagattgcgcccgtcaatttgcgtcttccttgcctggcagatacgaaagcttgtcgagaatcgcatcggccagtgcgacgggcagcacggtcaggatacgcatgccgaacgcaagcagaccagggaacgcgatttccgcacgcccggcatcgagcttcctgcgaatatatgcggcggcctgctcggcagtccacatgaacggcttgtcgccgggaaaaacgtcgctcatcgacgttttgacgaaacccggagaatgaccgagacaccaataccgtcgcgcttcagtagcggacggacagagtcggcgtaagccttgatcgccgatttgctcgcgcagtacgcgggcgagatggccatgccgcgaagcgcggcgagcgaactgatcgcggcgatacggccatgcttgcgggtgcgcatacgctcgacaatcgggagaaccgtgtgcatcgcaccgtagaaattcgtatcgacgacggtggagatacggtcgaggtcctcccagtcggacgcggaagacagcgtgctcgcgacacccgcgttggcgatgagcaggtcgatcggatactgatcgtcgaaacgatgcagccacacacgaatcggatcggacgctcgtacgtcgacgatgccgacgatcacttttgcaccgcgcgccctgcacgccgccgcagtcaattcgagctgcgcttcgttccggccaacgatgccgagcacagtatcggattgcgcgtatgcgagcgccaaagcgcggccgatgcctgcgctcgcgccggtgatgacgatgtgtcgaacggccttacgcagcatgcgaatcctcaatacgctgaatcgcagcgggaattgccatgtggataccggtttgcgtgtagaagtcgccgttgatctgcgtgcgatggaccacatggttcagaaatgcgcgatacaggttctcgtctggtgcttgtccgttcttccaaaattcgttgagcgagccctgccacgtgagtccggccatgttatagattgccgatcccaacgtaataagtggcctgttgtgatgcaatgcggacagacccacggtactgttgacaaccaccacgccgcgcgcatgttcgagcaacgtaggtaaatgacctgcgtcgataaagcgcaagcgttcggccatatcgcattcctgcgcgagcgtccgtgcgtatcgcctgtagtcaattaaacccgtatcgagcggatgatttttgattacaagccatgcgtctttcggcgcatggaaggcgaatgagcggatcgccttcgagatggcatcgcgcactccgtcgaagggcgaatgcacgacgatctgggcatccgaattcaattgcaaaggaaacagaaaatatgggcgctgggaactcaatagctcttctgtaacggcaagcgcctcagaccgatgacgccgaccttcgagcgcgcgcctcgccagtcccgcgtattcgctcacaccattgcgcggccggtgactccggtaatgtcggaagtaccccgagaaagccagattggctgcgcgatatcgcatgtcgtgcgccgcacgttcaaacaggctatagcctgtttcgaggccaagcggacacggcggaattgttgcttgccccgcaaggtacgccccaggatcgcgtggcaacaacgatcgcccgttcacgccgtgacgttcgagcgtgagccagtgcggacgcacgtagccctcctcgaacacgtgcacgcgtgctcccattgtctcggcgatctcgtgcaccggtacatgaacctctcgacagtcaccgaacatcaacacgtcagtaacaccctcacgcgcgatgacatcaccataccaaaatgcaagctcggcaagcggccgcgtgtaattcagcacgctgtttccacggctgtatgccagatccctccgcagaagttcacgcgccgcacggcgtgccctcgggcgcgaagcgacgcgcccaaggttgcaaaaaggagaggcgggcccttgcaaagcaagtatcgaaagtcgcacgactattttcgccctggagccgatgtgtgaatattttttccatgaacctttactcttcccatacccagcccagtccgcgattcgccttgcgttcctgtgcaacacgtcgtttcgccgaccaacgacgtaacagacttggcaatacgccgatactcttgccgaacaatcgcagcgatttactatccttgacgatccggttcgcgacgcgctttgccgcaaccggattgagcaccgtcggttgcagatagaacgctgaagacaacggcggcgcaacctgaaacatctgcgaatcgtcgcagaccacggcgatgactttcggccagcacacggccgagaagaatccgatccgcatctgatagagggcccttacgatcaagtcagactcgaacccattcgcaatcaacgtgacgatgtttcctgccgaaaacatcgcgcaatcgtttcggatccgttcgacgtcgagcacaccttccgctgtgtagccgatgcgaacccaatcagcgaactcgatcctatggacttcatgatccatcccgacgaccagtgcttgtcgcaggatagccgacgtgtcggcgagcatgaataccggttgcgccacgtcgcgcactgcgacaccgcgcaagaatgactcgacggcccggtcatcagcacgccaaacagaagttggtagacaaacggtatgcatgtcaggtccgcttgaatggcgtcgacttcatcaacgcgcgatagtaaaaggagattccacctttcagatacagtacatccttgcgccggcgaaacagatataacgccgaacacatagttccgacgagtaagctgagagaccgcctctggaggtaatctgccggcgagtgaagaaacactgcccctttcggacgcaacgcgatatggttcagcagcacgtcgttctccatcacaagcacgcgcaccggatcagcacgctcagcaagaaaactatgtacgacacgttcggtccacgaaaacggcagctgatcaaacacaacccacttttcgaagtccgccacgaaagcgcgcagcttttcggactgcatagggacacgcacacgtgacagcatgttgataatcgtcgcgagccgatgcgtcgaacgctcaacagaagccgcgggtaactgcatcctgatctcggcgggaacgtatttcgcagtaaaccgattcatcgcctcgagtgccttgtccgtactaactttgatcgccggcttgcgtttgatgggcagcacctcggtccaagcacgcgtcagacgtgctcttccctttgcgttctcgataaacgttccagcgacacgcattagcaatggacgcgacaccagactgcgtcacgccgtacggattgacacgactgggaatgcccatgtcggaagcgcgatacgcgtgttcgagatcttcgaactcgatccagtgcaggttttcgttctgcgggcacgagagccagaccgacttcttgcagatatacatgctgcccgtcggatagcttgtctgatcgtagcgcaatgcattgtgcgagaagaaactcgacctctcggtgagcgcgagcacggccggagcaaactcgctggcacgctcaacgccttcgttacgcataacgccgcgttcgctctggccacgcacccgatgtgagatcccaatgtccgagtagcgacgcggaaccatattcaacttgtcgtcgaaatacaggctctgcatcgttgtcagaggatagtcgtctccaaagcgactgacgatttcatcaaagttctccggaaggaagacgcgatcgtgaatgatgcagagattcggatgcgatgcctcctgcgccagtcggttcttcttcgcgcaaatcttgaccggtggcgcggtgatgtcttccctacgattcggacttggtcaaaatatttaaagttcgcgcccggacgaccgcaaaggagaatctccttctttgcaatcttcaattcgagaatgcgctcgactgcgacattgagtagcgtcgcatcctccgggccgaccgggatcccgaacgtccatgcatctagccccgaatcctgctcggccaacagcggtgcatgcttttcgaagacgacgccaccgtctacgctttcgactgccttgaatgacgccgcaaagtactcgcgtcgcaaatagctcgacgcggacgcatctccaagcatcgtgatcgttgcaccaatctcgatcgtatgcgcgacgtcccaaagaataagcggggccaatggcgagtcagtttcgagaccgtacatgacgatgtctcgccctttgatccatgagaaacgctcggacgcattgacccgcttgattgtttcaggacgatgacgtggagccaccgacctgaacgtcacaatcgtcgctccgttgtcggcgcgtacagcaacttcgtccggcagcatcggagcggtcgtcttcgaaacaggcgtatagccaagcgctttgagatgcgtgagcttataaatcggcattgcgttattcgaccagatacttgtcgttcagagcaccaggtgtcttgacgactacatttacggcatcggtcagcgcctcaaagtcagttgcatcgttgggctcaacaacgatgatgtccccttcgccccattctctgtcgaacatacgcacccggccggacagcaccagcgtgatttcggtcgcctctttgtggaagtgcgcattttccttttcgcccgctctataacgcttcactgccacttcgcatgctgtggtcgagaacgaagtaggcgtaaacccaccaacgaaccaacccttggtcatgtcggataacttgaaaacctgcatacttagactccgtgctcgtagtgcgattcggtgtgctgcaactgacgttggctcttgattggcaggtactttccaccttcgacgttccatacgccgatacgcgcctgattcaagatcagttcattgaggaccggcgtcacgtagaaatcgccgccaacatgggcatccttacgaatcatgtcgcggacgcccgcgaggaaacgctgaccgtcggcgaaccaatacacgccagccgatgcgaacttgctgatcggacgtttttctgcggcctccgaaaccagcttgtcgtcttcgacacgtacgtacgaatatcgtggatgaaccgactggaacgtcactaggcccgcgtcaaggcctcgctcgcggaaatcagcaacgacttcggcaaggttcatttcgagcaactgattcgcattgacgatcagcaattccgactcgctatcgatgtgctcgcccgcgagcaaggcggtgcatgcagcgccgcgcactgcatcggaaaccggcacaattttggcgtcagcgcgaagaatcgacacgacttcgccgagatgaaagcgcgtcatctctgaacggcgcaacgccacaatcaggctttcgccaacgatcggttcgaccgagcgaatcacgcgctcgatcagcgtcacgccgtcgatctcagccagcatcagcggatattcgccgtcgagcggctccatcggcgcggcccctgccgcgagaataagaacgttcatgcgatgagcgcctcctgcgccttattgattgctgcggagatgtttgcgtagttggtttcgtggacgtccttcaccaccagcacgtgcgcacctgacgcacgcgccgcgcgaatgccgttttcgttgtcctcgacgatcaggcactccccggctcgcagccgagtaggctcatcgccttcagatagatctctgggctcggctttgcctcgacgacgtcttcattcgatagcatgcgatcgagatactttgtcagtccggacttgctcatcatgagttcgaccgacatgcggatggagttcgatgcgactgccaacttatagccctgcgccttcaacttggaaagcgcgagttcgttagcaaaacggggcttgcaaagcgtttgcaccagctccgttgtgtactgttgcttcatctcgttgatgaaggagtgcagaccgcgcggcagatcgtgttgaagggagagcatctccagcttcttctttgttggcagaccatcataagtcgtcagatgatcgatccggtttatttcatagccgaacagctgaagcgcacggttaagcgcgtcgtagtgccactccttcgcctcgatcaggacgccgtccatgtcgaagatcactgctttgatcattgcaagccccgctggttagtatttaggactggaagaagcgctggcattcttccgggaggtccgtacaaatcattaaattgtctaagtcgttcatactcttgagcaccgaccacaattcgctgtgctcgcgcccgtgcagctccgccgataccacgcacacgcgcaagccacgcgaatgcaggtcgcggatcgtcgcggcgttgtaccaagtgtgtgagaacgcatcaagccagacgcccttggcctgatccagccatgcgggcgtgcgttcgacctcgctcattcgcgcgaacactggatttccagccttgagctgcatccttgtatctggcaccgacatatcgaacacgaaccagtcaagccccttacgatcaaactcttccgcaagccccgatgcaagaccgtccgccttgatgttcatcgccagcggcacatcgcgcccgccgacaatatcgataaacgctgacagcgagatggactctgccgtagctgggtcatgcgaaatgacgagctcgcctagtcggtcacgcacgtcggtttccgttccaaagccaagatcgaagctacgatggaaagcgagtggcgtattctttccgctggctctttccaataaccgcgatgcgaaagcactttcatgcgcgtactccggtcgcccgctcgcataccggcagagaaaggaacagatcgagatccttgggaatgccgagtccgtacatgcctgcggcttcgctacctacgttcgaaattcccacgcgcgcattctcggcgatcatttcgttgtagacaggtgcaacgtaatactcgttgttcacgagcagttccttacgaatcatcgcgtcggctgcacgcaggaaatctccgccacgtcggaagttgtagatgccgaccgttgcctcatcggatatgacctgcttctccaccacgttggtcaccatacgtgaatcggacagaccgacgaacgaccacttcggatcgtcggcagtcatcgtcatgatcagaccatcgagattctgtcgctccatctcggctagatattcgtcgatatcgatatcgacgtattgatcgctgttggcgatcatcaacgcgtcgtcgtcaccgatgtattcacgcgcagcgagtaccgtgcaggcagcaccttgcgtcagcccgtcgagaccgacaatctcacagcccggcgcccacgccgacaacttctcgaccagcccatattgctcgatatgcgaacgctggcagacgaagataaatcgatgctcgcaggatggcttaagattattgaccactaccttgatcatcggcaccccgcgcacgggaatcaacggcttcggatcaagatatcccgctttcgcgaaacggctgccagcacctgccatcggcaccacaatattcaacatatattcttcccacgaaaattaaatttacggaaaattcccagggcgtcacccagcaacggcatcaggccgcatttctttactacacccaaaatatggtcgatacggcgaatgactgaaacagctttcctccgatgacccggcgtcggaccactgaggccaaggtcgacatcgacaagcgctgcactgcgcgatgactcgagcatgaatctccaatccgatccccagacgcaattgaagaactggtagtgcgacagtggcacgcgccggtacttgtcgaaaacaagcccgaaccgcaatacgtcgcacacgatgagtcgggttgccagataactacggtagctctcgactacctccgggcggccgtcgtccaagaaacgcggcgcgacgtagccatccttgtgagcgttctggacggcgacgtattgctccggactgaagcgactgcggtaccgccgcgcaaagtagttactgctgctgtcgtgcggaaagatgtcataccagaccgcatcctgctccgtcatcagcggcacgtcgaagtatttacgcagtacttcgctcggcccaaagaaaaccagtctgaaatatggaaggaaacccctcgattccgtctgggtgcagtgtatagatgctgctcgtgagcagtggctccgaagccgtgtcgcagatcgcgacgcgctcgtagaggtcgacgaatgcccgcgagtcgagcgtgcaatccgtacgaatcttcacggcgtaaggcgtcgctgcgagcgccagtcccgcctgcgaagaaacaatcagccggttgacgttgttcagcggcgcatgcttgtcgcgcatgtatgcaggcaacgggccagggtccggcactatcgcaagaattacgccatccgttaccgcaaagcttcgtgcatacgcacgtcgctactgccaacgacgatcggcgcgtcaggaaagcattcgcgagcccgcgcaacgttctcgcgcaacctgtcgttccatggcccctggaagacaatggttatctgattgtcggcgatgaaggtcggcttgccctcacctgcctgtgccgtcatcggtcgtcggtgcaccgcgcggtgttctacaagtggtttcccgtccagtgcgagactgccgatcgcgaccgacaacgttcggttctcatccgagccggctcgttcctgcgaaggctcgaccacaatgcgggacgagaaacccagcttactccaaggcctgttgaacttgctcccggaaatcgaaccttccaccaatacacgtccatattggtccactgactgctcggtcaatcgcacgggaaaaccgtcgataagagctgtcaattgagacaaatgccagccggccacctgaaaatgaatcaggaacgagagcgtcttcgcatcccgtggcacagcgagattcatatgagcatggcgaccaatccagcgaaatgctctgccgtcacggttatcaatttcgaccgggtagaaatttgcgtccgtgctggcgcccgtttgcagcggaaagcccttatatgggctcacgacatagtttagaagtccaatgcgctcggcacggctttcctgcgtatcgttgacatcacccactttgtaagtcgacaaactagggtgtacatccgctaggattctgagctcctcatcgtcaaacgacgcaaacagtgcatcccgatagaggataaagcagacattcaacggtcgcaccgtcaagccggccatcgccagagatctggccatgatagcctctggcacacaaatttcttcgtcgataatatcgccgagtctctcgtatgtttcggcatatcgccgaaacgccggcggcaccgcaagacagagcatgtcatttgcccccgaccagctcatctgggtcggcagcaagacttgtccttccgatggaatctcctccggaaggaattgtttctgaaaatagatgtcgaaacgaacgcgaaggacagcctggtagtcagttagacgctcaatcgcaccaaatccgtatgcgatctcgtgccacatcatgacaagtgtcgaagcgacaggcttgccctcgaagcgcgacaccgcatccgccgtcgcctgtttaggaacggtaatcgtctttaccccgggaaatgcccgcgccagactttggagcgtttcctcgctcgcgaactcctctcgaatcaccgagaagtacgacacgttccattcatcaagcatgaacttcagcgtgtcgacgcacctttcgtatccacgaggcacgcccgtcaatacgacagcaagatttctcgcatcctttccggtcgatttcacggcctcgtcacctgtagtgatcgtacgcttctgcgaccgtatcgaactcgctgaacccaccatccttcagcaccgctgcacgcccacagtaccgctcgaccagatgagggtcatgagaaaccagcacaaaggcgcatgcgccccgccgctcgaacaattcgtactcgcacttcttgtgaaatgtcgaatcgcccacggcgatgatctcgtcgatgagatagcagtcgaagtcgattgcaagtgacagcgcgaacgaaaggcgcgcgcgcatccccgaagagtagcgcttcactggctcgcggaggtacgctccaagctccgtgaagcgctcgacgaattcaaccttttcgtgaaatggcacgccgtagagccggcagatgaaacgcaaattgtccaggccggtcaaactgctttgaaaggcaccaccgaatgcgagtggccaggacacgctcatcgatcggcgcacttcaccgctagacggccgctcagcgccgctcaaaggcgcagcagcgtcgacttgccggagccgttgcggcccagaatgccaatgcgttctcctagcccgatgcgcatgctgacgtcgtggagaatgcgtcgcgctccgccacgcgtcggatagaatttcgagactgattcaagcgcaatcattcgtgctccacccttgcctctgcatgcctgcacagatatagacccgcaagcgtcagcaccatgttgacgccaatcacataaggtacgtcatagtgtgctttgacctcgctaccgaagtagccgaggcggatcaattcgatcggcgtgatcatcggcatccacagcgcgagtttttgcaggctgaaaggcagccattcaatcatgaacatagcgcccgaaagcggaaacagcaaataggcgatcggatgccagagccgctcgaccagttcagataactcacttcctgcgcccaataccagtgccaacccagcaccaaaccaggcaaggaggaaccaaccgagcattagcgaaaacagatctgctgggacatgaagcagaccgacaccgacgaacattacgatcatcaagctgaatgccgccgtcgcgccagaaagctcaagcagaatccgagcaacataaatgtcaatcaaccgaacgttgcggtgataaagcaggctcaggttcggctgaagcgcatggacacatcggcttgccgtcgtacgccagagctgcaccgacgagtatccagtgaccgcaaacccggtaatcgacaggttgcctgcgtgcgatttgaacgtgaaatgccagagcaaggtgacaccaagcgtcagaagcatcggctcgaggaacagccacaggaagccaatgttgtgtcgaccatagcgcgtgagaatctcgcgcataaggagcgagtagatagctctcccttgcagcttgagggaatggcgaagcgatggcctagtgaccgttacgtcagtcatggtgctcccgaatacccgccatcaacagacttgcgataccccacgcaatcatgctcgcgacgaaggcaatcaatacacccttcagccgacgggggcggataggcacgtcgggggtgttagggttcgcaacaacttcgatatacatctgcttgcgcaacgcttcgttgcgcgccgactcgagcgtcgccattgccgaggcaagctgcttatctgcgacgagttgctcaagctgaaggcggctatattcgccggccttcttcgtcagcgatactttgccgccagcgatttgggacatctgctcatcggactgctgctgcaatgatgctagtcgcaccgcgagagtcgatatctgcggattactcggcgcgagcgacttgagctgtgccatctgcgccttcgtctcaactatggcttcctggagcttcgacaactgctgcagttgcagtgaagactggcgctccggatcgaatacttgctgcgacgtgcggaattgcgcaagatttgacccgacagcgaccgccgccgccttagcaacattgacttcgcgctgcgccgacgcgaccagatcagactgcatgcgcgcattcatttggttaatgagacgctcggccatcgccaacagggacgcgttgatcgtgtaagcatcctgcgcagagaacgcattggcggtaagcgtcgtgatgccggaggtcgagtccacgtcgacgtcgatgcgacgggcgaagtactcgtgcagactctcgaaactattgtcgatgccaactggatcaaagcggttcacgaagtcgatattcttcgcaccgaacatacgagacacattttcccggcgctccagttgagccaatgcatcgcgtgactcgataaaatcgcgtacgacataaacattgtccgccgagcgagtcagaccagtgccttgaagaatagcgccgagcccagcctgcgaactcttgtcttgagaacgcacgacgaaacggctctcggagacgtagatatccgacgctagcacgccgaaataaatgatcgaaatcagcgtcgggatgacgacgataagaaagaacgggctcttaatcagattgccccgacggattatcaaatcttcaccttcttctttgaccttgttagcgacacgaccgccatccggcttgcatcgccacgctggaatatctctacatacaagtcgaaacaggaacgcacgcattcgatgcgccgtaccctcggcatgcagcttacgaactagcggaatgtctgcacaccggtgaccaccggatatgccacagagaacacgacattgaggaacttctggacctccgcaattggcgcgttcgacacgtagagcaagtccttattgtcgatcatgaaactctgcgccacgaagaacgagttcgggtcgcgcagattgatgcggtacaccaccgggactttgccatcggccgtcgtccgcacaggtgactgcggccagtcaagcgcctttgcactctccatacggaagataaaaaccccttgcgcgtccgagcgagaatcctgaagcccgccagagcgtgcgagcgcctgtgcgagcgtgatgccctgagcttcgaaattgacctcttcgttcttgcccgtggcgccgagcgccatgaagctataaggctggaacagcgcggtcaccacatcgccagcatgtaatggaacattttgacgtggatcacggatcacactatcgagcggcaatgacgctaccgtgttaccccgcgtgagctgcaccgtgagtttaccgaccggctggcggacaccgcccgcagaggcgagcgcgtcaagcagccgctctccgcgcgcagtcaacggcatccgcgagctgccggccacgtcacccacaactgtcacataggacgtctcattgcgcgccaatctgacgatgacttgtggatcgtgcgcttgtccacgcagaccgcgcactatgtcctgctgaagctgcatgggcgttctgcctgcggcttttacaggaccgacaaatggaacgctaatgagcccattgccatcgattatctgattcggcagcacggtgacgcgcgagcttcctgtcgcgcctttgggatcggcctccgcgcttgcgaaaagaattgcaggcggcgcctcccatatcgtcacctcaaccgtatcacccacgccgagctgctgctggaaagcggcattctcgccgaagatcgacgcgaaatccgagttacgacgctcagccaagaggcggcgcgcgacatcatccgttacatcaacgacctgaattcccgcagcagtcggattggtagcgatctggtttcgggttggaccagaggtaggaattcccgaacacccggccagagccagggcaacggcgattcccatacacgcaacaagcgaaaatttagtcggcgcgcaaaacattggcatgtagcgtttaatttgataacctcggacggggtgcgattctctcacaggattgcctcaaatagaattcaagctcgcacacctcccacgtcggactgacgctgatcacctccggctcttgacataacagacggcctttggatcagctcgcttggacgcgttctgttcgcctgcttacaaaatacgacgatgcacacagctaggtgaattgttaaataagtgatatggcccgcttttctggcggtgactgtgcgtcgtactatggccagatttacacggcaccgccctcctgcgtctttaaaagaagaccggcggccattttgacaccacacagcgcagacgcggcatggtcttctgaaaccttcaagacggatcctgtcgatcaaactaccctactcacgtgtcgccaatatttctcgatgtcagtcgccttttgacgcgcgcttacgaaaacttgcacccaactggagttgatcgcgtcggcttggcatatatacaacagtatggagaccgtgcacgagcgattgttagccgaggcggcgcatcggtaattttaccgaaaaatgctcgcaaagcattttctcacttctcgtgtcgacgcagcgtgatcggaacctgatccggaaacgtttgctttccggaattgcaacagcttttctgcaaagcgagtacgtccgcggaggtttccttctgcatacaagccataacggcatggagtttcagcgttattacaactccatgcgaaggcgcggcattcgttcggtattcatgattcacgatctgatcccactgacgcatgccgagtattgccgcccaggcgtcgatgccacgcatcgacgccgaattcacacagcactgaatcatgcagacggactaatcggcaactcccaagcgacgctcgacgacctcgcgcgagaagcccaaaaagccggcttgcccgtcccgccaagcgtagtcgctcgccttgcctcgggcgtcacgataacggctcgctcatccgcaccgctcgacgagccatatttcctgctccttggcacaatcgagccaagaaaaaccactggttcatgctgcacatctggcggcggatagtcgagacgttcggcaccgcaccgaagctcgtgatagtgggccgacgcggctgggagtgcgagaacgtcgtcgacatgctcgatcgatgcgactcgctgcgccctcatgtcatcgagcgatccgattgcagcgacgcggaactgcatggctggatacagcacgcacgcgccctgttgtttccatcgttcgtcgaaggctacggcatgccgctcgtcgaggcatttgcagcaggaacaccagtgcttgcgagcgacttgggtgtattcaaggaaatcgccggtgacactccagactatctggatccattggacggcccggcttggatcgcacgcgtcgtcgactacgcccaagcagcctctccagcccgtgacgcgcaattgagtcgcatccgccgcttcaaggaaccgacctgggccgagcactttgcctgtgtcgatagccttctggaatctctaagctgctcatgagcgactcgaaagctgattttgacttgcgatcgatcgcacgcggccgccgttcgctgcgctggctgagcggccgtacgaacatactgtggcttgatagtttcccagggcgcatcgctgctcgtatcgccgctgcattgcgcaccgacatccgggtggcttggtctggtccaatcgcggcgcggcacgagttcggtatgcctacgcttagctggatctcagtgcctgttgcggctagcacgccacgcgcattctcggcgctgctggatcgctcgctattagattcaccgtacgacgtcaatcccgatcgcaccgccgaactcaccgcgctgatgcagcaagttcgcgatctgcacgcgctcgacccgttgcaccgcttgcccacgtgccctgcaccgctgaagaccacttcaccccggatcaaagtgctcctgatcgatgagcgcgaagccgaccctcgctgcacacttacgcgccgtcggcgccgcgtcgccttccgagcactcatccaggccgccactgcaatgcatcccgacgcgacattctggctcggccgttcgtcgcaacaaggccgcggcgcgtggctgtcatcgagcgcgagcgatctcatgcctgcgggactcaatctgttgagcgaccgcgaaacgctttgtgcgacgattgatcacgtcgaccatgtgtacacggtcggcgcgcgtgaaggtatgcacgcgttgcttgccaacgtgccagtacatgtgttcggagcccctattactcgggatggggcttcacgcatgattcgctaccctccgaacctcggcgcgcacgcccgacgctggtcgcattcttcggcgcgagctttgtgcaccatgcgcactacctcgatcctgcaacgcatcgccccggaacgctcgcagctcttttgcatagcattgctatccagcgcgaagttgagacgcgcttcaatgaactcgggccgttagcgggcattcgttttcagtggtggaagcgcccttcgcaacgccttttctcaccgcaaacggacatccgctgcgctggttacgcgatgcggctgaggttgacaaacacgagtgcgcagtcatctgggggcgcgatacgaaagacttagctgacagcacacaacgagtccgcattgaagacggttttctgcattccggcggactcggctccgatatgagcccgccactcagtcaggttattgatactcgcggcctgtattttgatgcgagctgcccaagcgatctcaccgtactgttgaacgaagctgatttcgactcgatggagctggctcgcgccgccgcgattcgacagtcaattgtcgccagcggtttgacaaagtacaacctcggccgacgtcacccgtcatggcaggcaccccagaccgtctcgtaattctcgtgcctggccaagtcgctgatgatgcatcgattcgccttgggacgcgggccatgtcgaccgtcgacgacttgctacgcgaagttcgtaagctgcgtccggacgcgtggatcgtctacaaaccgcaccctgacgtgctgtccggcaaccgtaatgggctaatcgatgctgactcgcttgcggacatcgtcgatacggaatccgatttgatctcgctgatcgaagtggccactgaggtccacacgctgtcgtctctatcgggtttcgaagcacttctacgcgacaaggccgtatatacctatggcttgcctttctatgctggctggggacttacgcatgatgcgctcgcgccagtgccatggcgcgagcgcacactcacgctcgacatgcttacggcaggcgtgctgttgcgctatccgttgtattgggactggagcctacgtctgtttaccacgcccgagcgggtgatagcagaactggcgccgctcgcaatgcgtccgctcgcgtcggtgcggaacgatcatctgcgtattgcgcgtaaagccgttcgatggatgcgcaacgtagtttcgcatcttatatggcgcaaccgtcaacccggcacgcatctcgttctacgaacccgattgccgtcagcacgcagcacaaaatccatcggcgggtaacccgattcaaacgaacagccaacgatgcgcagccccaattactatcttcacgcggcgataatcggagttttggccatccgggcccggcatggttcccttccccagtcgcaaccatgatccgggcgcgtcaccgggcccgttgtatggccggtgatcgctgataggggtttggccggaatatcccgacgccgcctgtgacatggatgccgagacttgccagcgttgttgcaggccaatccgttcgctctgcataaactgctatgcaagaaacccaacgacataacgccatcgatatcttcgtcggcgtcaacgtcggtaaaggccagcaccacgctgttgcactcgatcgaaatggcaagcgtctgtgcaacaaggtgcaacccaacgacgaggtcaagctgtgagcactcagcgccgagctcaagactcacggtcgactgctgttcgtcgtcgtgcagccttccaccatcggtgcaattcctgtagttgtcgctcgagctgacggcgcactcgccccctcttccgaactggccatgcgctgcgttgcggatctgcacgcctgcgaagccaagatcgatgcccgtgatcatcgccaaaaccgctctctcaatgcgcatacgctgcacccgcctcgaccggccgatgagcaactcgccgagctcaccatgctgtgcggcttcgatgacgacctcgccgctcgggtcacgcagacccgccgccgcattcgcggcttgcctactcgaatccacccggcgcccgagcgcgttctcgggccgcgccttgacgatccagcagcctagacctgcttgagcgctactcgtccccaagtgcacttgctgctgccagcgagaaggcgcttgccaaccgcccgaccaagctcgcaccgcgcatggacaagaatttggcggccgaaatcgttcaagcgctgaacgtgcaagccgtaatcgtacccggcacgcaggccaccaccatcgtcatgcctcgcttagcccggcagcttgccgctttgcgcaagcagcgggacgaagtcgccgcctaagttgagcggctggtgctcgctcaccctctttggcagatactgatcagcatgccgggagtcggcgtcaggaccgccgccagactcctgaccgaagttgtccacaaaacctttgcttccgccgtgcatctggcggcctacgctggcctcgcgccagtaacccggcgctcgggcgcgtcgatccgtggcaaggcccatccagacggggtaacaaggtgttcaagcgagccttgttcccctctgccttcgcagacttacgagacccggtcttgggagactattacgcgcgcaagatccagcaaggcaaagcgccacaacgaggccatcatcgcactggcacggtgacgctgcgacgtcctgttccatgctgcgtttcgcccccaagtcagccccgaacgcttgacgaacgacgtagtccccgaccgctctctgcgactgcagcgacaccagactctggccgatgccacgcagcggctatctgaagcaggcagaaatacaaacttccgtccgacaaacgaccaatctcttgcaatacctcaatggcgcgatggcaccgatcatctggcaattcggcgtgcgatcttggtcgatctccgtcgccgcaaacctgacgctacgcgagacacaatgcgctacgcgtgctgccgtccgatcatctgataccgaacgaagagccttggttgccctagcgagcgccgccacccgagtgaaggttaacgcacatctagtgcccttcgtcatcagaccgatcaccgcaattgtgaccagttcgagcgtcagtcctgcgcgaccacggtacaacctgtctttagcgacaagacagtgcgattgcacaacggcagggccgacacatactgcctcgaaagcggcgccgcgggatttccgggcgacactgtaagcatcatgcgatagccgacgagagtagacggcttgcctctcagtcaaccgacactatcaggcatatcgctccgcgacacgcgcttagagctgatttgcttgaaccgaagcagcgaggtactcgcctaggcgtgccgccaacgcgacgatggtcaatgttgggccatgcccccagcacgcggcatcacgctcgacccggcgacatagacgttgcgcgttccgatcaccctcatatcccggtcgacgacgccgttcggcccgtcagaacagttcattgtgccgctcagatgatgtgagttatagccggcccggtatttcggattgacgcccactacttcgataccaagtgcggtgagttttctacatatctggcccgtgacatcgtcgaacgcctcgatgactttcacataatcgtcatcaagaattctgggttcatcactatccagatccacgcgaaacccagctgtcggtggaatctcgagttcgcaaaagatcgcgaaacagcccgcgacatcgcgcatgaatgcatcactacctcgtgcgcgaagcacagcggggttgagccccgcctcaaaagcctctggcggcggttcgtgcgtcagggcgaatgcacttgcttcgatcgggccaaacgcgctcgggtaataagtcgatatttcaggcacgtggacgtgtgccagtccaccgaggttgccatacgcgagtggctgatccaacttgcaatgtaaatcgaggtgtccgtgatcctgatagaagcgtccgatcgactcgcgccgcaccccttctggcaactcactgcgaccaaagagacgaggcgtttctactccgttcgcagccaccacgagacaatcaaattcaatctggaatatctgctttccgtcgtagcattcgatcgctttcgcaacgtccccgtcgaatagaatgctcattgcgaacgcgccatagagcgtatcgtgttcgcgaaagacattgtccggacgaatcttcgcgtcttcgcgacaaatcgtgcattgcgagcggcctttgcactgccccgccgccgagccctcaggcacacgattgagcgcgacattggatagccgtgctagtgggaaatacggcttgtacgcatcgcgccagtactgcgcgccaggcatcgacgtgaatgggcgctcgatcggattatctggatcccccgccacacgtagcagctgttcggcctgttcataccacggtgtgagctcgtcataggatatgggccacgagactgggccatcctgctcaaaggtttcaggtgaacaacgacgcgtgttcccccaccagttggaagtgccgcctcgcaccatcgagtacttcgaataattccaacgtgacaattgcggtcgcacgttccaaggaaatcacttccgtaggcataatcctccgcagcatgaaaatccctgtcgctcgcatcttctcttcaaagcgagcgtacatctgaccataatcacgatcttcgccgcgctcgacgatcagataggatcccttagacaatttatccgcgacagttcgaccagcaaagccagagccgataataaccgtttgatacttcagaatttgcatgcttagatttcaacgaaacggggacgtgagatggcgcaggagaggcgccgctgatcgttcgacccggcgtacaacaaggctggcacccctgcaatacggcattcgaagtcgatccgcacgcgttccgccattttgaaataggccagaaccggtggggaaatgtctgcaacaatgcgcgcgcgcccatgacggtcagcctcgtcacggactagcgacatcggaatatcgccgacccagacgcgcaaatccatcaacgcttcgggtaggatggcgaacggtacgataaattccagtcggcaacgactggcaggcggctcgagataaagccatgcacgcttagcaaagaagcggaaattgagcccgtcgcgctcgtcggtttcctcgccgtaccaggcatcgcaatcaaccggcacattgaactgtgcgggcaccggtgctgaaaacggtttggcgacggctgattgtgccgaataccatccgctttgtccgacttgcatgctgttaccgcctcgaagataaatcaaattcggcagcacaaagcgcttgagcaattcatctcgcagcagtcgttcacttgtcgcaaacatcccaatgacttgttccaccccattgattcgaacgtcattcatttcttttctctattgcacttttgggaagtcacgcgcattccttacttcggcagcggacgacattcttccccgtgttgatcacgccgagggtcagcgctccccaagtcccgtgatgcttccgccccctggccaaaagacgcctgccgccctgatgacaacgccgcggcacgatgtgcgacgatagcgccattggttagcgcatagaacccatattgcgcgttgcccgttgcgcgtgcgccgttggcgacgatcgttccgcccgagagcgccgtgaagcccgcaagcgcattgttctgcgcacttgcaccggatgcgtccagcgttccgccgtattcggcaacgtagccgcttccgagtgcaagcttcgtgtcgtgcgtgtccacggccgatgactcttgcgcctcgatatgcccaccgttatatgcgaagaaccctgcatctcctgcgtgacgcacctgcaccgctcgcgcgcgaattacaccgccgtagcgcgcctgcgctccatagtagaaaccgtcgacgaccacggctggcccgacctgcaagacgcccgcattttcggccagcagtccgctcgcgttgtcgcgcgctccattgtcattgccaccaggaatttcacgcagaatcgtcaccccgtccagacgcccaagagcgccgcctgtcccgacataaacgccgtctgtcttcgatggccagacgaggcgcaccttctccggcgcactagtgttgccaacgatttgaatgcgtacaccatcgggatgatcaacgcgcaacgtacgatcgatcttgtatgttccatcttcgaggtgaatctgcaccgcagccccggaagaatccgccattgcgcgatcccgtcgatggccgattcaagcgcattttcacggtcgggatggatcgtgatcgtctcgacgtgacccggaagaatcgttctcgtgcgtccaagcattgaggcatctgcgaacgctttgttcgcaagactgctcgtcaatgcaacgatggcaaggatgccggggatacttcgataaattaatgatgtgggattcatttttgggcgacgcctatgtcgcgaagcattgcgcagaacacctgatgtcgaccgaattccgcaagcgcgatacacgccactcgcgaacctcttagaaatacaccgactcgcttcttattcgcacagcgagttctaagttcttcacaatataaagggtattgcgtatatcgactctgtttggcgtgccacctcactcgatctccgccaaacctttcgacgctcgccttgcttcaaaaattatgctgtactggcggaaatcagttcagctcagcttggtttggtgctcacgtagttcactcaatacaaccggccttggataagcactggtcgggctacatcagatacaccagcatcgtgcccgccgtgactcagctacggcaattatgcgattgctcgtcctgatccaacgcaggctcactttatgcacgatacgccccgcatcggcaccagacccgccccagcaacgaatcgagtccgggtatccgaataccatcggcacacccttcattgcctctgaactgaaccgccaacaactcgactcagggaatctacccaagcaatttcactgtgtgattcagactacgctcacctccggccaacgactgtggtgccgcaccgtgctaggttacagatgaaagaccacagatttcgaatatttcaaagattttacacatgctttcagcatctgtctttcaagatcgtcatttccagtcaaaaataacatgctgcatgactggccccgcccatcggggcgcctcgacttgtccgtcggatcacgaaatcattgctctgtaaaatctcgtaataatcagatcatttgccgcaccaaactcgtccattcagtcactttgaagcctcgggctccttcctgtcaggacgacaaaaagcctcgtaaaatttagtaacaatttaggcgttcctcatgcttcactttccccattcaagtcgcctccccctcacccccgcctgataggacgcgaagaaatacttcgtaaaatgtcgtaataatcagagcattttccacactaaactcgtcctttccccggagcctccaatgatcgatctcgccaccgcccagcaattcctgatgacccgcggcctcgacttcggcctcaacctcctcgccgcgatcgtcttgtggttcgtcggccgctgggcgatccgcatcggtacccgcctgctcggcaaggtcgtgcgccgcagcggcaaggtcgacccgacactcaccgactacctgacctccgtcgtcggcgtgctgctgacgatcctgctgatcctcgcgatcctgcagatcttcggcgtgcagaccacctcgttcgccgcgctgctcgccggcctcggcctcgcgatcggtaccgcctggggcggcctgctcgcgcatttcgccgccggcgtgttcatgcaggtgctgcgtccgttcaagatcggcgacgtgatcagcgcgggcggcgtcacgggcacggtcaaggagctcggcctgttcggcacgacgatcgtcacgccggacaacatcgtgacgatcgtcggcaacaacaagatcttctcggacaacatcgccaactacagcgcaacgtcgtatcgtcgcgtcgacctgaccgcgaagatcgcgaacggcgtcgatgcggtcgacgcgatcaaccgcctgaaagcgtcgatccagcagatcccgaacgtgctgaccaacccggcaccggacgtcggcgtgctgcagttcacgccggaaggcccgctgctgttcgtgcgcccgtccacgcaaccggaaaactactggcaggtgtactgcgacaccaaccgcgtgatcctcgaaacgttccgcgacgcgcaatacccgacgcccgaaacgccgctcttgcatcgcagcgcatgacggcggcaccggacgaaaaagcgtggcacccgccacgctttttattgcctgaaaccgaagcgtccgggcttaccgcccgcccgtcttctgcgcgttatccgactgcttcccgcgcaccagcttccacaccgcgccgagcgcgaccggcacgatcgccgcaccgataccgaccagcacgatcacgttcaggtactggcggatgaacgggatgttgccgaagaaatacccgagcagcacgagcagcagcacccacaccagcgcgccgatcacgttgaagagctggaagcgcgcgacgctcatcgacgacgcgcccgcgacgaacggcgcgaacgtacgcacgaccgggatgaagcgcgcgagcacgatcgtcttgccgccgtgcttgtcgtagaacgagtgggtcttctgcagcgcggcgcggtcaaggaagcgctcgagcaccgggatatgcgtattgaacaccttcgggccgacccagcggccgatcaggtagttcacggtgttgccggcgatcgccgcgacgagcagcagcacgatcagcgcgccgacgttcatttcgcccgtcgccgcgaacgcgccgccgatgaacagcagcgaatcgcccggcaggaacgggaacacgacgagccccgtctcgcagaacacgatcaggaacagcacgagatagacccacgcgccgtactgccggatgaaatcgccgaggaaggcgtcgatatgcaggacaaggttgacgaaatgaagcagcgtatccaaatgcgattcctcgaaggcgatagggccggaacggccgaaacaggccagacttggcggaagcgcccgccggccaaggcggcgcgcgaaacggagccatgataccgaaactaccttaaggctccgtgaaaaacgtaacgctccgccgccccggcacgcatccgccgcctcgctataattcggccatgtccgaaatcaccgaaacggccgcgggcgacacgcccgcccctgctccgcgcccgctgcgcgcgatccagcccctgcccgaccagctgatcagccagatcgccgctggcgaggtcgtcgaacgtccggcgtcggtcgtcaaggagctgctagagaacgcgatggacgccggcgccacgacgctgcgcatcgtgctggaagaaggcggcgtcaagcgcatctcgatcaccgacgacggctgcgggattccgcccgacgagctggcgctcgcgctgatgcgccatgcgaccagcaagatccgctcgctcgaggagctcgaggcggttgccacgctgggtttccgcggcgaagcgctcgcgtcgatcgcgtcggtggccgagatgtcgatcacgagccggacggccgatgccgcgcatgcgataaagatcgacgcgcagacgggcgtgctgtcgcccgccgccggcgcgaccggcacgacgatcgaggtgcgcgagctgtacttcaacacgcccgcgcggcgcaagttcctgaagagcgagcagaccgagttcggccactgcctggaaatgatccgccgcgcggctcgcgcggccggacgtcgcgatctcggtgctgcacaacggcaaggccgtcgagcactggaacgcgaccgagcccgcgcagcgcgtcgcgaagatcctcggcgacggcttcgcgaccgcgcacctgccgctcgacgagcaggccggcccgctcgccgtctacggctgcgcaggcctgccgaccgcaagccgcgggcgcgccgaccagcaatacttcttcgtgaacggccgcttcgtgcgcgacaagctgctgacgcacgcggtgcgcgcggcctatgaggacgtgctgcacggcgaccgctacccgtcgtacgtgctgtttctcgacctgccgccggaagccgtcgacgtgaacgtgcatccgtcgaagatcgaagtgcggttccgcgattcgcgctcgatccaccagtacgtgttccatgcggtccagcgcgcgctcgcgcgccatgcgggcgcgtcgccggaaaccacggcgggcggccatgccgcgcatatcgaaccggctccgcgcgggccgtcgtcgttcctggacacgccgctcgggcagagccagggccacgcgaccggcagcatgggtggcacgggcggcagcggcttctcgtcgccgtcgtcctcgtcggcaggcaacacctggatgcgccaggcgcggatgacgcagggcacgctgcccgtcgcgcagccgctcgcgctctacgacgcgatgttcggccgcaaggatagcggcgccggcacaccggacggcacgaccgccatcgcgcgcgattcggccgacacgccgctcgcaccgctgcccggcttcgccgtatcgccgatcgccgccaccgcgcacgacgagcagccgctcggcttcgcgctcggccagatccacggtatttacgtgctcgcgcagaacgcgcacgggctcgtgatcgtcgacatgcacgcggcacacgagcggatcctgtacgaacagttcaagaatgcgctcgccgaccgctcggtcgccgtgcaggcgctgctgctgccgatctcgatgacggccacgccggtcgaaatcggcacggtcgaggaagagcgcgacacgctcgaatcgctcggcttcgacctggcggtgctgtcgccgacgacgctcgcgatccgcgcggtcccggcgctgctgaaggatgccgacctgcagtcgctcgcgcgcgcggtgctcgccgacctgcacgcgttcggcggctcgcgcgtgcttaccgagcgccagcacgagctgctcggcacgctcgcctgccaccacgcggtgcgcgcgaaccggcgcctgacgctcgacgagatgaacgcgttgctgcggcagatggaggcgaccgaacgcgcggaccagtgcaatcacggccggccgacgtggtatcagctcacgctgaacgatctcgaccgcctgttcatgcgcggacaatgagcgcttcaccgcagacctctccgacgacgatcgcctgcctgctcggccccaccgcctcgggcaagacggccgcggcgctggcactcgccgcgcgccgcccgatcgagatcgtcagcgtcgattcggcgctcgtctaccgcgacatggatatcggcaccgcgaagccttcgcgtgaagagcgcgcgagcgtgccgcaccacctgatcgacatcatcgatccggccgacgcgtattcggccgcgagtttccgcaccgacacgctgcgcctgatcggcgagatcgccgcgcgcggccgcacgccgctgctcgcgggcggcacgatgctgtactacaaggcactgacgcaggggctcaacgacctgcccggcgccgatccggacgtgcgcgcgactctcgatgcggaagccgcacgcgatggctggcccgccctgcacgcgcgactcgcgcaggtcgatcccgacacggccgcgcggctcgcgccgaacgattcgcaacggatccagcgggcgctcgaagtgttcatgctgagtgggcagccgatgtcggtgctgctcgccgccccgcgacgcaacgacgatgcggccgccgcttaccgcttcgtgccggtcgcgctcgaaccgtccgatcgcgcggtactgcacgcacggatcgcgcagcgcttcgatgcgatgctcgacgcgggtttcatcgacgaagtcgagcggctgcgccgtcgcgaggatctccatcccgacctgccgtcgatgcgctgcgtcggctaccggcaggcatgggaattcctcgacggcgacaccgactaccggacgatgcgcgacaagggcatcttcgcgacgcgccagctctgcaagcgccagatcacctggctgcgcgcgatgccggagcggatcgtcgtcgactgcatcgcgccggacgccacggcccgcgcgctcgacgcgctcgaacgcgtgctcgacggcggcacgccggcctgaccgtcagccgcgcccgcgtgctgccaggcgcgcgcgggcgccgtcgacgaccagcgcgacgccgcgctcgaacgcttcgtcgccgccgcgcgcagcgcggcccagcccttggcgagcaacggaaactcggccgcgtccggcagcggcgcatcggcctcgccttcgggttccgcctgttcctccagcacccatccaaccacgaagcggcccagcgcatacatcacgtcgaccgcctcgtccggcgcgaaacccgcttcgccgagcagcgcgaccttgcgttcgatcgagctgaaatgcagcgcccgcggccgggtaccggcatgcaggcgcgcgccgtcgcgataggccagcagcgcgcggcggaaactgagcgcgttgtcgagaagccacgcatcccacgcctcgcccggccgcggcagcgacgcatcgtgccgctcgagcatgatcgcctcggccatcgcgtcgagcagttcggccttgttccggaaatgccaataaagcgtcggtgactgcacgccgagccgctcggcgagccgccgcgtcgacagcccatcgatgccgacttcgtcgagcaggtcgagcgccgcgcgcagtaccgtgtcgcgcgtcagtcgcgcccctgtgtccttcatctctatcaccgataggaaagctgtggaataatcgccactctatcaccgatagagtcacacccttgaacccgtccctgattgccattctggccacggtcctgctcgacgcgatcggcgtcgggatcgtgatgccgatcctccccggcctgctgcgctcgctcgccgatgcgggcagcaccgacacccgctacgggatcctgctcgcgctctacgcgttcgcgcagttcctgtgtgcgccgctgctcggcgcgctgagcgaccgcgtcggccgccggcccgtactgctcgtgtcgctcgcgggcgccgcgctcgactacctgctgatggcgctcgcgccgacgctcgcctggctctacgtcgggcggctgatcgcgggcatcaccggcgcgaacgtcgcggtcgcgactgcatacgtgaccgacgtcacggccgaacccgaccgcgcgcgacgcttcggccagctcggcgcgatgatgggcatcggcttcatcgcgggcccgttgatcggcggcctgctcggcgcgctccatgtgcgcgcgccgttcgtcgcggccgccgtgctcaacgcgctcaatctcgtgctcgtctggcgcgcgctgccggaatcgcggccgcgttcggcccgcgaaggtcggacggccggcgcgctcaacccgttcgccagcctgcgccggctgaccggctcaccggcgctcgtgccgctgatcggcatttacgtgatcgtggcgctggtgtcgcaggcgcccgccacgctgtggatcctgtacggccaggaacatttcgggtggtcgacaccgatcgccggactgtcgctggccggctacggcgcgtgtcacgcgctcgcgcaggctttcgcgatcgggccgctgatcgcgcggctcggcgagcgccgcgcgctcgcactgggcctcgcgggcgacgcgctcgggctcgtggcgattgcgttcgcgaccgccgcgtgggtgccgttcgcgctgctgccgctgttcgcggcgggcggcatgacgctgccggcgctgcaggcgatgctcgcgcggcaggtcgacgatgcgcgccagggtgaactgcaaggcgcgctcgcgagcgtggcgagcctgatcggtgtcgcggggccactggtcgtcaccgcaacctatgcggcgacacgcgcgacctggccggggctcgtctgggccgcggccgcgctgctttatctgctcgtcccgccgttgctggccggtgcccggccagcgggcgcggcgcggccgtccgcctgagcgccggccggcaccgtcacgcccgccgccgtgctcaatgcgcgagcgtcacgagattagcatcgcggacgagctgccagcggccgtcggccttgcggaagatcgtcagcgtatggcccgaacggcggatcgtctcgccgcccggcggagtcgcctcgatctcgatgaaattgcgcatgtacgcccagtcgcccagcacgcgcagttcgtcgatccggtaacggccgtcgatcgtcggcgcgggcccgccccggcgttcgcgtcacgcgatgcggccgcaaacgccgccttgtcgaacggcggcctgccggccaccatgaagatcgcgtcgtcggcgatcaggtcgagcacggtcgtcaggtcgccgcggcggctcgatacgaaccagttgtccacgagctcacggatcgcgcgttcgtcttcggtcatcgtcgctcctccttcgtcggcgcgcgcccgtacgccgcgcggcgccgaaaaagccgcccggatcgactccgggcggctttcctgctgcatctgctgcggccgtgcgtcagaccacgacggtctgcgcctcgccttcgcgggtcgcacggacggtgccgatcttccacacctgttcgccggcggcggtcaggtcggcgatcgctgcgtcggcatcggccgccgaaacgatcacggccatgccgatcccgcagttgaacacgcggtgcatttccgcgtcggcaacgccgccgtgctcctgcagccacttgaacagcggcggcagcggccacgcgttctggtcgagctcggcggtgaggccttcgcgcagcacgcgcggaatgttctcgacgaggccgccgccggtgatgtgcgccatgcccttcaccgacagtttctgcatcagcgcgagcagcggcttcacgtagatgcgcgtgggtgccatcagcgcgtcggcgagcgagcggccgtggaaatcggccgacaggtcggggttcgcgcgctcgatgatcttgcgcacgagcgagaagccgttcgagtggatgccgctcgatgcgaggcccagcaccacgtcgccctcggcgatcgtgctgccgtcgatgatcttgctcttctcgaccgcgccgaccgcgaagccggccaggtcgtattcgccgtccgggtacatgcccggcatttcggccgtttcaccgccgatcagcgcgcagccggacagttcgcaaccctgcgcgatgcccttgacgaccgttgccgcggtatcgacgtcgagcttgccgcacgcgaagtagtcgaggaagaacagcggctcggcgccctgcacgaggatgtcgttcacgctcatcgcgacgagatcctggccgacggtgtcgtgtttgttcagatgaaaggccagcttgagcttggtgcccacgccgtcggtgcccgacacgagcacgggctccttgtacttcttcggtacttcgaacagcgcgccgaacccgccgatgccgccgagcacgccgtcgcgcagggttttcttcgcaaaaggcttgatcttgtcgatgagcgcgtcgcccgcgtcgatgtcgacgcctgcgtcgcgataggacagaccttgggcgtcgggagcggatttcggaggattcatggggaatgcgagaaggtcggtaaaatgcgattttacccgaagccggcccgttggccggaattcccagcaccgaatcgtcagggattgcatcttggtcaacacgtccccgttttcatcgccgagcgaaccgcgccgaaaccggcgtggcgccgtgcgtgcgggcgcgcgtgaagcccgcgaaggcgcagttcccggcgcgtgcccggcgtacggcacgcgtattttcaaccgacccgcattgtgactgttgtgtcccgtcaactgacgctcgatctcggcacgccgccgcccgccacgttcgacaacttcatcatgaacgaggagaacgacgagctcatctcgcgcctgcagaagctcgacctcgcgctcgcggcgggccccgtgccggaccggtcgttctatatctggggcgagcccggatgcggccgcacccatctgctgcaggcgctcgtgagcgacgcctcgtacggctatgcgcgttatctcacaccgcaaagcccgctcggcgcgttcacgttcgacccgcgcatcggcatctatgcgatcgacgactgcgaccggatgagcgacacgcagcaggtcgcactgttcaacctgttcaacgaagtgcgcgcgcacccgtcgagcgcgttcgtcgcggccggccccgcggcgccgctcgcgctcgacgtgcgcgaggatctccgcacgcgcctcggctggggctcgtgttccacctgtcgccgccgtccgatgccggcaagatcgccgtgctcaagctcgcggcgaaggaacgcgggatcgcgctcaccgacgacatcgccgcctacctgctgacccatttccgccgcgacatgccgagcctgatggcgctgctcgacgcgctcgaccgcttctcgctcgagcagaaacgcgccgtcacgctgccgttgctgcgccgcatgctggcgcgtcccggcgacgacatcaccccaccgggcacgggcccgaaccgcttcgagtaaaatgcgcttccatgactaatctggcactctttgacctcgatcacacgctgatcccgaccgatagcgaccacgaatggggccgcttcatggtgaagctcggcatcgtcgacgcggaaagcttctcgcgtcagaacgaccagttcttcgccgactacaaggccggcaagctcgacatccacgcgtacctcacggcgatgctcacgccgctcgcgaagtattcgcgtgcgcagctcgcgcaatggcacgagcagtacatgcacgaggtgatccgacccgcaatgacgcccgccgcgctcgaactcgtgcgcaagcacctcgatgcaggcgacctgtgctgcgtcgtgacggcgaccaacgaattcatcacgcgcccgatcgccaccgcgttcggcgtcgacacgctgatcgcctgcgaggtcgagacgaccgacgggcatcccgattcgccgtacacgggccggccgaccggcacgccgagctatcgcgaaggcaagatcgtgcggaccgaagcgtggctcgcgtcgctcggcaagcaatggagcgacttcacgcacacctacttctacagcgactcgcacaacgacatcccgttgctcgagaaagtcaccgacccgatcgcgaccaaccctgacgacacgctgcgcgcgcatgcaagcaaccgcggctggcgcatcctcgatctcttctgaacgtcgtgatcaaaaattcattcgcaaactgctcggccaggacgaaaccgagcaaaccactcccgcagcggccccggccgacgaagcggccctgctaccccgcgtgccccgaaaggcgcccgcggcggcacgaaaaagccgcgcagcaaccatgagccgaccgtcgtgccggccagcgtgcacggcatcaacccggcgctgatctcgaagaatgccgtgcgcgtgaccgacacgctgcagcaggcgggcttccgcgccttcatcgtcggcggtgcggtacgcgacctgctgctcggcatcgcgccgaaggacttcgacgtcgcgactgatgcgacgcccaccgaggtgcagcgcctgttccgccgcgcgcgcctgatcggccgccgcttccagatcgtccacgtgcagttcggccaggagctgatcgaggtgtcgacgttccgcgcgctggtcgatgcgccgcccgaggcggccgctgccgagccgccgaagcgcctgaagcgcgacgaactcgatcgccgcacccatgcggtcgacgcgagcggccgcgtgctgcgcgacaacgtgtggggcgagcagcacgaagacgccgcacgccgcgacttcacgatcaacgcgatgtactacgatccgtcgacgcagacggtgctcgactaccacgacgggatggccgacgtgcgcgcccgcctgttgcgaatgatcggcgatccggccacgcgtttccgcgaggatccggtgcggatgctgcgcgtcgtgcgcttcgcggcgaagctcggtttcgagatcgagccgcacacgcgcgagccgatcaacgcgctcgccgacctgatcaacaacgtgccggccgcgcgcctgttcgacgaaatgctgaagctgctgctgtcgggccacgcgctcgcgtgcctgcagcggctgcgcaaggaaggcctgcaccacgggctgctgccgctgctcgacgtcgtgctcgaacagccgcagggcgagaagttcatcacgctcgcgctgaacaacaccgatgcacgcgtgcgcgccggcaagacggtttcccgggcttcctgttcgcgacgctgctgtggcacgacatgcgccagcgcttcgagcaatacacggccgaaggcgaaatcccggtgccggcgctccatcgcgcgatggacgacgtgctcgacatgcagaccgagaaactcgcgatccacaagcgctactcggccgacatgcgcgagatctggggcctgcagctgcgcctcgagaaacgctcgggccgcagcgcgatgaggctgctggaacaccaaaggtttagagcggggtatgatttcctcctgttacgctgcgaatccggcgagctcgatgcggaagtcggacagtggtggacggatttcatcgaaggcgacgcggccgctcgcgaggcattgctcacgcagggcggctcgaaggaaaaatcgccccgcaagcggcgccgccgcggcggtgcgcgaaaccgcaagccgggtgaaggtgccgccgagcaggcaccggacacctcgggcggttccgacgactgacgcgcacgacggcgaacgacgtaggaagtgatgccatgacggttgcatatatcggactgggggcgaatctcggcgatgcgcgccagaccctgaaggacgcggtggtgtgcctcgcgcagcagcgcaccatctcgatcctcggcaaatcgagcctgtatcgcacggcgcccttcgaagcgggcggcgacgactactacaactgcgtcgtcaagctcgacacgacgctgtcggcgcgcgagctgctcgcgctctgccagaagatcgaacatcacttcggccgcgagcgcccgtatcgcaacgcgccgcgcacgctcgacctcgacatcctgctgttcggcgccgactcgatcgacgaacccgacctgatcgtcccgcacccgcgcctcaccgatcgcgcgttcgcgctcgtgccgctcgtggagatcgagcccgcactcgacattccgcgcgcggccgtgccgataccttcctcgccgccgtcgcggatcagcgtgtcgagaaggtgcagacctgccagtgcctgatgcagaaggcgctcgccgccagcgaagacgccgacaagaaccgctgccgatgaccccgacacccctcaccgtcactgcgcccgacctgcgcgccccgcaccgctatctcgtgatcgaaggcccgatcggcgtcggcaagacgacgctcgcgcgcctgctcgccgaacgctggtcgatgcagacgctgctcgagcgcccgcaggacaacccgttcctcgaacgcttctatcgcgataccgcgcgctacgcgctgcccgtgcagctgtcgttcgcgctgcagcgtgcgcagcaggcacgcgagctgatcggtgcgctcgaaacgggccgcccggtcatcgccgatttcatgccgcagaaaaacgacatcttcgcgcggctgaacctgccggaagacgagtggcagctctaccgttcggtcgccacgcacgtggacgtgccgcaggcgccgtcgcccgacctcgtcgtctacctgcaggcgagccccgaagtgctgttctcgcgcatccagaagcgcgggctgccgatggagctgcagatcagcgacgcgtacctgcgctcgctcgtcgacgcgtacaacgaattcttctaccactacgaccgcacgccggtgctgacggtcgccgcggaacacctgaacccgcaggattccccgaagatctcgccctgctggtcgagcgcatcgagacgatgcgcggccgcaaggaattcttcgtcaagggcgagacgacgcgctgacgcgtcctcgcctgtcgttcctcatccattcgaaccggatttcccatgacctatctccaggaatcgagccggcctgccgtcacggtgcccaagctgcaggcaatgcgcgtcgccggcgagaagatcgcgatgctcacctgctacgacgcgagctttgccgccctgctcgaccgttcgggcgtcgacgtgctgctgatcggcgattcgctcggcaacgtgctgcagggccaaacgaccacgctgcccgtgtcgctcgacgacatcgcgtatcacaccgcctgtgtcgcccgcgcgcagccgcgcgcgctggtcgtcgccgatctgccgttcggcacgtacggtacgccggccgaggcgttcgcgagtgccgtcaagctgatgcgtgccggtgcgcagatggtcaagctcgaaggcggcgaatggctcgccgagacgatccgcttcctcgtcgagcgcgcggtgcccgtatgcgcgcacgtgggcctcacgccgcaatcggtgcacgcgttcggcggcttcaaggtgcaaggcaagaccgaagccggtgctgcccagttgctgcgcgacgcgcgcgcgatcgaggatgcgggcgcgcagctcgtcgtgctcgaagccgtgccgacgctcgtcgcctccgaagtcacgcacatgctcaagattccgacgatcggcatcggcgcgggcgtcgactgctcgggccaggtgctcgtgctgcacgacatgctcggcgtgttccccggcaagcggccgcgcttcgtgaaggatttcatgcagggtcagccgaacatccaggcggccgtcgaagcgtacgtgcacgcggtgaaggatggttcgttccctggcccggaacattcgttctgacgtccgaggcggggcctgcggcgcgtgtgccgatgcctcgatgtaaaaagcgcggcgccctttgcggggcgccgcgcttttctttcatacgctgcaagttgccggctaccggttacttcagtaccgcgtcgagcgcgccgcgcaacgcgttggtcagcagcagcgcctccgcacgcgcgagatcgtcgcgggtcacgacccgctccgtcgcgccgaacacacgatcgtcgagcaacacgccacgcatcacccccggcagcacgccggattcgagcggcggcgttacccactggccgtcgagcttcacgaacacgttcgagcgcccgccttccgtcacctcgccgcgctcgttgacgaacagcatgtcgaagcacccgagcgcctccgccgcctgccacgcgcgatcgtattcggcgcggcgcgtcgtcttgtgcagcagcagcgcatcgctcgcacgggtcgatgcgaagccgtgcgcggacgccagcaacacgccgaccggccccgccggcaatggcttgagcggtgccgcgacgatctcgatcgtgccgtccttcgcgagcgcgagcttcatccggtaggcgtcgtcgccgtcgagcgccgcgcagcgcgcgtcgatctcgcgacgtagcgcctcggggtcgaagcggaagccgaacgcatccgcgctacgctgcagccgcgcgagatgacgatcgaggtgccggatgccgtccgcacgcgtggcggcggtcgtttcgaacagctggaagccgggatcggcatccgtcaggaatcgtgctttcaattcgcactccgcatattcgtcggccgcgacactgtcgagcacgatgcccgcgccgacccccatcgtgccacggcgccggccggcgattggcgttgccggattgcgtgcttcggcaccggtcgcaccttcaccggtagcatcaagcgtcagcgtccggatcgcgaccgacaggcaaaaatcgccacaaccggccaggcgctcacccggcgcgtcggaatcggcgccttgcttcgcggcgtcaagccagccgatcgcgcccgtatagaggccgcgcggtgtcgactcgatcgcatcgatcaactgcatcgtcttgtacttcggcgcgcccgtgatcgatccgcacggaaacagcgcacgcagcatctgcgcgaacgtcgtcccttcgcgccagccggcctcgaccgtcgacgtcatctgccacaccgacgcatacggctcgacggagaacagcgccggcacgcgaaccgtcccggtgcgcgcgatccgcgatacgtcgttgcgcagcaggtcgacgatcatcacgttttccgcgcggttcttcggatcgttcgcgaggaacgcggccgccgccgcatcgtcgcgagggtcggccgaacggggtgcggtgcccttcatcggccgcgcgcgcagcacgtcgccgtgcttctcgacgaacagctcgggcgaacacgacacgacccacgaaccgtcgggcaacgcgaccagcgcgccgtagcgcaccggctggcgcgcacgcagccgccggtacagcgcgagcggcgtgccgaacacgtcgaagttcagccggtacgtgtagttgacctgatacgaatcgcccgcgcgcagcgcgtcgtgcaccgcggcgatcgccgcatcgaacgcatcgcgcgacacgctcttcgcgacatgcgcgacacccgcgatcgacggcgcgtcgctgccgccgtcctgccgcgcgagccacgcgtcgacttcgtcgcgcgacaggcgttcgcagcgcgcatacagcaaaagcgcagcggggcatggcccggctgcgcccgttgcaggttgcgtccgaattcgtaatcgccgacgacgaccgcatgcagcccgtcgcgcaggtcctgcgccaccgccgcatcgactgcgtcgagccgcgccggatccgtgcacacgcgttcgcgcacgaatcccgaatacaaacgactcgaccgcgcggacgcggtcgagtcgcaatcgtccaagagcgcgaacgacgcgctctcgttgccttcagtcatgctgttactcgagttactcgaagaagctcttcacacggtcgaaccagctcttgctctgcgggctgtgacgcgcgccgccctcggccagcgacttctcgaactgcttgagcaggtcgcgctggttgtcggtcagcttcacgggcgtctcgacctgcacgtgcacgtacagatcgcccgcgatgctcgaacgcagccccttgatgcccttgccgcgcagccggaacgtcttgcccgactgcgtgccttccggcaccgggaacgatgcgcggccggccagcgtcggcacctcgatctcgccgccgagcgcggcggtcgtgaacgggatcggcatctggcagtggagatcgtcgccgtcgcgctcgaacaccgagtgcggcttgatgtggatctcgacgtacaggtcgcccggcggcccgccgttgatgcccggctcgccgttgccggccgagcggatgcgcatccgtcgtcgatcccggccgggatcttcacttcgagcgtcttggtttccttcaccttgcccgacccgtggcaatgcacgcacggctccgggatgtaggtgcccgtgccgtggcacttcgggcaggtctgctggatgctgaagaagccctgcgacatgcgcaccgtgccctggccatgacaggtcgggcaggtttccggcttcgtgccgggcttcgcacccgacccgtggcagacctcgcacgacacccagctcggcacgcggatctgcgtgtcgtagccgtgggcggcctgctcgagcgtgatttccatgctgtagcgcaggtcggcaccgcgatacacctgcgggccgccacggccgccgcgcgcggcgccgcccgcggcctggccgaagatgtcgccgaagatgtcgccaaacgcatccgcgaagccgccgaagccctgtgcgcccgcaccgcccatgttcggatcgacgcccgcatggccgtactggtcgtacgcggcccgcttctggctgtccgagagcatttcgtaggcttccttcacctccttgaaatgctcttccgcatccttgttgtccggattgcggtcagggtgatacttcatcgcaagcttgcgatatgccttcttgatttcgtcgtcgctcgcattcttcgcgacgcccagaacctcgtagtaatcccgtttcgccatatcgattcactgtgccgccacgcatcgcgcacgcggcggctcctttcgcccgcagtaaagtctctcgactcgtctggcgctgcgcccgtccgcggacggctcgtgcagcacccgccaaaaacaaatgtgcccggagggccgcaaagcccgccaggcgtggagtcgatccggccatccggaaggaaagacagaccgcttgtcagccagcccgtcagccgcgccgcgcgcgtgttgcgcgcgcggcgtgcggcaccggggcaacccggcttagtccttcttcacttccttgaactcggcgtcgacgacatcgtcggcagcctgttgcgcgccgcccgcgtgggccgcaccttccgctgcacccgctgcgccggccgcacccgcttgctgggcctgcatgtcggcgtacatcttttcgccgagcttctgcgaaaccttgccgagttcctcgaccttcgcgtcgatcgcagccttgtcggccgacgtgtccttcagcacttcctcgagcgacttcagcgacgcttcgatcgcctccttctcgcccgcgtccagcttgtcgccgtactcggtcagcgccttcttcgtgctgtggaccagcgcatcgccctggttgcgcgaatcggccagctcgcgcagcttgtgatcttccgctgcgttcgcttccgcgtccttgatcatctggtcgatttcagcctcggacagacccgagttcgccttgatcgtgatcttgttttccttgccggtcgccttgtccttcgcgccgacgtgcaggatgccgttcgcgtcgatgtcgaaggtcacttcgatctgcggcacgccgcgcggtgcgggcgggatgccttcgaggttgaactcgccgagcagcttgttgccggctgccatttcgcgttcgccctggaacaccttgatcgtcacggcgccctggttgtcgtccgccgtcgaatacacttgcgcgtgcttcgtcgggatcgtcgtgttcttgctgatcatcttcgtcatcacgccgccgagcgtctcgataccgagcgacagcggggtcacgtcgagcagcagcacgtccttgcggtcgcccgacaggacctggccctggatcgccgcgccaaccgcgacggcttcgtccgggttcacgtcacggcgcggatccttgccgaagaactccttcaccttctccatgaccttcggcatgcgcgtctggccgccgaccaggatcacgtcgtcgatgtccgacaccttgacgcctgcgtccttgatcgcgatgcggcacggttcgatcgtgcgctcgacgagatcttccaccagcgcttccagcttcgcgcgggtgatcttcaggttcaagtgcttcgggcccgacgcgtccgccgtgatgtacggcaggttgatttcggtctgctggctcgacgacagctcgatcttcgccttttcagcggcttccttcaggcgctgcagcgcgagcacgtccttcgacaggtcgacgccctgctccttcttgaactcgccgatgatgtaatcgatgatgcgctggtcgaagtcttcgccgccgaggaacgtgtcgccgttggtcgacagcacttcgaactgcatttcgccgtcgacgtccgcgatttcgatgatcgacacgtcgaacgtaccgccgccgaggtcatacacggcgatcttgcggtcgcccttctcggccttgtcgaggccgaacgcgagcgcggctgcggtcggctcgttgatgatccgcttgacttcgaggcccgcgatgcggccggcatccttggttgcctggcgctggctgtcgttgaagtacgccggcaccgtgatcacggcttccgtgaccggctcgccgaggtagtcttcggccgtcttcttcatcttgcgcagcacttccgccgaaacctgcggcggcgcgagctttcgccgtgcgcttcgacccatgcatcgccgttgtcggccttgatgatgctgtaaggcatcaggccgatgtccttctggacttccttctcttcgaagcggcggccgatcaggcgcttcaccgcgaacagcgtgttcttcgggttggtcaccgattgacgcttggccggcgcgccgacgagcacttcgttgtcgtccatgtaggcgatgatcgacggcgtggtgcgcgtgccttccgagttctcgatgaccttgacctggttgccttccatgatggcaacgcacgagttcgtggtgccgaggtcaataccgatgatctttcccattttcctaatctccagaaatgcttgtttgctgcgcaaaaccccgcgttttggggcggtttcgcgcgccagaattcaactctgttcccgaaatgcgtccggccgatccgttttcaagacccgccgagcgatgcggatattaaatttttcaatcgccgccggctagggatcgctgcccgccgctgcgattttcgcgcgcgccgccgacacggccgcctggaattgcgcgaggccatgccagcccgtcgcgcggccgagccgcttgccgcggtggaagaagaaccacgtcggcacaccgtgcagcccgaagcggcgccccagctggtggtgttcgtacacgttgcaatggaaccacttcaagcccagcgcgcggatggcgtcgggctgggcgagcatcgccttcttcgcgatctcgcagttgaagcagtcgacgccccagaagaacaccaccgcaagcgcgtccccgcgccgtcgatcgccgcgtcgaacgtgccggcgtccagcgcctgcatgtcgaacgcgtcaaatgcggccggatcgacgccggcgggcaccatcgcgacgcccttacttcggctgcgcgacggtgacgagcgccggacgcagcacgcggtcggcgatcgtgtagcccttctgcagcaccgtgacgacggtgttcggctcctgctcggccggcaccatcgaaatcgcctgatgctggtgcggatcgaacttctcgccgaccgggttgatcgcgacgacgcggcccttctcgagtgcgctcgtcagctggcgcagcgtcagctcgacgccttcgcgcaccttcgcgatgtcgccggacgtgtcgttgacggctgcttccaggctgtccagcacgggcagcaggtgctccgcgaagctctcgatcgcgaacttgtgcgccttcgagacgtcgtcctgcgcgcggcggcggacgttctcggtctcggccttcgcccgcaggtagctctcctgcagctcggcgaccttggcttgagcctccgcgagcgccgcgtcggctgcttcggcggcgggagcagcgccttgcgccgcctgcttctcgctgccgatatcttcggccgattgggtagacgggttctcttgcgtgttttccatgtcgctgaaagtcgattagaggttgaagccaaatcggcaaccgccggaccgatacccggcggcaccgcacattgctggtgcaaataagggtgaaaactgcgatttcaagagggttattcgccggcattctccaatgccgcgaaacaaccgcgcgtcgcaccggtgcatcgcacgaatagtccgccaaagcaggcgaaacgggctgtaacaacgcttacctggcaagtactagcttggcacagtcccgctgcactacactccactcaagcgtcggaaaagcgtgtttacccttagctgaccgacgccttacaaccaccacctggcgccgttttcaccccttctcgagggagtaccgtgaaactgacctttgcgatatcggtggtcgcgctggtactcattgccggcaccaccaccatctgcctgtcgggagccgtcaccgaccgcacgaccgagtacgggagcgcgcgggcgacgttcgaccagatgttcagctcccaccagaaaatctgtcgatgatgcgccggtcgcgcttcgtcggccggccgtgcaattcggccgccggctcgcgatacgtgcggcgccgctccagttcggcgagccgtgcggcccgccccgcttccgtttcctcgtaaagcgtctgcgcgacgctcgccggcccgcgcacgtcgcacacgccgagtacggcaatgtgccagacgatgccgtcgatcgcaatttcgacctcgtcgcccacgcgcacttccttcgccggcttgactgcagccccgccgatcttcacgtgccccttgtcgaccgcatcggttgcaagcgagcgcgtcttgaagaaccgggccgcccacagccatttgtcgatgcgcagcttcgcgcccggttcggtcgaaattttgtaattcatcgcacctcacccaccgtttcgggctgcgcggccttgaccggccagccctgcagattctcggcgacgatctcgccaagcgcgccgatccacgcgggtgcgccgttcaggcacggaatccggtggaatgccttgccgccaccggcgaggaactcgtcgcgcacctccatgccgatctcctcgatcgtctccaggcaatcggccgtgaaaccgggacagaacacgtcggcccgctgtacgcctgcctcgccgaactcgcgcagcgtcggcgcggtataaggttgcaaccattcggccttgccgaaacgcgactggaacgtgacgcggcactcggtcgtcgacaacccgagcgcggccatcagcagcgcgcccgtctgctggcactggtcgtgatagggatcgccgaggtcgagcgtgcgcttcggcacgccgtgaaagctcagcacgagcttgtcgccggccgcgaagtccggccggccgtgctgcgcccaatactggcgcacctgctcggccagcgcgtggatataggccggatggtcggcgtagtgccgtatcgtgcgcacctccggctggttgcgcatgcgcgagagcgcgtcgaatgcggcgtcgaatgcggtggccgtggtcgacgccgagtattgcggatacatcggcatcagcagcacgcgctcgacgccggcgcgcttgaactgcgcgagcgcgtgcgaaatgttcggactgccgtagcgcatcgcgtagtcgacctgcacttgataaccgttcgacgcgagcaggtgccgcacgccgtcggtctggcgcacggtatgcacgcgcagcggcgagccctcgggcatccagacggccgcgtatttcttcgcggacgcgcggccgcgcagcggcaggatcagcgtgcgcagcagcacttgccagacggcctgcggaatctcgacgacccgcggatccgacaggaattcggccagatagcgccgcacggcacgcggcgtgggcgcatcgggcgtgccgagattgatcagcagcacgccgatgcgatgggcagccgcgatactcgaaggcggctcaagatcgaaacgcatgggcaagaacgtgctcggggcacgggaccggacggctctcaattatagcgggccgcctcgcgccggtcggctggccgttcggccgactgtcggcgcacgcggcgccgcggcacgatgacggggcgggatcgggctgggctcgcaggctactgctggctcagcgtgagcgacagcagccgcgcggtgatgtcgacgatcgggatcacgcggttgtacgccatgcgggtcgggccgatcacgccgagcgtgccgacgatctgcccgttcacctcgtaaggggcggtaacgacgctcatttcctcgatcggcacgagtgtcgattcgccgccgatgaagatctgcacgccctgggcgtggctcgacacgtcgagcagttgcaggaggcccgtcttttggtcgaatacgtcgaacagcttgcgcagccgggccatgtcggacgacagatccgccacctcgagcaggttgcgctcgccggaaatcagcacggtgtcctcggtgtcgggcacctcggtgctggccgtcaccgccgcatgcatcagcgtggtcatgtcgccgcgcaactggtcgatctcgtcgcgcaggcgacggcgcacctcgtcgaacgacagtccggcgaaatgcgcgttgatgtagttggacgcctcggtcagttgcgacggcgagtagtcgcgcggcgtcgcgagcatccggttctgcacgtcgccctcgggcgtcacgatgatcagcaggatgcgcttgtccgacaggcgcatgaactcgatctgcttgaacacgtggctgcggcgcggcgtcagcacgacgcccgcgaactgcgacaggttcgacagcacgctcgcggcggccgccacgacgcgctgctgcggctcgccggcctgcagcgtgttctgcacctgccgcgcgacggcctcggcgtcgatcggcacctcgaccgtcagcatcgtgtcgacgaacagccggtagccgcgcggcgtcggcacgcggccggccgacgtgtgcgggctcgacacgaggccgagctcctccaggtcggacatcacgttgcggatcgtcgccgggctcagctcgagcccggagtaacgggacaacgtgcgcgatccgactggctgaccgtcggcgatataccgttcgatcagggttttcaggagggttcgtgcgcgaggatctagcatggtggaaaattttagcgcaaccgcgcgaccgcggcgagtggcgtcggccaccgatgcgcgggccgacccgatccggccccgtcagcgcacagccggttcttttcgtcaacgagctatggtgtaatgccggcatgaaaaccggtaatcagttcaacactgtcgcgctcgtcggccggagcaacacgccgaacatcgccgagccgctcgccacgctggccgcctgcatcgccaagcggggcttcgaggtcgtcttcgaagccgagaccgcgcgcgagatcggcatcaccggctacccggcgctgaccccagccgaaatcggggcgcgcgccgacgtggcggtcgtactgggcggcgacgggacgatgctcggcatcggccgtcagctcgcgccatacaagacaccgctgatcgggatcaaccacgggcggctcggcttcatcaccgatatcgcggcggccgacatgcaggccctcgtcccggtgatcctgtcgggcaagttcgagcgcgaggagcgctcgctgctcgaggcccggatcatgcgcgacggcgaaccgatctaccacgcgctcgcgttcaacgacgtcgtcgtgaaccgcagcggcttctccggatggtcgagttgcgcgcgtcggtcgacggccggtacatgtacaaccagcgttcggacggcctgatcgtcgccacgccgaccggctcgaccgcttacgcactgtcgtcggccggcccgatcctccatccgcagttgcagggcatcgtgctcgtgccgatcgcgccgcacgcgctgtcgaaccggccgatcgtgctgcccgacgattcgaaaatcgcgatccagatcgtcggcgggcgcgacgtcaacgtgaacttcgacatgcagtcgttcacgtcgctcgaactgaacgacacgatcgaggtgcgccgctcgaagcacacggtgccgttcctgcacccgatcggctacagctatttctcgacgctgcgcaagaagctgcactggaacgaacacgcctcgaacgaagacgacaaggcgtcctgacgccgctccgcccgacaccatgctccgccacctctcgatccgcgacttcgtcatcgtcgccgcgctcgatctcgaattcgacagcggcttttccgtcttttccggtgaaaccggcgccgggaaatcgatcctgatcgacgccctcgccctcgcgctcggcgaacgtgccgacgcgagcgtcgtgcgcaccggctgcggccgcgccgacatcaccgccgaattcacgccgcacgaccgcgtcgcgcgctggctcgacgaacacgcgttcgacaccgaggacaccgtgatgctgcgccgcgtgatcgacgcgaacggccggtcgcgcgcattcatcaacggcaccagcgcgacgctcgcgcagctgcgcgaactcggcgaaatgctcgtcgacatccacggccagcatgcgcaccagctgctgatgcggcccgacgcgcagcgcgagctgttcgacacgcacgcggggctcgtcgccgatgcggcgaacgtcgcgcgcgcgtggcgcgtgtggcgcgacgcgacgcaggcgatcgaggccgcgaaggcgcacgagcgggagctgcagctcgaacgcgaaaagctcgcgtggcaactcgccgagctcgacaagctcgcgccgcagcccggcgaatgggacgaagtcagcaacgagcacaagcgcctgtcgcattcggcgaacctgatcgacggcgtgcgcggcgcactcaacgcgttgtccgaggccgacgacgcgatgctcgcgcagctcggcgcgatcgtgtcgaagctgcgcagcctggccgactacgacaccgcgctcggcgacgcgctcgcgtcgctcgaaccggccgagatccagctgcaggaagccgtctactcgctgtcgcactatgcgcagcgcgtcgatctcgatcccgagcggctcgcgcaggtcgaaacgcgcctcgatgcgctgcactcgaccgcccgcaagttccggttgccgcccgacacgctgcacgaagaacacgcggcacgccgcgcgcagctcgccgcgctcgacgcggccgccgatctcggtgcgctcgaggcgacgcaggccaaggcgcgggaagcctacctcgccgatgccgggcatctgtcgaaggcgcgcgcgcaggccgccaaggcgctcggcacggccgtcacggccggcatgcaggaactgtcgatggcgggcggaagcttcgaagtcgcgctcgtcccgctcgccgacggcggcccgcacgggctcgagcaggtcgaattccgggtcgccggccaccccggcgtgccgctgcggccgctcgcgaaggtcgcgtcgggcggcgaactcgcgcggatcagcctcgcgctcgcggtgatcgcaagcgcggcgagcccgacgccgacgctgatcttcgacgaagtcgatacggggatcggcggcggcgtcgccgaagtggtcggccgcctgctgcaccagctcgggcgcgatcgccaggtgctgtgcgtgacgcacctgccgcaggtcgccgcgcgcggcgaccaccacttccaggtcgcgaagggcgccgacgagcgcggcggcacggtgtcgacggtcgtcgcgctcgaccgcgccaaccggatcgaggaagtcgcgcggatgctcggcgggctcgagatcacggccacgacgcgcaagcacgcgaaggaaatgctggcggcctgacgcgggcatcgcatcggccgaatgcaaaagaccggcgcatgcgccggtctttttgccgcacggccgctcgcccgatcgcgcccgccctgctccgcgaattcgaacgcccgattcgaacgtccgattcgaacgcccgactcaaacgcccgtttcagccgtcccgaacacgcgcgcccacagcgccgtcacggctgcgcgctcgtcggccaccacggccggatcgacccgcgccttctccatcccgtcgagccgcagcttgtgctgcagcttccggtacttccggtaggccgcgccgacgcgctcggcctcgtcctcgcccatcagcccgaagcgcgcgacctcgcgcagcaacgcgatgttgcccgtgttgcggatcagctcggcgtcgctcgacgcgtgcagcagcacccagtactggacgatgaattcgatgtcgaccatcccgccgcgatcgtgcttcaggtcgaacaggtcggtctggttcggatggccggcaaacaccttgccgcgcatgtcgacgatctccttcgcgagcacgccgccgtcgcgcggcgtcgtcagcacctgctggcggatcgcctcgaagtccgcgccgatctgcgcgtcgcccgcgctgtagcgggcacgcgtcagcgcctggtgctcccacacccacgcggtgttcgcggcgtcgccctcgcgcagctggtagcggcggaacgcatcgagatcggtgacgagcagcccggcctcgccgttcggccgcagccgcaggtcgatgtcgaacagcgcgccggccccggtcgccgtggtgagccacgtgatgagccgccgcgtgaaggtcgtgtagacgtccgccgagcgctcgtccgcgtcgtcgtacaggaagatcaggtcgagatcggatgcgtagccgagctccttgccgcccagcttgccgtacgcgatcaccgcgaacttcggcacgtcgcgatggcgtttcgcgagctgggaccagacgacttcgatcgtcacgtcgagcacggcatcggccagctcggacagccggtcgctcacgtgctcgaccgacagctgcccggccaggtcgatcagcaggatccggaacacctccgcgtgctgcgcgtgccgcagcaggtccatctgctgctcggggccgtcggccgccgcgaggcgcgcacgcagcgcgtccttgaacgcaggccagtcgaacgggctcgcgatcgcctcgtcgtcgagcagctcgtcgagcagctgcgggtggcggatcaggtatccgccgccccagcgcgtcgcaccgagcaccgacagcacgcggtcgagcgcggccggatactcggtcagcagcgcgagatagacgccgcgccggctgaccgtctcgagcaggtcgaacaggcgcacgatcgtgtcgtcgcggcgtgcggcgtcgatgttcggcgcggcctcgagcgcccgctgcgcgacgctgtcgaagcgctgccggctcttttccggcaggcccatgtagcgcgtcgattgccagatcgcacgcagccgcgcgagcacggcggccggatcggcgaagccgaggccgtcgaggcgtgcgaccagcgcatcgtcctcgccgtcgtcgcccaacgcgccgctccagatccatgcggcggccgtgtcgtcacccgccgcgcaagggccgccgcccttcaccttgtccgcgaagatctggtcgaactgcgcctcgacgaagttccgatgctcatccagcaccgtcatcagcgccgcgtagtcggcaaagccgagcgatgcagccagcgccgcgcgttcgtcggactcgaccggcatcgcgtgcgtctgcgcgtcgttgcggtactgcagccggtgctcgagcgtgcgcaggaagttgtaagcatcggccaggcgcgcgcacacgtcctcgccgatcagcccgcgcgcctgcgcatggcgcagcaccgcgagcgtcggccgcacgcggaattccgcatcctggccgccccggatcagctggaatacctgcgcgctgaactcgatctcgcggatcccgccgcgcccgagcttgatgtcgtccgacttgtcgggccgcatcgacgcgcggcgcgcggcttcctgccggatctgctggtgcagcgagcggatcgcgccgatcacgccgaaatcgagatagcggcgatacacgaacggcttgacgatcgactcgagctgcgactccagccgtcgcgccgcgtcgctgtcgccttccgacacgagccgccccttgatccacgcatagcgctcccactcgcgcccctgcacgtagaaatattcctcgagcatgccgaggctgcagacgagcggccccgaatcgccgttcggacgcagccgcatgtcgacgcgaaacacgtagccgtcggccgtgacctcggacagcacgccgatcaggcgccggccgagccgcgtgaagtattcctgcgtggacagcggcgaacgcgcgccgccggtcgtctcgccgtcgtcctcgtagacgaagatcaggtcgatgtccgacgacacgttcaactcgcggccgccgagcttgcccatcccgaccacgccgagcacgacgcgctggccgtcggcgccgcgcggctcgccgtacaacgcctcgagttcaaccgacagcagcgcgagcgagcgctgcacggccacttcggcgagatcggtcatcgcgcccgtgacctcggcgacgtccgccagcccgcgcaggtcgcgttccgcgaccgcgccgaacgcctcgacacgcaactgccgcagcgcgcgcttcagttgctcctcggtcggcgcggccgtgccggccggcgtcgccagcagctcggtgaggcgcgcgtcgagctgcacacggccgagcggcgcggcggcccacgcggcgacctgttcggccagcgcgggccgcgcggcagccgcgcgagcgaggtatcgggaataggacgtgctgatcagggcggaagcgtcggtcatcgagaagcgggcctggcggaaaggctggccggcagcggccggcgcgtgcgcgccccgctaccggccagccccatggattcggcgcggcatcgcgggacgcgcgtgcgcccgccgcgaaaccgcgcgccggaaagcccgtgccgcgctgccgcaacggccgccggcacgaacccgtgtgatacatttcaacgtcagtctgcaaaactaccatatcgccgcccgtccgccgcatgtccgaccgtcaggaatccgccgtagctgcgcccgaagcgggacctccgaagcacgatcatccggtcctgcgccgcgtgttccgggtgacgctggcagtcgggctcggcacctacttcgtcgcgtccggcgcgttcctcgggctgcgctacgtactgctgccccgcatcgacgaattccgcccgcgcatcgagcgcgcggtgtccgacaagctccacgcgcagctttcgatcggcaagctttcccgaactggtccggcatgcagccgggcgtcgaactcacgaacctgacgatccgcggccacgacggcaaggtcgcgctgtcggtgccgcatgcaacggccgcgctgtcgtggatgtcgctgctgcggctgtcgcccgcgctgtcgagcctgatcgtcgaccagcccgacctcgtcgtcgcgcgggcggccgacggctcgctgagcgtcgcgggcgtcggcgtggcaaccactcacggcggcaacgacacgttcggcacgtggctgctgaagcaggaagcgatcgtgctgcgcggcggcacgctgcgctggcgcgacgcgcagcacgacgcgccggaactcgtgctgtcgggcatccggctcgcggtgctcaacgacggccgcgtgcacaaggccgcgctgcaggcgcccgcgaacggcacgctgctgctcggcccgctcgatttccgcgcgcgcttcaggcacaagccgctcgcgccggtcggcaagccgtcgaactggtcgggcgacgcgtacctgtcgacgggcccggtcgacctgcagacgctcgggcgctacctcgacatgccgctcacgatccacgcgggccggatcgacaacgcgatctgggccaccttcagcgacggccacctgcattcggcgggcggcgacctgcagggcgcggacgtcgcgctgcgcgtgcgcccgacgcagccgcggctcgacgtgccgacggtcggcttcggctgggacatgcagctcgatgccggccacgactacacgctgcacctgacgcgcttcaacgcggaactcggccagccgccgctgccggacggcacaccgctcgcccgctcgctcgcgctgtcgacgctgacggcccgctaccgtgtgccgaccgccagccaggggcagctgttgagcgtcgtcggcgaccgcgtcgatctcggcattctcagcgagttcattcgcgggctgccgctgccggcgcggctgcgcaacgagctgatcaagatcgacccgcgcgggatggtgtcgaactatcacatcgaggtcgaacgcgcgaagcccgcgcgggccgacctcgccgacgaggagcgacgcatgggcgccgcgccgatcgtccgctatcgcttcctcggcgatctgcagggcatcagcttcgccgcgcaggagccgccgcccgggctgtcgccgcgtggccacccgcgggccggctggccgggcgtcgagaacctgtggggccgcgtcgatgcgaacgagacgggcggcagcgcgcatttcgatacggtcaacgcggcggtcacggtacccggcgaattcgacgagccgcgcctgacattcgaccggctgcgcggcaacgcaaagtgggtgatcacgcccgccgccggcgaaaagcatgcgcgcgtcgacgtgaccctgcccgacctgctcgtctcgaaccccgatgccgaaatcgcggtatccggctcgtacacgaaccccggccacggccgcggctcgctcgacctgcgtgccgatttcgcccgcgcgtcggtggcgcgcattccgcgctacctgccgaccgggatgtccgaacacctgcgcgactatctcggccatgcgctgcaggccggccaggtgaccaagggtgcgtcgatcgtcgcgcgcggcccgctcgagaaattcccgttcgaacacgagccggacgccggcgtgttccacatcgtcgcgccgttcaccggcggtcgcttcgaaccgacgccgtacccgccgcgcaagctcgcgaacggcacgccgagcgtctggccggcgctcgacgggatcaacggcgtgttcgagctcgcgcagaacaagctgcgcttcgacatcgatcgtgcgcactacaagcgcgtcgcgctgacgaaggtcgcgggccgcatcgacgatctcggcaacccgagccactcgccgctcatcatcgacggtcatgcgcagggcccgctcgccgacctgatcgactacgcggacaacagctcgctcggcacgatgagcgggcatatcggccagcggatcgatgcgcaggggcccgcgtcactcgcgctcaagatcacgattccgcagcacgtcccgcatccgcacacgcacatcgaaggcgcgctcgcgttcggcggcaacacgctgacgacgagcggcgtgccgccgctgtccgcgctgcgcggcagtgtccagttcaccgaggccggcgcatcgctgcacgacctgtcggggcgcttcctcggcggcccggtgcgcgcgagcggcaacttccagtcgcacggcccgtatacggtggacgtcgacggccggctcgcgctcgacgccgcacgcggcctgaacctgcacggcccggcggccgcgctgctcgagcacgtggtcggcgacgcgccgtacaaggtcgccgtgcgcggcgcgccgggccgcctgcccgacatcagcgcgcattccgacctgaccggcgtggcactgaatttcccgcgccgttcgcaaaacctgccggcacgccgatgccgttcagcttcacgctgcagccggcgccgcaggcggacggcaagcgcctcgagcacgccgacctgacgctcggccccgtgtccgcgacctacctgctcgacgcgacgcgcggccagccgctgcgcgcggtgcgcggcgcgatgggcatccaccggatgcccgacatgccgcaggacggcgtgagcgcggccgtcgacgtcaacgaactggacgccgacgcgtggctcgcgctggcccatacgctgaagcccgacacgccacgcgcgcaggagccgcaagccgcgccgcgcgtcgatttcgcgagcttcgcgccgaagcgtttcgcgctccatttcggcacgctgaagctgctcaagcgtaactgggaaaacgtgatcgtcggcgcgtcgcacgtcgacgagctctggcaggcgaacatcgcgtcgaaccaggtgtcgggctacctgtcatgggcgccgggcggcggccacaacggcgcgggcgtgctgaacgcgcggctcgcgaagctcgtggtgcccgacagcgcgcagcacgatctcgtcggccgcgcgatgaacctgccgacgccgaccgaccgcccgatgccgtcgatcgacctgatcgtcgaccaggtcgtcgcgcgcaaccacgacatcggccgtctcgtcgtcaacgcgcgcaacatcgacgaagccggcacgccggtctggcagctcgacaagctggagctgtcgaacccggccgcgaagctgacagcgaccggcaactggcgcacctcgcgccgcgcgcttgcccgcggcgccgacgaaacgacgcgccgcgccgcaccgtgttcgacttcaaactcgacatcgacaacgcgggcgcgctgctcgatcgcgtcggcctgccgcgcacgctcgcggacggtcacggcacggtcaccggcaaggtcggctggcgcggcggcccgaccgcggtcgacctgccgtcgctcggcggccagatcgcgctcgacctcgaacacggccagatcctgaaggtcgatccgggcgcggcgaagctcctcggcgtgctgagcctgcagagcctcgcgcgcttcctgacgctgaatttccgcgacgtgatcggcaaggggctgccgttcgacaagatcacaggcaccggccggatctcgaacggaatcgcccgcaccgacgacttctcgatgatgaccgggcccgcgaacgtcaccgtgcgcggcgcggtggatctcggcaccgagacgcaggacctgcacgcgcacgtcgcgccgaaaatcagcgcgggcgcggcggcgatcggggcggccatcgtcaacccgctgctcggcgtcggcgtgctggccgcgaactacgcgctgtcggagacgctatcgcgcgcgttcgcgctcgactacacgatcaccggctcgtgggcgcacccgcacatcgagcgagtgcggggcgatcagggtaagatgaatcacggtccggccgatgcggcgagccattgagccgcgcgtcgggccgcgcacggtgccgggccgcaccccatttatgacgcaaccgatccagcgatgaccgaccacacccgttccgccacgcccttccaggtcgccgcgctgcagatggtgagcacgccggacgtcgcgcgcaatctcgccgaggcgcgccgcctgatcgcggaagccgccggcgaaggcacgcagctcgtgctgctgcccgagtacttctgcttcatgggtcaccgcgacaccgacaagctcgcgctcgccgaaccttaccgggacggcccgatccagcatttcctcgcggacgccgcgcgtcgccacggcatctgggtgatcggcggcacgctgccgctgaaggccccggagcccgatcgcgtgctcaacacgacgctcgtgttcgacccatccggcaacgaagccgcgcgctacgacaagatccacctgttcaacttcgagaaaggcgacgagtcgttcgacgaagcgcgcacgatccgcgcgggcgatacggtcgtcacgttcgacgcgccgttcgggcgggtcggcctgtccgtctgttacgatctccgctttccggagctgtatcgcaggatgggcgactgcgcactgatcgtcgtaccgtcggcgtttacgtatacgaccggccgcgcgcactgggaaacgctgctgcgcgcgcgggccgtcgagaaccagtgctacgtgctcgcggccgcgcaaggcggcaagcacgagaacggccggcgcacctggggccacagcatgctgatcgacccgtggggcgagatcgtcgcggttcgcgacgtgggcgcaagcgtcgtgcgcggcgcgctcgatccgcagcgcatcgccgacgtgcgccagagcctgcccgcgtggcggcatcgcgtgctgacctgaatccgccgcaccgcttgaaacaccgcgcggccaacccatctgcccagaagcacccgacaactttttgagaaaccccgatatccgcatgaacatcatcgaacccggcatccgcaacctcgcgctggcgaaggacatcctgctcacgccgtacggcctcgacgaaagcctgctcacgcgcacgatcgccgacatcttcacgcatcgcgtcgactacgcggacctgtacttccaggcgacccgcagcgaagcgtggagcctcgaggaaggcatcgtcaaatcgggcagcttcagcatcgaccagggcgtcggcgtgcgcgcggtcgcgggcgaccgcaccgcgttcgcgtactcggacgacctgtcgccggaggcgatcgcgcaagccgctgccgccaccaaggcgatcgcggcggccggcggcggccgccagaagatcaaggcggccacgtcgctgaagggcatctcgggccgcgacctgtacctgccgtccgatccgctcgcgtcgctcgacgcgacggccaaggtcaagctgctcgagcgcatcgagcagatggcgcgcggccgcgacccgcgcgtcacgcaggtgatggccggcctcgccggcgaatacgacgtcgtgctggtcgcgcgcagcgacggcgcgctcgcggccgacatccgcccgctcgtacgcgtgtcggtcacggtgatcgccgagcagaacggccgccgcgaaatcggctccggcggcggcggcggccgcttcgactacggttacttcaccgacgaagtcctgtcccgctacgtcgacgacgccgtgcatgcggcgctcgtgaacctcgacgcacgccccgcgccggccggcgcgatgacggtcgtgctcgggccgggctggccgggcgtgctgctgcacgaagcgatcggccacggcctcgaaggcgacttcaaccgcaagggttcgtccgcgttcgcgggccggatcggcgagcaggtcgccgcgaagggcgtgacggtggtcgacgacggcacgctgccgaaccgccgcggctcgttgaacatcgacgacgaaggcaacccgacgcagtgcacgacgctgatcgaggacggcatcctgaagggctacatccaggacacgctgaacgcgcgcctgatgaagatgccggttacgggcaacgcgcggcgcgaatcgtacgcggcgctgccgatgccgcgcatgaccaacacgtacatgctgaacggcgacaaggatccgcaggaaatcatcgcgtcggtgaagaacggcctgtacgcggtgaacttcggcggcggccaggtcgacatcacgaacggcaagttcgtgttctcggcgtccgaggcatacatgatcgagaacggcaagatcacctacccggtgaagggcgcgacgctgatcggcagcggccccgaatcgctgaagtacgtgagcatgatcggcaacgacatgtcgctcgacaccggtgtcggcgtgtgcggcaaggaaggccagagcgtgccggtcggcgtcggccagccgaccctgcggatcgacaagatgacggtcggcggtacggcataaccgcatcgcgacgcagacattccgcgcatttttagaaaacgcgcggaatgtccgcattttcgacgctccccggttgccagccgcccggcgacggggtataaattccgaatcaactttttgacgaaccgaatctccgtcatgtccgccaagttttacttttacttttttggcatctcagaccgctggcggatcgagagggttgatggcgcgtaaagcgcaaccgaaattcgaaaaaccgccggcgaacccggcggtttttcgcccttcgcttcccggtcgccgccgcagcggttccgcagccccgaccgaaaccactgaatcgcttgaattgatgaatctgccgcacgcccactgatcgaacggcgcccgaaaccaaggagaaacagcatgcccccgcacaacaccgacgacgtccgcatccgcgaactcaaggaactgacgccgcccgcccacctgatccgcgaattcgcgtgctccgaagccgcgtccgagctgatctacaactcgcgccagtcgatgcaccgcatcctgcacgggatggacgaccggctgatcgtggtgatcgggccgtgctcgatccatgacacgaaggcggcgatcgagtacgcggggcggctcgtgaaggagcgcgagcgcttcaagggcgagctggaaatcgtgatgcgcgtgtacttcgagaagccgcgcacgacggtcggctggaaggggctcatcaacgatccgcacctcgacaacagcttcaagatcaacgaagggctgcgcaccgcgcgcgagctgctgctccagatcaacgagatgggcctgccggccgcgaccgaatacctcgacatgatcagcccgcagtacatcgccgacctgatctcgtggggcgcgatcggcgcgcgcacgaccgaatcgcaagtgcaccgcgagctcgcgtcggggctgtcgtgcccggtcggcttcaagaacggcaccgacggcaacgtgaagatcgcggtcgacgcgatcaaggccgcatcgcagccgcaccatttcctgtcggtgacgaagggcggccattcggcgatcgtgtcgacggccggcaacgaggattgccacgtgatcctgcgcggcggcaagacgccgaactacgacgcggaaagcgtgaacgccgcgtgcgcggacatcggcaaggccggcctcgccgcacgcctgatgatcgacgcgagccacgcgaacagctcgaagaagcacgagaaccagatccccgtctgtgccgacatcggccgccagatcgcggccggggacgcccgcatcgtcggcgtgatgatcgagtcgcatctcgtcgaggggcgccaggacctgaaggaaggctgcgaactgacctacggccagagcatcaccgacgcgtgcatcgcatgggacgacagcgtgaaggtgctcgaaggcctcgcggaatcggtgaaggcacgccgcgtcacgcgcggcagcgggaactgatcgtccgcgcctgcaccgaaacgaaaaacgcccggctcgcgccgggctttttcgcgggccgccgactgccggtcagcgcatcactcgagcgcgcccgaaccgaagatctcggtattgatgcgttccggcgcgacgccgagcgcgaccagcgcatcgcgttgtgccttcatgaacgcgaccgggccgcagacgtagtagtcggcgtgcggcaccagcgcgtagtgccgcacgcgctccggcgtgaggcgcccttccagatcgtggtcgacgccgacacgatcgttcgggccgaccagctcgtacagcaccgtgcgcttgacgttcgcatgctcgcgcaccgtgtcgttcagccagtcgcggaacgcgtgcaccgcgcccgagcggcatgcatggacgaaccgcacgtcgcgcttgctgccttcgtcgaccagcgtcgacgccatcgacaccatcggcgtcaggccgacgccgccggaaatcagcaccaccggcgtctcgacgccgcgcttcagcgagaattcgcccatcggcgcggtgacctcgacgatcgcgccctcttccacgccgtcgtgcatcagcgtcgacaccttgccggccggaatgacttccggcctgccggcttcgcgcttcaccgagattcgcagccacttgccgtgcggcgcgtcggacaggctgtactggcgcggctggtcgacgccgagatcgccgacgaaacgcttcaccgtgatgtactggccgggctcgaacgtcggcgccgcgccgccgtcggcgggcgtcaggtagaacgacgtgatctcgtcgctttcgcgcaccttgcgctcgaccttgaacggacggaacccgctccaggcggcgcccgcgtacaggtcggcctcggcgccgatcaggatctgcgcgagctggccgtacgccacccgccacgcctcgagcgtgtcggcatcgaccgcgtcgcccagcacctcgacgatcgaggcgagcaggttctcgccgacgatcgggtaatgctcggggcggatgttcaggctcgcgtgcttgtgcgcgatgtgcgacaccgccccgcccagcgcaccgagattgtcgatgttcgccgcatacgcgtagacggccttcgcgagcgcttccggctggccgcccgtcttctggtgcgtctggttgaacaggttcttcagttccggatggcgcgcgaacatgcgctggtagaagtgcttcgtgatcgtcgcgccgtgcacggcgaggacaggggcagtggccttcacgcgagccatctggtcagcggtgatgtgggtcatgttcgttctccgttaaacatgcacacacaataccttttaaaaattcgatgcccctcgggcaaattgtcgcagcgcggcaagggtaaggggcgaatcgtcagcggtcagcggacacggccgcgttcccacagcacgtccgatccgccgtcggcacggttcagcacgcgcgccagcacgaacagcaggtccgacagccggttcacgtagcgccgcggcgcatcgttgagcgtttcggtgcgcccgagcgcgacgatcgaacgctccgcgcgacggcatacggttcgacacacgtgcgcgagcgacgccgcgcgcgagccggccggcaggatgaattccttcagcggcggcagcgtcgcgttgtagtcggcgagccagcgatcgagacgcgcgagatgcgtgtcgtcgagcaccgtatggccgggaatgcacaattcgccgccgagatcgaacaggtcatgctggatcgtcacgagcgccgtgcggatatcgtccggcagcgtttcggcgagcagcacgccgaggttcgagttcagttcgtcgacgtcgccgatcgcggcgatccgcgtatcgtccttgccgatacgccggccgtcaccgaggccggtggtgccgtcgtcgccggtacgcgtggcgatcttgctcaagcggttgcccatgcggatgtccttcgcggcgcggcgcggcccggttgcgttcgaacgcgattatcgcagcccgcgacggcgggcgcagcaggcgttacagcgtagaatgggccgaaacccagcagcacgggagccggttcggcgccaacgcgctcatccggatcgacaaggagacgttcgtgaatcaccctgccccgccggccgccacgcgccgcccccttcccccgccatgctcgatgcgctgcgcgccgccttcggcgagcgcgtgtcgaccgccgacgccgttcgcgcccaccacggccgcgacgaatcgccgttcgatccgcaactgcccgacgccgtcgtgttcgcgcacagcgcggacgacgtgcgcgaagtcgtgtcgctgtgctcgctgtacagcgtcccgctgatcccgtacggcgccggttcgtcgctcgaaggccacctgctcgcggtgcgcggcggcatctcgctcgacctgtcggaaatgaaccgcgtgctgtcgatcaacgccgaagacctgaccgtgacggtcgagccgggcatcacgcgcaaggcgctcaacgaggcgctgcgcgacaccggcctgttcttcccgatcgacccgggcgccgacgccagcatcggcgggatgaccgccacgcgtgcgtcgggcaccaacgccgtgcgctacggcacgatgcgcgaaaacgtgctcggcctgaccgccgtgctcgccgacggccgtgtggtgaagaccggctcgcgtgcccgcaagtcgtcggccggctacgacctcacacgcctgttcgtcggctccgaaggcacgctcggcgtgatcaccgagatcacgctgcgcctgcatccgctgcccgaagccgtatcggccgcgatctgcacgttcccgtcgatgggcgacgcggtgcgcaccgtgatcgagacgatccagatcggcgtgccgatcgcgcgcgtcgaattcgtcgatgcgctcgccgtgcgctcgatcaaccgccattcgaacctgacgctcaccgaagcgccgacgctgttcttcgaattccacggcaccgaggccggcgtgaaggaacaggccgagctcgtgcaggcgctcgcgggccagaacaacggccagggtttcgaatgggcaacccgccccgaagaccgcacgcgcctctgggccgcacgccacaacgcgtatttcgcgatgctgcaattgaaacccggctgccgcgcggtgacgaccgacgtctgcgtgccgatctcgcagctcgccgcgtgcgtcgaggaaaccgaagtcgacctgcgcgcctcgtcgctgccctgcccgatcgtcggccacgtcggcgacggcaatttccacgtggcgatcctgatcgaccccgacaagcccgaggaaatcgcggaagccgagcacatcaacgaccggatcgtcgagcgcgcgctgcgcctcggcggcacctgcacgggcgagcacggcgtcgggctgcacaagatgcgcttcctgccgaaggagcacggcgacaacgcgatcgacacgatgcgtgcgatcaagctcgcgctcgatccgcgcaacctgatgaatccgggcaagattttcacgtgctgacacggcggcgcgacaccgcgccgcctgctgcaggagaccccatgaacgctcccgtcgaactgtcgagcgcggcacgcgcgcagcgccagcgcgaagtcgtgcaggcgctgatggccgtgctgccgacgcactgcctgctctaccgcgacgaagacacggcgccgtacgaatgcgacggcctgtccgcgtaccgccgcctgccgctcgcggtcgcgctgcccgaaacggaatcgcaggtgcagcggatcgtgcagatctgccgccgcatggaggtgccgatcgtgccgcgcggcgcgggcacgagcctgtcgggcggcgcgttgccgatcgcgctcggcgtcgtgctgtcgcttgcgcgcttcacgcgcatcgtcgaagtcgatccctacgcgcgcacggcgaccgtgcagcccggcgtgcgcaacctcgcaatctcggaggccgccgcgccgtacggcctgtactacgcgcccgatccgtcgtcgcagatcgcgtgcacgatcggcggcaacgtcgcggaaaattccggcggcgtccattgcctgaaatacgggctgaccgtgcacaacgtgatgcgcgtgcgcgcggtgacgatcgacggcgagatcgtcgaattcggttcgctggcgctcgacatgccgggcctcgacctgctcgccgtgatgatcggcagcgaagggatgttcgcgatcgtcaccgaggtcacggtgaagctgatcccgaagccgcagacggcccagctcgtgatggcgagcttcgacgacgtcgtcaagggcggcgaggccgtcgcggcgatcatcgcgtcggggatcatcccggccgggctcgaaatgatggacaagccggccacgcaggccgtcgaggcgttcacgcacgccggctacgatctcgaggcgaaagcgatcctgctgtgcgaatcggacggcacgccggaagaagtcgcagaagagatcgtgcggatgacggccgtgctgcgcgagcatggcgcgacacgcatccaggtatcgcgcaacgagcacgagcggctgcgcttctggtcgggccgcaagaacgcgttcccggccgccggccgcatctcggccgactactactgcatggacggcaccgtgccgcgccgcgcgatcggcccgctgctcgcgcgcatcgagcagctcgaaacgcaatacgggctgcgctgcatcaacgtgttccacgcgggcgacggcaacatgcatccgctgatcctctacaacgcgaacgatccggacgaactgcaccgcgccgagcagttcggcgcggaaatcctcgaatgctgcgtggaattcggcggcagcgtgacgggcgagcacggcgtcggcatcgagaagctcaattcgatgtgcgtacagttctcgccgcaggagcgcgacgcgttcttcgcggtcaagcgcgccttcgatccggcggggctgctgaacccggacaagggcatcccgacccgcgcgcgctgcgccgaatacggtcgccagcacgtgcgcggcgggctgctgccgcaccccgacctgccgcgcttctgagcggcccgcgcgggtcgcggccggtgcccgcggccgggccgcggcgttcgaccgtgcccgcgcggcccgttcatgcggcgacgcgggcagacggcccgcgataccggtcttagggatagtcgcgatgtggaatcgcgccaccccggtacaatcgaccgaacaacaagtcgaggcagcaacagaacatggaagaggacgacatcgtcgccggatgggccgaccgcgtccgcgccgccagcgccgacggccggccgctgcggattcgcggcggcggcaccaaggactggtacggccaggcgctcgagggcgaaattctcgacacgcgcgcgtttcagggcgtcgtgtcgtacgacccggctgaactcgtcgtcacggtccgcgcgggcacgccgctcgcacagcttgaaaccgtcctcgccgagtgcggccagatgctgccgttcgagccgccgcacttcggccgcgcggccaccgtcggcggctgcgtcgcggccggcctcgcgggcccgcgccgggccacctgcggcgcgccgcgcgatttcatgctcggcgtcacgctgatgaacggccgcggcgaagtgctgcgcttcggcgggcaggtcgtgaagaacgtcgccggctacgacgtgtcgcggctgatggccggcgcgctcggcacgctcgggctgatgctcgacctgtcgctcaaggtgctgccgatgcccgtcgcagaagtcacgctgaagttcgagatgaccgcgaccgacgcggtgcgcaagctcaacgaatggggcggccatccgctgcccgtcagcgcgagcgggtggcgcaacggcacgctcgtcctgcgcctgtcgggcgccgaagcggccgtgaaatccgcgaagacgctgctcggcggcgaagtcgtcgacgcggtcgaggccgagcgcttctgggccggcctgcgcgagcataccgacccgttcttccacggcatcccgcccggctatgcgctgtggcgtctcgcgctgccgtcgatcaccgaaccgatgcacctgcccggcacccagttgatggaatggggcggcgcgcagcgctggtggatcaccgacgccgatgcgcagaccgtgcggatgagcgccaagcaggccggcggccacgcgacgctgttccgcgcgggcgacgcgtacgaccgcagcgcgggcgtgttcacgccgctcccgccccgatgatgaaaatccaccgcgggttgaaagccgcgttcgatcccgcgcgcatcttcaaccgcggccggctctatccggatctctgagatgcagacgaacctcgccgatttcatccgcaatacgcccgacggcgacgaagccgacgcgatattgcgcaagtgcgtgcattgcgggttctgcaccgcgacctgcccgacctaccagttgctcggcgacgaactcgacggcccgcgcggccgcatctacctgatcaagcagatggtcgaaggcgcgcccgtcacgcgcagcacgcagcagcacctcgaccgttgcctcacgtgccgcagttgcgagacgacctgcccgtccggcgtccagtacggccggctcgtcgagatcggccgcaagcacgtcgaggcacaggttcagcgccccgtgcagcagcgtctcgtgcgccgcgtgctcgcgagcctcgtgccgaacgccgcgctgttctcgccggtgatgcggctcggccagcacgtccgtccgctgctgccgaagcggctgcgcgacaaggtgccgccgcgcacgcggctgctcgaatggccgcacctgacgcatacgcgcaagatgctgatgctcggcggctgcgtgcagccgtcgatgctgccgaacatcaatatcgcgaccgcgcgcgtgctcgacgcgctcggcatcgagaccgtcgtcgcgcccgatgccggctgctgcggcgcgatccgcctgcacctgaactatcacgacgaagcgctcgacgacgcgcgccgcaacatcgacgcgtggtggccccatgtcgaacagggtgtcgaggcgatcgtgatgaacgcgtcgggctgcggcgcgacggtgctcgaatacgcgcacctgctgcgcgacgacccggcctacgccgagaaggcgcagcgcatcgtgtcgctgacgcgcgacatctccgacgtgctgctcgcgttcgaggccgagctcgcgacgctcgcgcgccgccgtgcggtccatacggtcgcgtaccacccgccgtgcacgctgcagcacggccagcagtcgcgcggcaaggtcgaacgcctgctcgagaccctcggcatcgacgtgcggctgccggcggacagccatctgtgctgcggctcggccggcacctattcgctgacgcagccgtcgctgtcgtaccggttgcgcaagcagaagctgctgaagctgcaggcgctcgagccgcagatgatcgtctccggcaacatcggctgcatcgcgcacctgcagagcggcacgcagattccggtggcccactggatccagctcgtcgagcacctgctgtatggctagggcctgttcatacgaatgacgggcgggccctgggcctcgcgcccggcgtccgtataatgggcggatcgatgcgccgcgtgccgcggcgcatccgctacatgcccgcttccgtgcctgctttcgtgcccgtcatgtccgatctcgccgcccgcctcgaatccgttcatcgccgcatcgccgacgccgcccgcgcggccggccgcgatcccgccaccgtatcgctgctcgccgtctcgaagacgtttcccgccgccgacgtgcgcgccgcgcatgcggccgggcagcgcgcattcggcgaaaactacgtgcaggaatcgatcgacaagatcgacgcgctcgccgacctgcgcgcgagcctcgaatggcatttcatcgggccgctgcaatcgaacaagacgcgcccggttgccgaacgcttcgactgggtccattcggtcgaccggctgaagatcgcgcagcgcctgtcggaacagcgccccgcgcacctgccgccgctcaacgtgtgcgtgcaggtgaacatcagcggcgaggcgtcgaagagcggcgtcgcaccggccgacgtggccgaggtcgcgcgcgcggtcgccgcgctgccgtcgctgcggctgcgcggcctgatggcgattcccgaaccggccggcgacaccgacgcgcaacgcgtgccgcatcgcgcactgcgcgtgctgttcgacgcgttgcgcgccgacggcctgccgctcgacacgctgtcgatgggcatgtccgccgatctcgacgcggccgtgctcgaaggcgcgacgatcgtgcgcgtcggcaccgcgatcttcggcgcgcgcgattactcgcactgaacgccgcgccctttccgccctcccgttcactcactcgctcaatcgaacaccatgaaaatcgcattcatcggcggcggcaacatggccgcggccctgatcggcggcctgatcaagcgcggcgtcgccgctgacggcctgtatgccatcgacgtcaacgaagaagtgcgcgcgcgccgcgcagcaattcggcatccgcaccggcgcggccgtcgacgcaacgctcgccgactacgacgcgatcgtgctcgcggtgaagccgcaggtgctgaaggacgtcgcgcaggcgctcgcgccgcacctgaagacacagctcgtgatcagcatcgcggccggcatccgcggcagcgatctcgcgcgctggctcggcgactacgcacgcgtcgtgcgcacgatgccgaacacgcccgcgctcgtcggcatgggcgtgacgggcctcgccgcactgccgggcgtcgatgcggcgggccgcgaactcgcgtcgaacgtgctcggcgcggtcggcgagatcgtgtggttcgacgacgagtcgaagctcgatgccgtcacggccatttcgggcagcggccccgcgtatgtgttctatttcatcgaagcgctgcaggaagccgcgcgccagctcggcatgaacgacgaacagggccgcgcgctcgcggtcgcgacgttcacgggcgccgcgcaactcgccgcgcaatcgggcgagccggcaagcgtgctgcgcgagcgcgtgacgtcgaagggcggcacgacagccgccgcgctcgcatcgttcgacgcgcagggcgtgaaggacgcgatcgtgcgcggcgcgctcgcggccgaagcgcgtgcgaaggaaatgggcgacgaactcggtcgcgcgtaagcgccgcgcccgccccgggcctcccttccggcaccggcaacaaaaagcggcctcggccgctttttgttggcatcgcgcatcgcgtcgcgcgccggcgcggccgcttcagttgcccgccggccccgccagcaggtagtgcgcggcgatccccgcgaacagcacgccgccgagccagttgttgtgccggaatgcggcgaagcacggcatccgctcgcggcccttgatcagcgtgtagtgatacagcgcgcagccgaccgccgccgcccagccggcccagtacgcgaggccgaagccgagcgtcacgccgatccacacgtagatgccgagcgtcgccgcataacacaccatcacggccgcgacgtcgaagcggccgaacgtcagcgccgacgtgcggatcccgatcttgatgtcgtcgtcgcgatcgaccatcgcgtattcggtgtcgtacgcgaccgaccagaaaatgttcgcgaccagcatcacccacgcgatcgtcggcaccgtgtcctgcacggccgcgaacgccatcggaatgccgaagccgaacgcgatgccgagatacgcctgcggaatcgcgaagaaacgcttcatgaacggatacgaacccgcgacgaacagcgcgacgacggacagctccttcgtcagcgtgttgagcggcaggatcagcaggaacgagatgaatgcgagcccgacggcgatcgcaacggcttcccacgcacggatcttgcccgacgtcagcggccggtcggccgtgcgcttcacgtggcggtcgaaatcgcggtcggcgtagtcgttcatcgcgcagccggccgagcgcatcagcagcgtgccgagcgagaagatcacaagcagcggccagcgcggatggccgtcggacgcgatccacagcgcgttgagcgtcggccacagcagcagcaggctgccgatcggcttgtccatccggacgagccgcagatacaggggaaagcgggcaagcatggcgaggcaccgggaggataaccccggcattttagagccgggcggtgcttcgcgtcatgtcggggcggcccgcggccggcagccgcccggcgcgcccgggccgcccggcccgctgcgcagggccgggccacgatttgcgccaatcaagggacggattcgatcactccggatcgggcgagtcagcgcgccctcaccggccgcaccgcacttacgcgagcagcgagcgcagcatccacgcggtttttcatgcgtctgcaggtcggcggtcggctcgccgcgtcggcgatcgggaagattcgcgcgcgcgggttcgcacgacggcctcgtgcccttcgacgagcgggcggatcatgtcttccgccgccggcacgcccttcgcttccggcaccgacgacagtttcgcgaaatcgccgaaggcacgcgttcctgtccttccggattcgaggctaagcgccgaaccggatcgcgccgttctcgatggcagcctggctgccgtattgccaggtgatgttgcggtgttcatgtccgatcggcagacccgagtagatcggcaggccgaagccgcccagcacgtcgacaagcatctgctcgagcgtgaaatccgcgccgtccgggatcgggcagcgcgtgaattgcccaagcacgaacgcacgggctccgtcgaacgcgccgctcagacgcagttgcgtcaggctgcggtcgagccggtagcccaactccgtcacgtcctccagcagcacgatcgcgtcgcgtgagcgaagcgaccagcgcgtacccgcgacgctcgcgagtaccgtcacgttgccgccgcacagacgtccccgcacggcaccaggggcgccggacaaatgccgcagactcagcgcggcgcgttcgtcgccggtcagcacagcgcgaatgtcggcgcgcgtcgcgtcgtcgaccttggtcgccagactgtgaaatgtcgggccatgcagcaaacgcacgccgggccgatccgcgagtgcgcagaacagtgacgttgcgtcggaaaagccgatgatcgtctttggcgttgcgatctcgtcgggcaagtgctcaagcaaatgcgcgcaaccgaatcccccgcgcgagccacacgatctcgatcgacggatccatcagggtgcgccgcaggtcgtccgcgcgctcctcggcggtcccggcgaaatagcggtaccggctgccgagatgcgcgccggccctgacctcgaagccccaactttcgaggagcgcaatgccacgcgcgatgccttccggatcgggcacacccgcaggcgcgaccacgcccactgccttgcgtcgtgattccattgaatggctacctggatgatggagaacctgccgaatatatccgacaccgcttgctgacggctcggccttgtcacgcagcgtcgtgcgcgcggggatgacgatcgccggcgtccgcgaaaccgctgcgttgccggtgccgcttgagaatcaccgtcgcggcaaaatcgccgaccgatcgatgcgaatcccgttcgatcgacgaaccaggcagcacgtcgagcggatgcacctcggagccgccggcgttgcgggcccttcccggcgtcaacgcgtcggtcggtaaccagtcagccatgtcgaacgcagggaatcgtacccatcccatcggacgtacgcgcaggcattcaagcaggatgtgatcagggagacgttggcgcccggcatgtcggtgtcgattgttgcgcgccggcacgacatcaacgccaatgtggcgtccggatggcgcaagcaatatcgtcagtgcaccgtcaaccgggtagatctggatcgatcgtgggtctcagtggacatgttgcggactcctcactcaacgaaccggagcaattcgcgcgaatctattgccctgcataccgacaccgcaccacccgtatggctcgccactgcagcgtggcgtgcgctccaccgcgctcaggcggcggcgatcgcgtgcagcgcctgcgacaccagttcggccgcaccgccgacgacgatcgcgaatccgactacgtaccgcgcgatctcggccggcgcccgcaccttcggtgccgccagtgcggcgcgcatgttcagcatcatttgcgtcatgatcgtcactccttcaatgaaatccaggatcgggacgaaacggccggccggacgaccggccgtttccgttactgcctcaccgtgctactgcacggcaacgctcacgcgaggtcgaagcggtcgaggttcatcaccttgttccaggccgcgacgaagtcgcgcgcgaacttctccttcgcatccgcgctgccgtacacctcggccagcgcacgcagctgcgcatgcgagccgaagatcaggtcgacgcgcgtgccggtccacttcaccttgcccgtcgcgcgatcgcgcccttcgaacacgtcgttcgcggccgacaccggcttccattccgtgcccatgtcgagcaggttcacgaagaagtcgttcgtcagcgcttccggacggtcggtgaacacgccgtgcttcgcctcgccggcgttcgcaccgagcacgcgcagaccaccgacgagcaccgtcatctcgggcgcgctcagcgtcagcagttgcgccttgtcgaccagcagcgcctcggccggcgtcttgaacgcgctcttcaggtagttgcggaacccgtcagccaccggctcgagcacggccatcgcttcgatatcggtctcttcctgcgatgcatccgcacggcccggtgcgaacggcaccgtcaccgcgacgcccgcgttcttcgcggcctgctcgacgccggccgcaccggccagcacgatcaggtcggcgagcgacaccttcttgccgcccgtctgcgcgtcgttgaacgccttctgcacgccttcgagcgtcgcgagcaccttcgcgagttcggccggacggttcacttcccagtccttctgcggggcgaggcggatacgcgcaccgttcgcgccgccgcgcttgtccgatccgcggaacgtcgcggccgacgcccatgccgtcgacacgagctgcgacaccgacagacccgttgccagcaccttcgccttcagcgcggcaacgtcggcgtcgtcgatcagcgggtgatcgactgccgggatcgggtcctgccacagcaggtgttccgccggcacttccgggccgagataacgggagcgcgggcccatgtcgcggtgcgtgagcttgaaccaggcgcgcgcgaacgcatcggcgaactcggccgggttctcgtagaaacggcgcgagatctttcgtaggccgggtcgaaacgcagcgacaggtcggtcgtcagcatcgtcgggcgatgcttcttcgacgcgtcgaacgcatcgggaatcacttcgccggcgtccttcgcgacccactggtgcgcaccggccgggctcttcgtgagctcccactcgtagctgaacaggtgcttgaagaagtcgttgctccacttcgtcggcgtcgacgtccacgtgacttcgaggccgctcgtgatcgcgtccttgcccttgcccgtgccgaacgtgctcttccagccgagaccctgctcctcgaggcccgcggcttccggctcggggccgacgttcgacgccggaccggcaccgtgcgtcttgccgaacgtgtggccgcccgcgatcagcgcgaccgtctcttcgtcgttcatcgccatccgcgcgaacgtctcgcggatgtcatgcgcggcggcgaccggatcggggttgccgtccgggccttccgggttcacgtagatgaggcccatctgcacggcggcgagcgggctttcgagctcacgcttgcccgagtagcggctgttcgggccgccgctcagttccagccagatcttttccgagccccagtagacgtcgtccggttcccacgtatcgacgcggccgccggcatagccgaaggtcttgaagcccatcgattcgagcgcgacgttgccggtcaggatcagcaggtcggcccacgagatgttgcggccgtacttctgcttgatcggccacagcagccggcgtgccttgtcgaggctgacgttgtccggccagctgttgagcggcgcgaagcgctgctgcccgccgcccgcaccgccgcggccgtcggccgtgcggtacgtgccggcgctgtgccaggccatgcggatgaacaggccgccatagtggccgaagtcggccggccaccagtcctgcgacatcgtcatcagggcgtgcaggtccttcttcaccgccgcgaggtccagcttgctgaacgcttccgcgtagtcgaaatccttgtccatcggatcggacagcgccgaatggcggtgcaggatgttcaggttgagctgattcggccaccagtccttgttcgtcgtgccgccaccagcggtgtggttgaacgggcacttcgtttcgttcgacatgcgatttctccttggcttgctcgtatgactccaccggttcgctccggcggcatgccgggtgcggttggtggagtgtcattgcggggatgggaaacggaacaggttgattctcctgtcgtactacgggatgtcgcgcggggcctgtaacgcgcgttcccgctgcgacgcgccgcgggcgggacgctcgggaaccggctgcccgcaggcgtcgtgacgacgccgcgggcggaattccagctttcggacatgcgatgctccctcatggcttgatggcgggtgaatcggggaacactgaaccggcgcgcggcggcgttcaaccgccatacacacgatccgcgaggtacgcgaacgcaatcggacgcaggctgcgaaccgccgccctggcgcgatgtacgaccgcgtcgcgcggcgggatgttccgctgcgcgtgctgcaataccgaccgcatcatgacatcctcctttgacgcttgcactcagcgtgcagaccggtcgtcgacaggacaccgatccatggagaggattctatatacgtctatcgattacttgaatttaattaatttcatctatgcgatagagaaaataaacggggtcgcaagaccccgttcatcgggctgccgcacgcgcatgccgcagcgtactcagttcatcgtcgccggcatgtcgagcttcgcgacacccggcagctcgcaggcggaaatcgcgtcgctgatcgcgtcgatcgcgggcatccgcgtgaagctcttgcgccacacgagcaccacgcggcggtcgggcaccggctcgttgaacggcacgtacgacagcagttcggcatcggggccgttcgcgcgcgggccgatctcggcaaccgacattcgcggcagcaccgtgatgccgacgccgctcgcgaccatgtggcggatcgtctcgagcgacgagccctcgaaggtcttctggatgccgtcggccgtctgcgagaagcgcatcagctccgggcacacgccgagcacgtgatcgcggaagcagtgaccgttgccgagcagcagcatggtttcctgcttcaggtcctcggcgtcgatctcctcacgcttctcccacggatggccggccggcagcgcgacgacgaacggttcgtcgtacagcgggcgcaccatcaggccggtttccggaaacggcagcgccatgatcgcggcgtcgatctcgccctgcttcagcaattcgagcagcttgagcgtgtagttttcctgcagcatcagcggcatctgcgggacacgctggatcatctgcttgacgagcgtcggcagcaggtacggcccgatcgtgtagatcacgccaaggcggaacgggccgaccagcggatcctgccctgcttcgcgatctccttgatcgcgaaagtctgctcgagtacgcgctgcgcctgcgtgacgatctggtcaccgatcggcgtcacgctcacttcgctcgcgccgcgctcgaaaatctgcacgttcagctcgtcttcgagcttcttgatcgccaccgacagcgtcggctggctcacgaagcaggcttcggccgcacggccgaaatgccgttcgcgcgcgaccgcgacgatgtatttcaattcagtcagcgtcattgtgggtcaatcagagatatacaggcgataggtttaatttatacaccctgtgacaccggttcgccaagtttctctgcatcggaatgcgtcgaatggcgattccggatccggccccagcccgcggatcaggctttcagatactgctcccgcgcgccgagccagcgcgcgagatgctgcgtgacgatttcgggatacgcggcaatcagccgcgtcgcggcttcgcgggccggatcgatcagccagccgtcggtctcgaggttcgcgaagcgcagcatcgccgcgcccgactggcgggcgccgaggaattcgccggggccgcggatctcgaggtcgcgccgcgcgatctcgaagccgtcggtcgtctcgcgcatcgtcttcagccgctcgcggccggtgagcgacagcggccccgtgtacagcagcacgcacaccgacgccgcggtgccgcgcccgacccggccgcgcaactggtgcagctgcgcgaggccgaagcgctccgcgtgctcgatcaccatcagcgacgcgttcggcacgtcgacgccgacctcgatcacggtcgtcgcgacgagcagctgcacttcgttgcgcgtgaacgcttccatcacggccgccttgtcggccggcgacaaccggccgtgcacgagcccgaccttcagctccgggagcgcggcggccagcgtctcgtaagtctcgacggccgtctgcaactgcagcgtctcgctctcctcgatcagcgggcacacccagtacacctggcgcccggtcagcgcggcctcgcgcacgcgggcgatcacctcctcgcgccgcgcatcgccgacgaggcgcgtcagcaccggcgtgcggcccggcggcagctcgtcgatcgtcgagacctcgagatccgcgtaatacgtcatcgcgagcgtgcgcggaatcggcgtggccgacatcatcaactggtgcggctggaagtcgcgcgcgccgttggccgcgttcgcggccttcgcccgcagcgcgagccgctgctcgacgccgaagcggtgctgctcgtcgacgatcacgaggccgagccgggcgaattcgaccgtgtcctggatgatcgcgtgcgtgccgatcacgagctgcgcggtgccgagcgcggccgcctcgatcgccgcgcgcttctctttcgccttcaggctgcccgcgagccacgcaaccgtgacgccgagcggctcgagccacgcgcgcagcttgcgcgcgtgctccgcgaggatttcggtgggcgccatcagcgcggcctggtagccggcgtcgatcgcctgcgtggcggccagcgccgcgaccaccgtcttgccgctgccgacgtcgccctgcagcaggcgctgcatcgggtgcgcgagcgtgaggtcgcgcgcgatctcgtcgacgacgcgcgcctgcgcgcccgtcagcgtgaacggcagcgcggcatagagccgggtcgtcagcgcatcggcatcgctcgcggtgcggcgcggcatcgcgggcgccgcgcgcgtgcggcgctcctcgtgcgcgcgcttgagcgacagctgctgcgcgagcagctcctcgaacttgatgcgcgtccacgccggatgcgagccgtccatcagcgcggcttcgtcggaatcgacacgcgggtggtgcaggatgcgcaccgcctgctcgagcgtcggcacgtcgagcggcttcaggtagtcgcgctggatctcgggcggcagcaactcgggcagcggcgtgcgctccaccgcgttctcgatcgccttgcgcaggtacgcctgcgacacgccggccgtgctcggatagacgggcgtgagcacctgcggcagcggcgcatcggcttcgacgacgcgcacggccggatgcaccatctccatcccgaaaaagccgccgcgcacgtcgccgcgcacgcgcagccgctggccgacggccatctgcttgacctgcgagccgtagaaattgaggaagcgcagcacgagctgctcgccgtcgtcgtcctggatcttcacgacgagctggcggcgcgggcgatacgcgacctcgttgtcgaacacgaccccttccgtctgcgcgatgccgcccggcagcagctcgccgatcggcgtgagcgtggtttcgtcctcgtagcgcatcggcagatgcagcacgagatcgatcgagcgcgtgaggccgagcttcgcgagcttgtcgacggtcttcacgggcttgtcggcggccggcttcttcttgcgcttcgcaccggccgggcctgccgcgccggcctcacccgctgcatcgcccgcggcggcgccgtcggcatccggcgcggcggccgccggctgcgcgagcctgccgtcggcgccgcgcttcgggccggcacggcgcggcacggtgcgcgccgccgtgtcgtgcacgggcggcgcagcgtcctccgcgtcgaacggatcggcggaatcggcaacggcagcggaggaacggcgtggtgacacaggcatcggatcgtctgggtgcttcgcaaggcaagtacaatagcggctttcacgtcgtccgaacgaacgacgccggccaggccgcgcatcccgccatcatagcggctcgcgcgccccattcatgcgtttccgccctgtcggcggcgcccgccggccgtttcgaaccagcccgcatgttcacgctttccgatttcgatttcaatctgccgcccgagctgattgcgcaaaccgcgctgcccgaccgcaccgcgagccgcctgctcgaggtcgacggcaccgttgagcccgcacgcctcgtcgaccgccgcttcgccgagctgccgtcgtgcatcgcgcccggcgacctgctcgtgttcaacgataccaaggtgctgaaggcgcggttcttcggccagaaggccagcggcggcaagatcgaggtgctggtcgagcgcgtgaccggcacgcacacggcgctcgcgcagatccgcgcaagcaagtcgccgggcgccggcacgacgctgcgtctcgccgatgcgttcgacgtgaccgtcggcgagcgcgtcgagccgttcttcacgctgatcttcccggagccgtgcctcgatctgatcgagcagtacggccgcctgccgctgccgccctatatcgagcacgatccggacgcgaccgacgagacgcgctaccagaccgtctacgcgagcaatccggggcggtcgccgcacccacggccggcctgcacttcgaccagccgatgctcgaccggctcgacgcgatgggcgtcgaacgcgcgacgctgacgctgcacgtcggtgccggcacgttccagccggtgcgcgtcgacaacatcgccgagcacaagatgcacagcgagtggtacgacctgccgcagtcgctcgtcgacaagatcgccgcgacccgcgcgcgcggcggcaacgtgatcgcggtcggcacgacgtcgatgcgcgcgctcgaagccgcggcgcgctccgccgacgaagcgggccgcccgctcgcggccacgcaggccgagaccgacatcttcatcacgccgggctatcgtttccgcgtggtcgaccggctcgtcacgaacttccacctgccgaagtcgacgctgctgatgctggtgtccgcgttcgcgggcgtcgagacgatccgagccgcgtaccgtcacgcgatcgccgaacgctaccgcttcttcagctacggcgacgcgatgctgctcacgcggcgcgacacgccggaggcgccgcgcgcgtagcacgacaggcgcgaaaatgcagcggcccgcgattgcgcagcggccgttgcgcctcgcgctgccgcacgccgcgtgggtgtctccgcgctgttacccccgcgcggttgccccgtttcccttggtacgcgctacgatggcgcgcatctgtttttccccgccgccggcctgccggcggcgtttccaacatgcgccggactgttttccggtagcaaggagaatgacgcgatgaccgaaggttcatcccacgatacgcacgccccgtgcaggaccgccccgcaaacgggctcgaattcgaactgctgacaaccgacggccacgcgcgccgcggccgcgtgaagctcaatcacggcgtggtcgagacgccgatcttcatgccggtcggcacgtacggcaccgtgaaggcgatccagccgcgcgagctgcacgagatcaaggcccagatcattctcggcaacacgttccacctgtggctgcgcccaggcctcgacacgatcgacgcgcacggcggcctgcacggcttcatgggctggaacaagccgatcctgaccgactcgggcggcttccaggtgttctcgctcggcgacctgcgcaagatcaccgaggacggcgtcacgttcgcgtcgccgatcaacggcgacaagctgttcctgtcgccggaagtgtcgatgcagatccagaaggtgctgaactccgacgtcgtgatgcagttcgacgagtgcacgccgtacgcgaccaacggcgtgccgaccacgcacaaggaagcggccgactcgatgcgcatgtcgctgcgctgggcgaagcgctcgctcgacgaattcaaccggctcggcaacccgaacgcgctgttcgggatcgtccagggcggcatgttcgaggacctgcgcgacgaatcgctcgcgggcctcgcggaactcggcttccacggcctcgcgatcggcgggctgtcggtcggcgagccgaaggaagacatgatgcgcgtgctgcgccacgtgggcccgaagctgccggccaacaagccgcactacctgatgggtgtcggcacgccggaggacctggtcgagggcgtcgcgaacggcgtcgacatgttcgactgcgtgatgccgacccgcaacgcccgcaacggctggctcttcacgcgcttcggcgacgtgaagatccgcaacgcgacgcacaagaactcgctgaagccgctcgacgcgagctgctcgtgctacacgtgccagaacttctcgcgcggctacctgcatcacctgcaccgcgtcggcgagattctcggcgcgcagctcaacacgatccacaacctgcactactacctgcagctgatgagcgagatccgcgacgcgatcgagacccacacgttcgacgcgttccgccagcgcttcgcggaggatcgcgcgagaggcgtcgactgacgggccggctgcccgcgccgcggcccgccacataggacaagtactaaataacgcgtcccaactgtcgaatccggccgccaaacattacaattgcctttccaaacgagtcgcaacggtaccggttcgcgctttaacagcttgatccgaaagcgcatttgccgagccgtttgcgcatggggccggtggtagaataaccggcttatttttcgatcttcccctacggagagaccaacgtgccgttcatttccaacgcgttcgcgcaaggtgccggtggcgccgaatcgagcctgatgagcttcctgccgctcatcctgatgtttgccgtgctctacttcatcatgatccgtccgcagatgaagcgtcagaaggagcaccgcaacatgctcgcggccatggccaagggcgacgaagtcgtcacgagcggcggcctcgtgggcaaggtgacgaaggtcaccgaaggctacatcggcgtcgagatcgccgaaggcaccgaaatcaccgtgcagaaggccgcggtcacgaccattctgccgaagggcacgatcaagtcgctgtaagcccttcaccgagcgtccggcatcccgcgccgtgcccgcctgagagagcgggccgccgcggcgccggacgcgacgctttcacgccaaccacccgttcggctccctcatgaatcgttatccactctggaaatatgtcgtgatggtcgtggcgctcgccatcggccttctgtacacattgcccaacttcttcggcgaagcgccggcggtgcaggtgtcgagcggcaaggccacggtcaagctcgactcgaccacgctgacccaggtcgaatcggcgctcgccgccgcgcagatcacgccggacgacgtcaccttcgagaacacggcgaccaacgcgaacatccgcgtgcgcctgaaggacaccgatacgcagctgcgcgtcaaggacctgctgcagaagtcgctgaacgccgacccgaacgatccccagtacgtcgtcgcgctgaacctgcagagcgcgtcgccgcgctggctgaccgcgctgcacgcgctgccgatgtatctcggcctcgacctgcgtggcggcgtccacttcctgctccaggtcgacatgacgggcgcgctcacgaagaagctcgattccgacgcgtccgacgcgcgcacgctgctgcgcgacaagaacatccgcgacggcggcgtgagccgcgtcgaccagtccgtggtcgtcaatttcagcgatgcgcagacggcggaagacgcccgcaaggtgctcgcgctgtcgatcaccgaactgcaatgggcgacccagcccggcggcggcggcacgcaggtcgtcggcacgtttacgccggccgtgcagaagtccgtcgaggacgccgcgctcaagcagaacctgacgacgctccacaaccgcgtgaacgaactcggcgtgtcggagccgatcctgcagcagcagggcagcgaccgtatcgtcgtcgagctgccgggcgtgcaggacaccgcgaaggcgaaggacatcatcggccgcaccgcgacgctcgaggcgcgcctcgccgacccgatcaacacgcacccgaacccgaacgacccggtgccgccgggcgaagagctgttcacgcagggcaaccaggcgcccgtgctgctgaagaaggaagtgatcttcacgggcgaccgcatcatcgatgcatcggccggtttcgacgatcaccagcgtccgtcggtcaacatccgcctcgattcggcgggcggccgctcggtgcgcgcggtgtcgcgcgagaacatcggcaagccgatggcgatggtgctgttcgagaagggcaagggcgaggtgctgacggtcgcgacgatccagtcggagctcggcgaccgcttccagatcacgggccagccgacgccgcaggccgcagccgacctcgcgctgctgctgcgcgccggttcgctcgccgcgccgatggacatcatcgaggaacgcacgatcggcccgagcctcggcgccgacaacatcaagatgggcgtccactcggtgatctggggcttctgcgcgatcgccgtgttcatgatcgcgtactacatgctgttcggcgtgatctcggtgatcggcctgtcggtgaacctgctgctgctcgtcgccgtgctgtcgctgatgcaggccacgctgacgctgcccggtatcgccgctatcgcgcttgcgctcggcatggcgatcgactcgaacgtgctgatcaacgagcgcgtgcgtgaagaactgcgcgccggccagccgccgcagctcgcgatccagtcgggctacgcgcacgcatgggcgacgattctcgactcgaacgtcacgacgctgatcgccggcctcgcgctgctcgcgttcggctcgggcccggttcgcgcgttcgcgatcgtgcactgcctcggcatcctgacgtcgatgttctccgcggtgttcttctcgcgcgggatcgtcaacctctggtacggcggccgcaagaagctgaagtcgctcgcgatcggccaggtgtggaagccggaaggcgccgctgccgccgcaccgttcgccgaggcggacgatgcgaccgacaccgcgcgtgccgcgaagctcgccgcgcccgcgaagggcaacgcgccgcgcaccggcaagccgcagctgcgcaaccgcgcgcagcaaggcgtgtcgccgaagaaaccgggctcgacccaataaggccccggagaagaccatggaatttttccgcatccgtaaagacattccgttcatgcggcacgcgctggtgttcaacgtgatctcgctggtcacgttcctcgccgccgtgttcttcctgttccaccgcgggctgcacctgtccgtcgaattcaccggcgggacggtgatcgaggtgcagtaccagcaggcggccgaactcgaacccgtgcgcgcgacgctcggcaagctcggctacgtcgacgcgcaggtgcagaacttcggcacgtcgcgcaacgtgctgatccggctgcagctgaaggaaggcctcacgtccgctcagcagagcgaccaggtgatgagcgcgctgaaggcacagagcccggacgtcacgctgcaacgtgtcgaattcgttggcccgcaggtcggccgcgaactcgcgaccgacggcctgctcgcgctcgcgtgcgtcgtgatcggcatcgtgatctacctgtcgttccgcttcgagtggaagtacgcggtggccggcatcatcgccaacctgcacgacgtcgtgatcattctcggcttcttcgcgttcttccagtgggagttctcgctggcggtgctcgcggccatcctcgcggtgctcggctactcggtcaacgagtcggtcgtcatcttcgaccggatccgcgaaacgttccgccgcgaacgcaagatgaccgtgcaggaagtgatcaaccacgcgatcacgaccacgatgtcgcgtacgatcatcacgcacacgtcgaccgaaatgatggtgctgtcgatgttcttcttcggcggcccgacgctgcactacttcgccctcgcgctgacggtcggcatcatgttcggcatctactcgtcggtgttcgtcgcgggctcgctcgcgatgtggctcggcatcaagcgcgaagacctgatcaaggaaaagaagaccgcgcacgatccggacgatcccaacgcaggcgcgcaggtttaagcgccgcgctgcttcggcacagatgaaaaccggcccggttgggccggttttttcgcctgtattttcgcccgtaccgccggcgtggagcgcgcagcccgctcgccctgcccggccacgcgcgtcggctacaatcgtgaccgtcccgccggccgtgcgccggcgggacagcaccttcgccctccgttccaacgtgcggtcccgatgatgccttctacgcgtgccgttcttcgccttgccgtttgcgcagccgtcacggccgcgttcctgccgtgcgcgtcaccggtcggtgcgcaacaaccggcacccgccccgcccgcttctgctcccgccgcctcatcctcgtcatccgcctcacccgccacggcccggccgccttcgccctgcccgcccgactgggagccgcagatctgcgagctcaaggcggcggtggaagtcctgaagcggcagcacctgaccgacgtcgacatcggcgcgctgctcgacgccacgacccacgcgggaatcaagacgctgccgtacgcgcgtttcttcgatgcgaaggaggagcgggagcggcgcgaagacgaacggcgcgcgcgcgacggcacgcccggcatcggcatcgtcttcgagacgcggcccgacgggctgcacatcgtcgacgtgattcccgacgcgcccgcggaacaggccggcgtgcgccccgacgatctcgtcgtcgcgatgaacgatacgagcgtcgtcggcatcgacgccgccgacctgaccaagctcgccaagggcgacgcgggtgtgccgctgaagctcacggtacagcgcggcccgtcgcacgcgatgctgagcttcgcgcccgtgcggacgatcctcaagccgcaccccgcgaccgcgaaacggctcgccggcgacatcctgtacacgcggctgtcgagcttcccggaacccgcggtcggcgcctacatcgacgcggtgcaggccgcacgccgcgcggggccgcccgtgaaaggcgtgatcctggacctgcgcatcaacggcggcggcgcgctcaatgcggcgatcggcatcaccgcgctgtacgcgggccgcgatcgcaccgcgatggtgacggtcgagcgcggcgacgccaaccggcgccgctacacgaccaactggcccgattacgcgttgccggtcatgcacggacaggatccgctcgcgccgttgcaggccgacgactggtggcgcaccgtgccgctcgtcgtgcttgtcgacggacagagcgcgtcggccgccgaggcgaccgcggcggcgctgaaggatctcggccgcgcgaagctgctcggcatgccgacctacggaaaggggctcgcgcagacgggcgtcgacctgatcgacggcacgcgcctgaatttcacgttcgcgcgcaacctgcggccgaacggctgcccgatggacggctacggcgtggtgccggactggctcgtgccgccgcgccgcgactcggacgtcgacggcgtgctgctgtggtaccgcgaagccgatctcccgcgcgcgccatatgccgaccggctggcgcccgacccgttcgcgaaggtgcgcaaggagcggcagaagctgcgcgagcagcgtgcgcttgcaaagatcgactcggcgaagagcgcggcgctgccgcagcgcgagttcggcacggcctccgactggcagctcgggcaggcccttgccgcgctcgcggggcgccccgtgcgaaccatcgacgccaagccgcaactgatgcccgcgcaacccgtgtgcgagcgcgccggcaactgacgcgcgccgcctgccccgttaccggaagccgaaccgccggcgcagcacgaccagcgccgcgaggctcagcacggccgcgaacatcaggtagaagctcggcgccgtcttcatcccggttgccttgatcagccacgcgatgatgaacggcccgaagccgccgaagatcgtcaccgcgacgttataggcgagcgacatcccggtcgtgcgcgtctgcaccgggaacacttcggacaacaaacccggcagcgccgcgaagtagcccgtcatcaggaatgcgagcagcacctgcagggcgatcagcgtgccgaagcccggatgggcgaccagatacgcgaatgccggatagatcagcacgaggatgccgatcgccggcgcgatcatcacacgcacgcggccgtaagtatccgaccagtggccgacgagcggtgcgaacaccatctggatcacgccgacgacgaggatcgccgcgaacgcggccgacggcgcgaggccgagctgcttcacgccgtaggtcggcatgaacagcacgagataggtcgcgacggtgccgagcacgaccacgcccatcgcggcgacgagacgcgccttgtgcgacgcgaacgtgtcccgcagcgggttcgcggtgccttccgccgcgaggaattcgggcgtctcgtcgaccttcgtgcggatgtagtaagcgaccggcccgagcagcaggccgaagaagaacggcacgcgccagccccacgacgccatctgctcggccgagagctgcgcgttcagcacggtgccgaagccggcggcgagcagcgtcgtgagccctggctcgcgacctgccagctcgcgaagaagccgcgccggcccggcacgtgttcggcgaggaacgcggtcgcgctgccgaattcgccgccggccgagaagccctgcatcagccgcgcggcgacgaggatcaccggcgccgcgacgccgatcgccccgtaggtcggcagcaccgcgatgatcagcgtgccggccatcatcagcaggatcgacagcgtgagcgcggccttgcggcccgcgcggtcggcgtacgcgccgagcacgatcgcgccgagcgggcgcatgaagaacgacacgccgaacgtgccgagcgtgagcagcagcgacacggtgtcgttgccggccgggaagaacagcttcgagatcgtcaccgcgaaaaaccgtagacgacgagatcgaaccactcgagcgcattgccgatcgacgcggcgaccaccgcgcgccacacgcgcggcgacgaggcaatgggacgggactgcgtgacggcatgcatcggcgatctccttgtcgttgtacgttctgttcgaggcggccgcggccacgcgcgcgccgtcggcgccgcccggcgccgcgagcggcgctcgggcgattataggcgcgcaaaaaccgccgcgcccgtggaacgggaacgcggcggttggcgcgcgacgggccggcacggcggccggcccggctggcggtattactgctgcttgacggcttcggccgtgatcagcagcttcgtcttcatcttgaagccgtactgcttgccgtagtcgaggccgaaatcgtcgcggctgaattcgccgaccgcgtcgacgccgcagacttcacgcttgagcatcggatgcggcatgcacttgaacgagtcgatcttcagcgtcaacggcttcgtgacgccatgcagcgtcaggttgccgaccaccgacaccggcttgtcgccgtcgaacttgatcgtgcccttgtagttcgcctgcgggaacttcgcgacgtcgaagaattcgttcgtctgcaggtgctcgtcgagcttcgcgctgccggtgtggatcgacgcgatgtcggtcgtcacgtcgaccgtacccgtcttcgccgcgcgatcgagcgtcacggtgccgctcgacttgtcgaacttgccgcgccagaccgacaggccgccgaagtggtcggcctcgaagctcgggtacgtgtgggacggatcgaactggtaggttgcgctgtcggcgaatgccgagaacgacagcgtggcagccagtgcgcccgcggcgatcatcagatgctttttcaactctttctccttggaacggcgccgcgccctcgcgcggcattcgggtgatgcgatggttcgccgcttacttcgtggcgacgagatggaacttgatctgcacttcgtccgcgacgaccgacgtgtccttccactcgccggtgccgacgttgaaggccgaacgcttgatcggcagcacgccgtcgaacgtctgcgtcgcgccgttctgcgtgaccgtgacgggcaccgtgacggtttcggccttgcccttgatcgtcagcttgccggtcacgttgtacttgttgccgccggccggtgcgatcgccgacgacacgaacgtcgcctgcgggaaagccttcgcgtcgaaccagtccttgccggcgacctggtcgttgtacatcttgtcgccgaggtcatagctcgcgacgtcgatcgtcatctgggcgctgccctgcgcggccttcgccggatcgaacttcacctgcgcggaaaacttcttgaacgcgccttcggtcggcacgttcatctgcttcgacacggcagacaccttgctcttcgcgagatcgacatcggcgtgcgccgcgcccgacgcgacaagtgacaccgcggcgagcgcggtcagcatggagcgggagaaagacactttcatgggatccttcatttggcaaagggaagcatccgcgacagcaggccgtcgcggtccaacaactggtgcttgagcgccgcgagcacgtgcatcgcgacgagcgcaagcagaatgtaattcaaggacacgtggagcgtcttgaaggtttccttcagcaccggatcggggtcgatcagccgcggcagcggcacgatgccgaggtagacgaccgggatgttcgaggccgagctgtacaggtagcccgtcacggggatcacgatcatcagcacgtacagcagcatgtgcacgccgtgcgataccacgcgctgccacgccggcgtatcggccggcagcggcggcggcacgtgggtcgcacgccacagcacgcggatgacggccagcgcgaacaccgtcacgccgatccacttgtgccacgagaagtacttcagcttggtcggcgtgaagccggggatgtcggtcatcacccagccgagcgcgaagccgcagatgatcagcagcgcgatcagccagtgcagcgcgatcgcggtatgcgcataacgtgccggcacggccggcggcgatttcgataccatcctggattcctcagttcagcgaacagccgcgccggccattcgtccgacgcttgtcaagggcgccatgctaccgcaacctttgacgcgcgcggactctgaggacaggcatgtcagccggccgacagcttcccgtcatgttaccggccggtcacaaaccgcacgatccttgacacgccgaaaaggcccttttggtaagattggcgcgggttccggccccgtcgacgcgtgtccccggccgtcgcacaactgccttttccatgcaacgatacgacctgattgcctgtcacgagtgcgacgcactgttgcacaaaccgcgcctgagcggccgcgaaatcgcgcgttgcccgcgctgcgacgcgctgctttatcgcaacagcgcggcgcagatcgagcggatctgcgcgctcgcgctcgcggcactgatcacgttcacgattgcccaggcgttcccgatcctcgaaatggacgtgaacggcaaccgcgtgcagaccacgctgatcggcgcgatcgactcgctgtggcgccaggacatggcgatcgtcggcgtgatggtgttctgctcgaccgtgctgttcccgctcgtcgagatggccgcgctgctgtacctgctgctgccgatccgccgcggggtcgtgccgcccggtttcaacctcgtgctgcgcgcgatcgagatggtgcggccgtggggatgatcgaggtattcatgctcgggatcctcgtcacgatcgtcaagatggtgagcctcgcgcgcgtcgtgccggaagccgcgctgttcgcgttcgccgcgctcacgctgatgatcgccgtggtgctgatgttcgatccgcgcacgctgtgggacatcgtcgacgacctgcgcgccgggcgctcgcccgggcagcccgacgcgcccccgttgccggaagccgcccgccgatgacgatcccgaccgccgcccgcgagggctacgtcagctgccacacgtgcgggctcgtgcagacgctcgaccatccgcacgcgcattgcgcgcgctgcggcagcgcgctccatttccgcacgccgaacagcctgatgcgcacgtgggcgctgctgctcgcggccgcgatcctgtacattccggcgaacctgctgccgatcatgcgcaccgcgtcgatcgtcggctcgcaggaagacacgatcatgagcggcgtcatctatttctgggtgtcgggcgactggccgctcgccgtcgtcgtgttcgtcgcgagcatcctcgtgccgatgctcaagctcggcgtattgctgatcctcgtgatcagcgcgcagcgccgcaccgcatggcggccgcagcagcgcacgcggctgttccggatcgtcgagcgcatcggccgctggtcgatgctcgacatcttcgtcgtgacgctgaccgtcgcgctcgtccatttccgttcgctcgccgtcatcacggccggccccggcgcactcgcgttcggttccgtcgtgatcctgacgatgctcgcgtcgatgcagttcgatccccgcctgatctgggatccagtcgaaacctcagggaatcaccatgaatagtccacaaggcccgcagcacgacgcgccccggccgcccgatccgacgatctcgacgaaaagcggctggctgccgtcgctcgtctggctcgtgccgctgatcgccgcgctgatcggcatcggcctcgtgatcaagtccgtgcgcgaacgcggcccggaaatcacgatcagcttccacagcgccgaagggctcgagcccggcaagacccaggtcaagtacaaggacgtcgagatcggcatggtcaagacgatcaagctgtcgaaagacctgtcgcgcgtgctcgtccaggtgcagctcaagaaggaagccgaggacttcgcggtcaagggctcgcgcttctggatcgtgcggccgcgcgtcggcgcgaccggcgtgtcggggctcggcacgctgctgtcgggcgcgtacatcggcgtcgacgccggccgcggtcaggacacgctgaccgatttcacgggcctcgagacgccaccggccgtcacgggcgaccagaaaggcacgcagtacgtgctgcgcggcgattcgctcggctcggtcgacatcggctcgccggtctactaccgccgcgtgcaggtcggccaggtggtcggcttctcgctcgacaaggacggcacgggcgtcacgttcaacgtgttcgtcaatgcgccgtacgaccagtacgtcggcatcaactcgcgctggtggcaggcgagcggcgtcgacctgcggctcgattcgagcggcctgaagctgaacacgcagtcgctcgcgacggtgatcctcggcggcatcgcgttccagacgccgccgaaccagggctccggcacgaccgcgccgaacaacaccacgttccgcctcgcgtccgacgagggcgacgcgatgcgcgacccggacggccagccgctgcaggtcgtgatgaacttcaaccagtcgctgcgcgggctcgccgtcggcgcgacggtcgacttccgcggcatcgtgctcggcgaagtgacgaacatcggtatcgacttcgatccgaagacgaagaacttcctgatgccggtgacgatgaacatctatccggaacgcctcggccggcgcttccgcgaaacgatcgagagcaagggcgaaccggcccgccgcgagatcgtcgagcggctcgtccagcacgggctgcgcggccagctgcgcaccggcaacctgctgacgagccagctgtacgtcgcgctcgacttcttcccgaaggcgccggccgtgaagatcgacacggcacgccagccgctcgagctgccgaccgtgccgaacacgctcgacgagctgctgcaggtcgccgacatcgcgaagaagctcgacaaggtgccgttcgaccagatcggcgcgaacctgaacagcgcgctcgcgaacgccgacaagctgttcaagcagctcgacacgcaggtcgcgccggaagcgcgcgacacgctgtcggccgcgaagcagaccttctcgaccgccgaagcgacgctgcagcaggattcgccgctgcagtccgacgtgcgcggcgcgctgaaggaactcacgcgcacgctgcaatcgctgaacgcgctcgccgactacctcgagcgtcaccccgaatcgctgctcaagggcaagccaggagatcaaccatgacgacacgcgtgaacggtttcgcgagcggtgctgcggcggttgccgccgccctcgcgctcgccgcgtgcagctcgccgcccgcgcggttctacacgctcagcccggccgacgccgcggcgccgctgcgcaccgcgccggccaacccggcgttcctgatcgaggtgccgtccgtcggcgtgcccgagcaggtcgcgaagaaccagctggtcgtgcagaagaacgccgcgcaggtcgacgtgctcgagcaggaacgctgggcgtcgccgcctgccgacgagatccgccgtgcgctgtcggacgatctcgccgcgcggctcggcacgatcgacgtcgcgaattccgcgtatccgcccggcgtgcccgtgtatcgcatcagcgtgaacgtgcagcgcttcgagtcgtggccgggcaaacgcgcggcggtcgatgccgtgtggagcgtgcgctcgctcgccacgcaggccgtgatgacctgccgcacgagcgtcgccgaaccggtcgccgacggctacgacgcactcgtcgccggccaccggcgcgcgctcgacgtgatcgccacgcaagccgcggccggcgtgcgtgccatggccgcgcgccgtggcgcatcggctgccgcggcacccgcggccggcggcaagacggccgccgcgccggtcgtgccgtgcccggccaatccggcgccgggcggcgacgccggcgcgacgggcaagtccggcgcgtaagcgtgcggcgcgcaggcgaacgctcgacggcgtacgcgcctgcgcggcttcgtccagcgcggcgcgtccgatagcgaccgccggccgccgtcggcgatgcgctgccgcggccggccccggccccgcgtcgcgctccccggccggacggccatgacattgtttgtcaaagtcggccggaaccggcttcgtgcaacgcggtcggcttgcgttttccggcccgattgacgatcctacgcactttcaggcccgcgccgctcgtcgtgcgcgccagccagcggcgccgggccgtgttcggcccgaccgccgtgccgcccggcgcccgcaccgtgcaccgcagcggggcagccgcatcgcgggtcgcctcgcatcgtccggcaacctgccccgtctcacccgttctccccggcgccgcgccgtttcccggccggcatcccgaacccgcccgccgagggctttcgctattccgtttatgtttcgttccctgacgaccctgatcaagaagtggcgcgcgtcgcgcaatgccggtcaccagctcgatgcgctgctcgcgcacgccgacgccgatgcgtcgtacgccgagcgcagcgaatggctgatcgagctcgcgcactggctgcgccgcaccggcacgatgcaggacgcgccggccgatcgcgacgccgatgcgcgcgcgtatccggcccacgcgcgcttgcgctacctgttccacgtgctcgatcgcaaccccgcatggaaggcgcacgccgcgcgcatcctgcgcggcatcctgcgcgagtgcgacggcatctcgctcctgtgcgacgccggcatgcccgtgcactcgggcttcttcggcgcgctgttcgagcggatcgactcgtcgctgatcccgccggcgccgaaccgccgcgagctgtcggcgctcttcacgctgatgttcccgacgccggaagacgcgcaatggatcgacgcgctgcccgacgatctcctcacgcgcctcgccgacctgttctcgttcgacgtcaccgacgaagagcgccacgagccgggttcgttctcgcgcgacctgctggccgcgctgcacaacctgacctgccagatcagctcgaccggcctgtcgcagacggtgcgcagccggctctccgacgacgacgcgcgcaagccgctggaaacgcagccgttctatcgcctcacgcgcgcgatgctcgcggtcgagaccgcgcacgcggccgtcgaggacggcggcgacccgagcaagctgctgcacgaggtcaactacctgcgcgtgctgctcgacgaatgccggatcgccgtcgacgaggtgttctcgcacctgtaccgcaacggcgtgtcggtcgacatcgtgttccaggtcgagcggatgcgcatgcgcatcctgcgcgccgagatgctgctcaacgcgtggatggcgcgcgacgacctgcacgggatggcgcacctgacggccgagctcgtcgacgcgaaccacaacagccagagcgtgtcgcacctcgtgcgcagcaacttctcgctgttcgcgcgcaagctcgtcgaaaccaacgcggacaccggcgagcactacatctcgcgcggccgcgccgagtacctgaagatgctgcggatggccgcgggcggcggcctcgtcaccgtcgtgacggtgtgcgtgaagttcgcgatcacgggcgcgcacctgcagtcgatgctcgaagggctgctcgcgggcgtcaactacgcggccagcttcatgctgatgcacttcctgcacttcacgctcgcgaccaagcagcctgcgatgaccgcgccgacgctcgcgcgcgagctggacgacacgggccacgacgaaggcgtgaaggcgttcgtggcatcggtgatcgcgctgatccgcacgcaggccgccgcgatttcgggcaacgtgctcgtcgtgctgcccgtgtgcctgctggtgcagctgttcgccagcaacctgctgcatgcgaacctgatctcgccggagaaggcgcacgcgacgctgcactcgttctcgctgctcggcccgacgccgctctacgcggcgctgaccggcgtgctgctgtgggcgtcgagcctgctcgcgggttgggccgacaactggttcgtgctgcaccgggtcggcgacgcgctcacgtacaaccgccgcctgcgcctcacgctcggcgcggccggcgccgcgaagctcgcgcatttctgccggtcgaacgtggccggcgtggtcgcgaacgtcggcctcggcctgatgctcggcctcatcccggcgatcgtcaccgtgttcatgttcccgttcgaggtgcggcacgtgacgctgtcggccggttcgatcgggatcgcgctcggcgtgctgggcaaggacgcgctgggcaccccgagctgtggtgggccggcgccggcgtgctcagcatggcgatcctcaacgtgctcgtgagcttcgcgctcgcgttcacgatggccgtgcgctcgcgcagcctgcgtccgaccaaggtgcgcgcgctcgtcgccgcgatcgtccgcacggtgctgtcgaatccgctcgcgctgttctggccgggcagcagcccggccgcccgcgccggccagccgggctcgcactgagcccgcggcggcctggcggtgcccgcccgggcaccgccgggccgcccggcacgcatgcgcggcgcccgggcccgcgccgcggcaccgaaacgcgacgcaacgccggccccggccgcccgcgccgcgtacaatagtggacttttgcacgtcctcacccgccttatgtcctcgcccaccctgtacgaattcttcgccccctgcccgcgcggcctcgaagcggcgctcgccgccgagctggccgaaatcgccggccgccacctgaacggcgcgccgttcaccgcgggcgcgcaggtgccgggcggcgtccacttcagcggcggctgggccgccggcatggccgcgaacctccattcgcggatcgcgagccgggtcctgctgaagatcgcgcaccgcgcctaccgcaacgagcaggacgtctacgcgctcgcgctcgagcagccgtgggagcgctggttcgcggcgacgcagacgctgcgcgtcgacatcaccgcgatcaagtcgccgctgaagagcctcgaattcgcgacgttgcgcgtgaaggacgcgatctgcgaccggatgcgcgagaagaccggcgcgcgcccgagcatcgataccggtgcgcccgacgtgcgcgtgttcgcgttcctgacggccaacgagtgcacgctgtacctcgacacgtcgggcgagccgctgttcaagcgcggctggcgcctcgacaagggcgcggcgccgctgcgcgagaacctcgcggccggcatcctgcgcctgacgggctggacgcccggcacggcgctgtacgacccgatgtgcggcagcggcacgttcctcgcggaagccgcgcagatcgcgctcggcgtggcacccggcgtcgagcgccggttcggcttcgagaaactcaagcaatacgacatcaccgcatggcaggggctgaaggtcccggcactggacgcgaagcgcgcggcgcgcggcaaacgcggcgaagcgctcggcgtgtacggcagcgacatctccggcgacatgctcgagaaggcacgtgcgaacctcgagcgcgcgggcgtgccgtcggtgtggctcaagcaggtcgacgcgcgcgggatgacgccgccctgcgacggcccgggcatcatcctcgcgaacccgccgtacggcgagcggatcgaggtgcgcggccgcagcgcgcgcggcgaggtgcgcgagacgggccgcaaccgcggcaacgacgacgcgttccgccgcacccacaccgacgcaccggacagcgagttcttcaacgcgctcggcgatgcgctgaagcagcgtttcacgggctggcaggcgttcctgctgacgtccgatcgttcgctgccgggccagctgcggctgcgcgaatcggccaagacgccgctgttcaacggcgcgctcgaatgccggctgttccgcttcgacctgatcgccggcagcgtgaaggcgcgcccggccacgccggaaggcgacgcgtaatccgcatcatggtcgcgacggggccgccgatacggcccctgcgcgacaaccggaacgacgccgttaccgcatccgcggcaacggcggcgttccgtttcaatgcttcgacttctcccggcgccccgtcgtgaacggcagcgcctgccccgtctcgagcagcgtcttgcggctcgacggcacgaccggccactcgccgcgaatctcgcgatccatcttccatctccgagcccggcaccagcccgtcgtgcgtgacggtcggcttcacgacgcaggtcacgcgcgattccccactctccccgacgagcatgcgccacgtgacgaccagccggtgcggcggatcgttcccgacctctactgacaatacggtgtcagcagaccgcgatcacactgcaatcccggcgcaatgcaaggctggtttccgcaccgaacccgaacaacaacgcaacaaggaactcgtcatgacgtccgcaactgcaactgcaactgccaccgccactgccactgccacccccgagcgcgcaatcgcgtggttcgacattccgtccctcgatttcgaccgggcgatccgcttctacgaaaccgtgctgcaaacgacgctgcagcgcgaagtcatcggcggcgtgccgatggccacgttcgaccgcgacgcatcgagcacgggcggcagcatcgtgttcgatccgcagcagatcaagccgagcgcgaacggcgtgctcgtctacctgaacgccggcgaatcggtcgtcgcggcgctcgaacgcgcgaagcgcgcgggcggcgtcgtgcagggctccgtcgtcgagctgccgaacaactacggctacgtcggctacctgatcgacaccgaaggcaaccgcgtcggcctgcacgcgccgaaatgccactgagcgcagcggccatcaggcgcgcgcggcgctatcatcgcgaagtccccattgccgttggagccgaggtgccgtcatgacgcgccgtgccgaccgcctgttccagatcgccgagctgctgcgcgggcgtcgtctcacgaccgcgcagcagctggccgactggctgtcggtgtcgccgcgcacggtctatcgcgacgtgcgcgacctgcaactgtcaggggtaccgatcgaaggtgaagccggcatcggctaccggctgaaccgcaacgcgagcctgccgccgctcacgttcacggccgaggagctcgcggcgctcgccgccggcgcacgcatgctcgaaacctggggcggcgcgcgcttcgcgagcggcgcacgctcggcgctcgcgaagatcgcgtcggcgatgccggccgacaagcgcacggcgctcgaccgcctgcccgtgttcgcgccgtcgttccacatcgacgagacgttttgcgcgaaggtcgatgcgatccaccaggccatcgatacgcgccacgtcgtcagcttcgactaccgcgaccggctcggcgcgcattcgcaacgccgcgtgtggccgctcgggctcgtctactggggcgggcgctggacgatcggcgcgtggtgcgagctgcgcggcgatttccgcaccttcgacattgcgcggatgggcgacatcgtcgtgcacgagcagtttccggacatggaaggacggcggatcgccgattacatgcggatcgcggaagcgccgatgcgctgatgcggcacggcggcgggcgcaccgccgccgtccctgtttcgggccgccctccgtgcggcgcccggcccgcctttcctacgcgccgaacaccaccgtgcgcttcggccgctcgtcgacgtgcagcgagaacacgtcgggccgcgcgtaatgcccgaccacgtcgaagtcgtaacgcgcccgcacgagttcgtcggtatcgatacgcgcggtcacgagcccggccgtgccgatcagcggctccgtcagcaggtcgccgagcggcccgacgatcacgctgccgccgcggatcagcggccgctccggatcccagcccggcacgtcgatcccgagcgcgcgcggcgacggctgcacctggcacgcgctgacgacgaagcagcgccctcgtgcgcgatatgccgcatcgagctctgccacacgtcgcgctcgtcgacggtcggcgcgcaccagatctgcacgcctttcgcgtacatcgcgcagcgcagcagcggcatgtggttctcccagcagaccgcggcgcccgcgcggcccgcggccgtgtcgacgacgggcagcgtcgagccgtcgccctgcccccagatcagccgctcggtgccggtcggcatcagcttgcggtgcttcgcgacgagcccgtcgcgcggatcgaagaacagcgccgtgcagtacagcgtgctgccgccgcgctcgatcacgccgaccacgaggctcgcacccgtgcgctgcgacagcacggccagctcgtcggtttccggccccggcacgtcgatcgcctgcgcggcgtagcgcgcatacgcgtcgcggccctcgggcagccggtagccgagccgcgtgccgaagatctcgcctttcggatagccgccgagcacggcctcgggcagcacgacgagcgacgcccgctgtcgcggatcgcggtttcgtagccgaggatcgtgtcgagcgtggcgcgcgtgccgtcgggcgatgcgccgatctgcagcgcggcgatgactgaagtggacatgaaggcgtctccggtgaatggggtaacgccatctttatcgatatgatgtcatcgatcaaatcgatagaacgataagtgtcatgaatgcggatgatatcgccagcctcgacctgaacctgctgaaagtgttcgaggcgctgtacgaagaaggcggcgcgagccgggcggcgctgcggctcggtctcacgcagtcggcggtgagcgcggcgctcgcgcggctgcgcgtgatctatgccgatccgctgttcgtgcgcaccggccgcgggctcgcgccgacgccgcgcgcggacgaactgaaaccgatcctgtccgacgcgctcgaccgttgccgcgaaagcctcgcgatcgcggccgacggcggcgaccgcatcggccgcacgatctcgatcgggctgtcggacgacttcgagatcgcgctcggccgcgcgctgatcgacgccgttgcacgggaagccgccggcatccggctgatcttccggcagacgcacagcggcatcgccggcgacgcgctgctgcgccacggcgtcgacctcgcgatcgcatcgggcggcttctcggcgaacgggctcagccggcgcgcggtcgcgacgggcggttatgcgtgcctgatcgacccggccgcccgcccacggccgccgcgcacgctcacgctcgccgatttcctgcagcgcgaccacctgctcgtgtcgtcgggcggcgtgatcgggatcgtcgacgaggcgctggccacgctcggccacaagcggcgcgtcgcggcgtcgaccacgcatttcgccgcgttgccgtacctgctcgccggctccgacgcggtggcgacgattccctcgcacgcggcgcgcgcgatcgcgcgatccacgccgttgcgcgcgctcgcctgcccggtcgacttgccgcattacccggtcgaaatcggctggcgctcgagcacgcagcgcgacccggcgatcgtgcgcgtacgcgacacgatcgccgcgtgcatcgcgaacctcgtcgcaccatgaaaacggcccggccggcttgcgccggtcgggcctgtccttcgaggctgcccgtgaatcggggcaggccgccagcggccggcgcatgcgtcagtcgaccgccttcaccatgtcctcgatgaccttcttcgcatcgccgaacaccatcatcgtcttgtccatgtagaacaggtcgttgtcgaggcccgcgtagccggccgccatcgaccgcttgttgacgatcaccgtgcgcgccttgtacgcctcgatgatcggcatccccgcgatcggcgatgccgggtcgttcttcgcggccgggttcaccacgtcgttcgcgccgagcacgagcacgacgtcgacctggccgaattcgccgttgatgtcgtccatctcgaacacgatctcgtacggcacttccgcttccgcgagcagcacgttcatgtggcccggcatccgccccgcgaccggatggatcgcgtacttcacgtcgatgcccttctcgaccagcttgtcggtcagttccttcagcgcgtgctgcgcacgggcgacggccaacccgtagcccggcacgatcacgaccgtttccgcgttgccgagcatgaacgccgcatcgtcggccgaacccgatttcaccggccgctgctccttcgcgcccgcggcaccgccggccgccgcctcgccgccgaagccgccgaggatcacgttgaagaacgagcggttcatcgcgcggcacatgatgtacgacaggatcgcgcccgacgagccgaccagcgaccccgcgatgatcagcatcgcgttgttcagcgagaagccgatgccggccgccgcccagccggagtacgagttcagcatcgacacgaccaccggcatgtccgcgccgccgatcgggatgatgatcagcacgccgagcgcgaacgcgatcgccgtcatgatgatgaacggcagccacgactgcgtgatgaagaacaggatgccgaagccgagcatcccgagcgcgagcatcaggttgagcaggtgctggcccgcatacacgaccggcgcgccctggaacagccggaacgtgtacttgcccgacaacttgccgaacgcgatcaccgacccggagaacgtgatcgcgccgacgaacgtgccgatgaacagctcgacgcgattgccgtacggaatgaagtccggcgcgacggcgtcctgcggcacgagcccgaacgcttccggctccgacaccaccgcgtacgcgatgcacacggccgcgagaccgatcagcgagtgcatcgccgcgacgagttccggcatcttcgtcatctcgacgcgcgcggcgacgaacgccccacgccgccgccgacgatcagcgcgccgagcaccagcgcgaggccgagcggcaggttcgcgccgagccaggccgcctgcctggcgatcagcgcgatcgtcgtgaggatcgcgacggccatcccggccatcccgaacaggttgccgcgccgcgcgctcgtcgggttcgacaggcctttcagcgcctggatgaaacacaccgatgcgacgaggtacagcagcgtgacgacgttcatgctcatcgcgcgccctccttgccgcgcccgggctgccggggcgccttcttgcggaacatctcgagcatgcgcctcgtcacgaggaagccgccgaacacgttgaccgccgcgagcgcgaccgcgagcgtgccgaacaccttgccggtcgcgccgacggtgagcgcggccgcgagcatcgcgccgacgatcacgatcgccgagatcgcgttggtcacggccatcagcggcgtatgcagcgccggcgtgacgttccacaccacgtggtagccgacgtacaccgccagcacgaagatgatcacgtcgatcaccgtgtgattgacgacttccatggtctcctccgttatcggcgcgtgacttcgccgtcgcggcacaggagcgtcgcggcgacgatgtcgtcggtcaggtcgatgttcagcgtgccctccttcgtgacgatcagcttcatgaagtcgagcaggttgcgcgcatacagcgccgatgcgtccgaggcgaccatcgacgcgagattcgtgtagccggcgatcgtcacgccgtggtgcgcgatcacctggtcggcgaccgtcagcgggcagttgccgctcttgcggccgtcgaattcgggccgcggccggccgcgagatcgacgagcaccgagcccggcttcatcgactgcacggtttcgaccgagatcaaggtcggcgccgggcgcccgggaatcagcgcggtggtgatcacgatgtcggcctgcttcgcgcgctcgtgcacgagcgcggcctggcggccgagccacgacggcggcatcgggcgcgcgtagccgcccacgccctgcgcagcgtcgcgctcctcgtcggtttcgaacgggacgtcgaggaatttcgcgccgagcgactcgatctgctccttcacggccggccgcacgtcggacgcctcgatcaccgcgccgaggcgcttcgcggtcgcgatcgcctgcaggcccgcgacgcccgcgccgaggatcagcacgcgcgcggccttcaccgtgcccgcggccgtcatcagcatcggaaagaagcgcggatacagcgccgcggcgaccagcacggccttgtagcccgcgatgttcgcctgcgacgacagcacgtcgagcccctgcgcgcgcgtcgtgcgcggcgcggcttcgagcgcgaagcccgtcacgccggccgcggcgagcttcgccgcctgctcgccgttgaacggatcgagcatgccgaccagcacggcgccgcgcttgagcaacggcagctcggcgtcggtcggggcctggaccttcagcacgatgtcgacgtcgaacgcggccgactggccggtcagttcggcaccggcggccgcataggctgcgtcgggataactggccgcgaggccggccctctcgcgatactgacccgatgcccggccgccgcgtatttcttcacggtttccggcgtcgcggccacccgcgcctcgttcgcccgcgtttcggcaggcacgccaatatgcatcgtcagtccctccagtcatcgccggcaggtcgtttccggcgatttccaccgcgcaacgagccgggcagccggactaccggctcgcgagcgacggcactcacgtttcactttaggcgaaagcggcggccgcacccgcctttgcgcacgatcgcgcgagatcgacgcgtcagcctggccggcgtggccgcgcaccggcgcgccggacgattacgagggtcggattcgtctgaccgaacgccgggcagcgttcgggcgcaaccggtaaaatgccgaaccatgaaacccgaaatctggaccccgcatgtgacggtcgcggcgctcgtcgagcatgccggccgctttctcgtgatcgaggaagaaacctcgtcgggcctgcgcatcaaccagccggcaggccatctcgaagccggcgaaacgctggccgacgccgtgatccgagagacgctcgaggaaaccgcgcacccgttcacgcccgacgcgctcgtcggcgtctatctggcgcactacgaccgtcccggcaccgccggcgcgacctatctgcgcttcacgttctgcggcacggccggcgagccggtcgcgggccacgcgctcgacgacggcatcgtccgcacactgtggatgaccgccgacgaactgcgcgcgtgcagcgagcgccatcgctcgcccgcggtgatgcgctgcgtcgacgattacctcgccgggcggcgcattccgctcgatttcgtgcatacgcattcggtcgcgccgcgccccgaagcattcgaacgtcaggcggtcaacaaatgagcaagcgccgtgtagtggtgggcatgtcgggcggcgtcgattcgtcggtgaccgcgtggctgctgaaggaacagggttacgacgtggtcggcctgttcatgaagaactgggaagacgacgacgacggcgaatactgctcgacgcgccaggactggatcgacgtcgtgtcggtggccgacctgatcggcatcgacgtggaagccgtcaacttcgcggcggaatacaaggatcgcgtgttcgccgagttcctgcgcgaatactcggccggccgcacgccgaaccccgacgtgctgtgcaacgccgaaatcaagttcaaggcgttcctcgatcacgcgatgtcgctcgacgcggaaatgatcgcgacgggccactatgcgcgcgtgcgcgagcgcgacgggcgtttcgagctgctgaaggccttcgaccatacgaaagaccagtcgtacttcctgcaccggctgaaccaggcgcaactgtcgaagacgatgttcccgctcggcgagatcccgaagacgaaggtgcgcgagatcgccgcgcagatcgggctgccgaacgcgaagaagaaggattcgaccggcatctgcttcatcggcgaacggccgttccgcgatttcctgaaccgctatctgccgaccaaacccggcccgatgaagacgccggacggcaaggtcgtcggcgagcatatcggcctcgcgttctacacgttcggccagcgcaagggcatcggcctgggcggcagcaagagcggcagcggcgagccgtggttcgtcgccgcgaaggacatcgcgtcgaacacgctgtacgtcgtgcagggccacgatcatccgtggctgctgtcgcgcgagctcgtcgccggcaacgtgagctgggtcgccggcgagccgccggccgagggcttcgcgtgcggcgcgaagacgcgctaccggcaggccgatgcggcatgcgccttcggcgccgccgtgcccggcccggcaggcgaagcacgcttctcgctcgcgttcgacgacgcgcagtgggccgtcacgcccggccagtcggccgtgctgtacgacggcgagatctgtctcggcggcggcatcatcgaaagcgcggcaaccagcgaccggcaggcgctcgacgcgtcggcactcgcggccgcacgctgacgcgccgcaggcgccggccgaaagcggccgcggccgcccgcctgttcaacgcatgtgctgcacggccgcgtcgtagcgctcgcgcgccgcgtcgagcaccgggaaatggcgctcggcccagcgatcgagcgccacgagcgtgtccaccagcgattctgccaccggcgtcagccggtattcgacatgcgatcgccgcgcggcgatcgcgatccgttcgatcagcccgttgcgctccagctcgcgcagcgtctgcgtgagcaccttctgcgagatgccgccgatgcgccgcagcagctcgccgttgcgcagcggccgctcggccagcgccggcaggatcagcagcgtccatttgccggcgatcagcgcgagcgcgtcgcgcgccgaacagtccgccgcatagacgtcgccgggaaaagccatggttacctccgggtgcgtgattgcgcggccccgctgccgccggccatcatcgtcgcatactcacggagcccgccatgcatgcgctgatcgtcgttgcccatcccgaaccgcagtcgttcaacgcggccctctcccatgcggcggccgatacgtggcgcgccgccggccataccgcgaccgtcgcggacctgtacgccgacgggttcgacccgagcgaggcgccgcgccattacgccgatcggctcgacacgacacgcttcgacgcgcaacgcgagcagcgccaccactgggagcgcggcacgctcgcgccggaggtcgggcatcacgtcgggctgctgcaacaggccgacgcgctgatcctgcagttcccgctgtggtggttcggcgcgccggcgatcctgaagggctggatggatcgcgtgttcgtctacggcggcctctacagcagcagccggcgccatgacagcggcgtgttgcacgggcgccgcgcgctgctgagcgtgacgaccggatcgtcggccgccgcctgcgcgcccgacggccgcgagggcgacacgcgcctgctgctgtggccgctcatgcatgcgctgcgctacgtcggcttcgacgtgctcgaaccgcacctgatccacgaggttcgcagcgatccggccggcgacgccgcgcggcaccgcgacgcgcgcctcgcgcaagcgctcgcggactaccgcgcgcgactgcgcgcctggcacacgtggccgcgggtgccgttcaaccgcgacacggacttcgaagccggcgtcaggctgaagcccgacgcgcccgcatacggcccgttcatccgtcacgcgctcacctgacgcggcgggccggctcggcaacgcgagcttcacgggacccgtagtagactctcgaccatcgtgggcgccggcggcggccaggcacggctcgggcaccctgcccgccggcccggcgcgacgccgagggcgccgacctgccggccgccgcgcgaccgctcgcgagcgatggccatccagataattacgacggagtccccatgttttcccgacgctatctcgcgatgtggtgcgcggtcctgctgttcgtggccgtcgcggcactcgccgcgcggcacacgatcgcgtggctgtggatcctgattcccgccgccctcgtcgcgctcggcctgtacgacctgaagcaggaccgccacgcgatcctgcgcaactacccgctctggggccacttccgcttcctgttcgaattcatccgacctgaaatccgccagtatttcgtcgaggacgacaccgacgagaaaccgttctcgcgtgcgcagcgcagcctcgtctaccagcgcgcgaagaacgtcgccgacaaccgcccgtacggcaccgagctgaacgtgaaggccgtcgcgcacgaatggatcagccactcgctcgcgccgacgaagctgccgaaccatgatttccgtgtccgcgtcggcgcgaatcgcgcgcaaccgtacgacatttcgatcttcaacatctcggcgatgagcttcggctcgctgtccgcgaacgcgatccgctcgctgaacctcggcgcgaagaaaggcgggttcgcgcacgacacgggcgaaggctcgctgtcgaagtaccaccgcgagaacggcggcgacatcatctgggaaatcgcgtccggctacttcggctgccgcaacgacgacggcaccttcaaccccgacaagttcgcgaagcaggccgccgatccgcaggtcaagatgatcgaggtcaagctgtcgcagggcgcgaagcccggccacggcggcgtgctgccggccgcgaagatcacgccggagatcgccgagacgcgcggcgtgccgatgggcaaggactgcatctcgcccgcgacgcactcggaattctcgaccccgcgcgggctgctcgaattcgtcgaacggctgcgcacgctgtcgggcggcaagccgaccggcttcaagctgtgcgtcggccatccgtgggaattcttcgggatcgcgaaggcgatgctcgagaccggcatcgtgccggacttcatcgtcgtcgacggcgcggaaggcggcacgggcgctgcgccgctcgaattcaccgaccacgtcggcgtgccgctgcaggaagggctgctgctcgtgcacaacacgctcgtcgggatcggcgtgcgcgaccgcgtgaagatcggcgcgagcggcaagatcatcaccgcgttcgacgtcgcccgcacgctcgcgatcggcgcggactgggtgaactcggcgcgcggcttcatgttcgcggtcggctgcatccaggcgcagacctgccacacgggccgctgcccgaccggcgtcgcgacgcaggacccggtgcgccagcgcgcgctcgtcgtgcccgacaaggccgaccgcgtgtacaacttccaccgcaacacgctgcacgcgctgcaggagctcgtgcaggcggccggcctcgcgcatccgtcggagctgcgcgcgcatcacatcgtgcagcgcatcgcgccgcacgaggtccggcttatgtcgcagctgctgaagtacctgaagcccggcgcgctgctcgacggcaacacctgcggctttacgctgtacgacaagtggtggccgatttcgcgcagcgattcgttcacgctcggcgaggccgtctacgcgtcgatcgaatgatgcaggcgagcgcccccgccgcggggcggccggcaaagaaaagcccgcggggcgcttttctttgtctgccaaatgcgtgaatgcgtgtacgcgtcgcgcgcggctcagttctgcggcagcgtgtcggcgaacgacggccgctgcagcagcttcacgaagtgcttgtcgaggttcgggtggcggtcgcgccagttgagctcgggcatccggaagtcgagatagccgagcgcgcagccgagtgcgatgtcggcgagcgtgtaatgattaccgacgcaccacgtcttgccgccgagcccttgcgacatcgcgacgagcgcgtcgtcgatcttgcgctgctgacgcgcgatccagctcgcgctgcgctgcgcttcgtcccgctgcgtgtattcgagacgaatcgccacggccgcgtcgagcacgccgtcgcccagcgcttcccagcagcgcacttcgacgcgctcgcgccccgacggcggaatcagcttgccgaccggcgacagcgtgtcgacgtattcgcagatcacgcgggaatcgaacaccgcggcaccatcctccatcacgaggcacgggaccttgccgagcggattcgaagcatgaatatccgtctccggcgcccacacgttctcgagctccagcttgtagtcgatcttcttttcagccagcacgatccgcgccttgcggacgtacgggctgctgagcgaaccgattaatttcatcatctgccttttaagggaaccgccgagagacgttgtcgccgatcataaccggccggcgtcgcgcgacagaaaatcgcccgaccggcctgtggatggtttgcaacaaccgtcacgcgggccgcccggcgcggcttcccgccctctctcacgcgcggcgtcacgcggcgctacaatcgcacgaatgaacgcgccctcgataccgccatcgccgtcgacgtctaccgccagcgccgtgaacgcgtgcttgccgcactgcgtgccgccggcggcggcgtcgccatcgtccccaccgcgccggaactgctgcgcaaccgcgatacggcctacccgtaccggtacgacagctacttccattacctgacgggcttcaccgagccggatgccgtgctcgtgctgaacgcggccgcgccgcacggcgcgccggagtcgatcctgttctgccgcggcaagaatgccgaccgcgagatctgggaaggcttccattacgggcccgaagccgcgcgcgatgcgttcggcttcgacgcggcgttcgcggtcgacgtgatcgatacggagatgccgcgcctgctcgccgactccggcaccgtgcactaccggttcggcgcatcggccgacttcgaccgccggctcgcgggctggatcgacgcggtgcgcgcgctggcgcgcacgggcgtcgccgcaccggacgcgatgctcgacctcacgccgctcctcgacgacatgcggctcgtgaaggacgagcacgagctcgcgatcatgatgcgcgccgcgcacatctccgcgctcgcgcaccgccgcgcgatgcaggcgtgccgccccggcatccgcgaatacgaactcgaagccgagctgctgtatgtgttccgcaagcacggcgcgcagtcgcccgcgtacggctcgatcgtcgcggccggcgcgaacgcgtgcgtgctgcactacccggccggcaacgcaaccgcgaaggacggcgacctgatcctgatcgacgccgcgtgcgaactcgacggctacgcgtcggacatcacgcgcacgttcccggccaacgggcgcttctcgaccgcgcaacgcacgctgtacgacatcgtgcttgccgcccagcaggccgcgatcgacgcgacgcgcgccggcgtgctgttcgaagcaccgcacgacgccgccgtgcgcgtgctcgcgcaggggctgctcgacaccggcatcatcccgaaaacgcgcttctcgaacgtcgacgacgtgatcgccgagcgtgcgtacacgcgcttctacatgcaccgcaccggccactggatcggcatggacgtgcacgattgcggcgactaccgcgagcggctcgccgagcgcgacggcaacggcgcgctgccatggcgcacgctgaaggccggcatgacgctgacggtcgaacccggcctctatgtgcgcgccgccgacgacgtgccgcccgagtactggaacatcggcatccgcatcgaggacgacgcgatcgtgcgcgagcagggctgcgagctgatcacgcgcggcgtgcccgtcgcggcggacgagatcgaagcgctgatgcgcgcactcgcatgaccggctgccgccgaccgttacctccgtttcacgaatcaagatgacgaccgcctcctccccggccacgccggactacgacctcgccatcgtcggcgcgggccccgtcgggctcgcgctcgccggctggctcgcgcgccgcagcgccacgcagcacgcatcgatcgcgctgatcgatgcgcgtgaaccggccgcgagcgcaaacgatccgcgcgcgatcgccgtgtcgcacggcagccgcgtgctgctcgacacgctcgcgtggcccgccgacgcgacgccgatcgaacacatccacgtatcgcagcgcggccatttcggccgcacgctgatcgaccgcgacgaacacgacctcgccgcgctcggttatgtcgtgcgcttcggctcgctcgtgcaggcgctcgccggcgccgtgcgcggcacccgcgtcgactggctcacgtcgaccaccgcgcgcgagccgcagcaggatgccgacggcgtcacgctgacgctcgatggcccgcaaggcgagcgcacgctgcgcgcacgcatcgtcatcaatgccgaaggcgggctgttccacgaacagcgggccgataccggcaagcatcgccgcgactacggccagaccgcgatcgtcggcacggtcacggtatcggcgccgcgcccgaacgtcgcgtgggaacgcttcacgcacgaaggcccgctcgcactgctgccgcttggcggcccgcgccaggccgagtattcgctcgtgtggtgctgcacgcccgacgaagcggcacgccgcgccgcgctgcccgacgacgcattcctgcgcgagctcggcagcgcgttcggcgagcgcatgggcgacttcgtcgcgatcgcgggccgcgcgtctttcccgctcggcctgaacgccgcgcagacgctcgtcaacggccgcgtcgcgatcgtcggcaatgccgcgcaaaccctgcaccccgtcgcgggccagggctcaacctcgggctgcgcgatgcgcatacgctcgtcgacacgctgtccacgcaaggcttcgaagcgaccgcgctcgccaccttcaacgcgcgccgcgcactcgaccggcgcttcacgatcggcgcgaccgacacgctggcacgcctgttcacgatcgactcgggcccgctcccgctgctgcgcggtgccgcgctgaccgcactcgagttcgtgccgccgctcaagaaggtgatcgcgcgccagatgatgttcggccagcgcaactgacgcgcggtgcgcacagtcgcgccactcaaaccgggtcaaatcggcggggcatgggaatacggtaaaatgcgcgtttccgtctgcccttttcatgcccgcgcccgccgcgggcggtgccattgcgatgcccgttatcggctctcacgtattgcgtaacaacctgttcgtcgccccgatggccggcgtgacggatcgtccgttccgccagctctgcaagcggatgggggccggttacgccgtgtccgagatggtcgcgtccaacgcgcagctgtggaaaagcgcgaagacgatgcggcgcgcgaaccacgaaggcgaagtggagccgatcgcggtccagatcgcgggcgccgatccggcgatgatggccgaagcggcccgctacaacgtcgacaacggcgcgcagatcatcgacatcaacatgggctgcccggcgaaaaaggtctgcaacgtcgcggccggctccgcgctgctgcagaacgagccgctcgtgcagcgcatcgtcgaggcggtcgtcgcggcggtcggcacggggcccgacgcggtgcccgtcacgctgaagatccgcacgggctgggatcgcgagcacaagaacgcgatcacggtcgcgcgcctggccgaagccgccggcatttcgatgctcaccgtgcacggccgcacgcgcgccgacctgtaccgcggcgacgccgaatacgacaccatcgcggccgtgaaggcggcggtgcggattccggtggtcgcgaacggcgacatcacgtcgcccgcgaaggcgaaggccgtgctcgacgcgaccggcgccgatgccctgatgatcggtcgcgccgcgcaaggtcggccatggttgttccgcgaaatcgatcatttcctgcaaaccggcgaactgctgcccccgccgcggatcgacgagatccagcacgtgatgaacgaacacctggaagaccactacgccttctatggtgaattcacgggagtccgtactgcgcgcaagcacatcggctggtacactcgcggcctttccggtgccaacgggttccggcacaggatgaacacgctcgattccacccgcgagcagctcgccgccgtcaatgcattcttcgaggcgcaaaggcgctgtcggaccacctcgtctacgtcgacgacgaagaggaaaacggccagggcgagtcggacgaccataaccagttagcagcatgagcaagcacaacatcgaacaatgtgtccgcgagagcctggacgtgtatttccgggatctagacggctccaatccgcacgacgtctatgaaatggtgatgtcctgcgtcgaaaagccgatgctcgaggtcgtgctcgtacaggcaggcggcaaccagtcgctcgccgcggagtacctcggcatcaatcgcaatacgctgcgcaagaagctgcagcagcacggcctgctgtaggcagccgtcccgtccccgtttccctggctattggtggttccatcatgatcaagcaagcgctcatttccgtttccgacaagaccggcattgtcgacttcgcgaagtcgctgtccgacctcggcgtcaagctgctgtcgacgggcggcaccgcgaaactcctcgccgacgccggcctgcccgtgaccgaagtggccgattacacgggcttcccggagatgctcgatgggcgcgtgaagacgctccacccgaaggtgcacggcggcatcctcgcccgccgcgacctgcccgagcacatgcaggcgctggaacagcacggcatcccgacgatcgacctgctcgtcgtgaacctgtatccgttcgtcgcgacgatcgcgaaggacgactgcacgctcgccgacgcgatcgagaacatcgacatcggcggcccgacgatgctgcgctcggccgcgaagaaccaccgcgacgtgacggtcgtcgtcgatccggccgactacgcggtcgtgctcgatgaaatgaaggcgaacggcaatgcggtgggctacgcgaccaacttccgcctcgcgacgaaggtgttcgcgcacaccgcgcaatatgacggcgcgatcacgaactacctgacgagcctgaccgacgagctgaagcacgcctcgcgcagcacgtacccggccacgctgaacctggcgttcgacaaggtgcaggacctgcgctacggcgagaacccgcaccagagcgcggcgttctaccgcgacctcgcgacgccggccggcgcgctggcgaactaccgccagctgcaaggcaaggaactgtcgtacaacaacatcgcggattccgacgcggcgtgggaatgcgtgaagacgttcgacgcaccggcctgcgtgatcatcaagcatgcgaacccgtgcggcgttgcagttggcaacgattcggccgacgcgtacgcgaaggcgttccagacggatccgacgtcggccttcggcggcatcatcgcgttcaaccgcgaagtcgacgaagcggctgcccaggccgtcgcgaagcagttcgtcgaagtgctgatcgccccgtcgttctccgacgccgcgaagcaggtgttcgccgcgaagcagaacgtgcgcctgctcgagatcgcgctgggcgacggccataacgcattcgacctgaagcgcgtgggcggcggcctgctcgtgcaatcgctcgattcgaagaacgtgcagccgagcgagctgcgcgtcgtcacgaagcgccagccgaccgcgaaggaaatggacgacctgctgttcgcatggcgcgtcgcgaagtacgtgaagtcgaacgcgatcgtgttctgcggcaacggcatgacgctcggcgtcggcgccggccagatgagccgcgtcgattccgcgcgcatcgcaagcatcaaggcgcagaacgcgggcctgacgctggccggttcggccgtcgcgtcggatgcgttcttcccgttccgcgacggcctcgacgtcgtcgtggcggccggcgcgacctgcgtgatccagccgggcggctcgatgcgcgacgacgaagtgatcgccgcagccgacgagcacggcatcgcgatgatcctgacgggcgtgcgtcacttccgtcactgatcgcggcatgcggcccgcgcggccgctgcacgacaacccggcggcattgcacccgccgggtttttattgcgttgcgccggcgcacgcaaccgtgcggccggcgccgcacaccattcgttgtagtatcgctgcatcacgccattctcctcactcatgcgaattctcggcatcgaccccggcctgcgcgtcaccggtttcggcatcatcgacgtcagcggccaccggctcgcctatgtcgcgagcggcgtgatccgcacgccgaccgccgacctggccacccggctcggcacgatcttccagggcgtctcgaccatcgtgcgcgagcacgcacccgatcaggccgcgatcgaaaaggtgttcgtcaacgtgaacccgcagtcgacgctgctgctcggccaggcgcgcggcgccgcgatctgcggcctcgtcgcgggcggcctgcccgtcgccgaatacacggcgctgcagctcaagcaggccgtggtcggctacggccgcgcgaccaagacgcagatgcaggagatggtcacgcggctgctcaatctctccggacagccgggctccgacgcggccgacgcgctcggcatggcgatctgccacgcgcacggcggcgacacgctcaacacgctcggcggcctcgcgccggcgctcgcgaagaaagggctgcgcgtacggcgcgggcggctggtcggctgacatcgcgcgtgccggcgtgcggttcgccggatcgaccgtgtcgaccgtttcgaccgtttcgaccgtttcgaccggacgcggcacacccacgacacccgttgccccggcctgacggccgatcccgtcggcattgcgccgcacgtgcgctacactcgcgctttattcctcgcatcccgccctccatgatcggtcgcatcgccggcatcctgctcgaaaagaacccgcctcacctgctcgtcgactgcaacggcgtcggctacgaaatcgacgtgccgatgagcaccttctacaacctgccgcaaacgggcgagcgcgtcgtgctgctcacgcagcagatcgtccgcgaggacgcgcacctgctgtacggcttcctgacgcctcaagagcgcacgaccttccgcgaactgctgaagatcaccggcatcggcgcgcgcatggcgctcgccgtgctgtccggcatgagcgtgcaggaactcgcgcaggccgtgacgatgcaggacgccgcacgcctcacgcgcctgcccggcatcggcaagaagacggccgaacgcctgctgctcgaactgaagggcaagctcggcgccgatctcggcgcgctcgccggcgccgcgtcgccgtccgaccacgcaaccgacatcctcaacgcgctgcttgcgctcggctattccgaaaaggaaggcctggccgcgatcaagaacgtgccggccggcaccggtgtatccgaaggcatcaagctcgcactgaaggcgttgtcgaaggcgtaacgcgcgttcaatccggccgtcgaaaccagtgtcgcgcggcgcggcatcgcgcgccagtcggccgttcggccaggtgggcgggcgggcggcgcgcggtacaatggccgcatgattgaaaccgacaaactcgccaccgagcagcggatcatcgccgccacgcccgcctcgtcgcacgaggaggtgttcgaacgtgcgctgcggccgcgccagctcgacgactacgtcggccaggaaaaggtgcgcggccagctcgagatcttcatcgaagccgccaagcgccgctccgagccgctcgaccacgtgctgctgttcgggccgccgggcctcggcaagacgacgctcgcgcacatcatcgcgcgggaaatgggcgtgaacctgcgccagacgtccggccccgtgctcgagcgcgcgggcgatctcgccgcgctgctgacgaacctcgaggcgaacgacgtgctgttcatcgacgaaatccaccggctgtcgccggtcgtcgaggaaatcctgtatccggcactcgaggattaccagatcgacatcatgatcggcgaaggcccggccgcgcgcagcgtgaagctcgacctgcagccgttcacgctggtcggcgccaccacccgcgccgggatgctgaccaacccgctgcgcgaccgtttcgggatcgtcgcgcgcctcgagttctacgacgccgatcaactgtcgcgcatcgtgcggcgctcggcatcgctgctgaacgcgcagatcgatccgaacggtgcgctggaaatcgcgaagcgctcgcgcggcacgccgcggattgcgaaccggctgctgcgccgcgtgcgcgacttcgcggaagtgaaggccgacggccagatcaccgcggccgtcgccgatgccgcgctcgcgatgctcgacgtcgatccggtcggcttcgacctgatggaccgcaagctgctcgaggcgatcctgtacaagttcgacggcggcccggtcggtatcgacaacctcgcggcggcgatcggcgaagagcgcgacacgatcgaggacgtactcgagccctacctgatccagcagggcttcctgcagcgcacgccgcgcgggcgcgtcgcgacgctgctcacgtatcgccacttcgggctttccgtgcccgacgccggccgcaccgaacgcggcgagtgggataccccgacgggaagtaacccgtcgcccgagccgcacccgccatgacgacgccgcccagccgccaccccgccgcacctgcaccgggcccgcgctgggccgagccgatccgcaagcggctcgtggccggcgtcacgcacctgacggcgggcggcggcggcccgtcgctcgacctctcctctccgcccggagacccggggctgttcggccccgacgccgtctgctggcgcgtacatgccgacttcacgtcgatgatgacgggcggcatcgccgcactgctgctgcaggcgctccatccgctcgccctcgcgggcgtctgggatcactcgtcgtttcgcaccgacatcctgggtcgcttgcggcgcaccgccacgttcatcaccggtacgaccttcggcagtcgcgcggacgccctcgcactgatcgagcgcgtgaaatcgatccacgcgcacatatcgggcaccgcaccggacggccggccgtatcgcgccgacgatccggcgttgctgacctgggtgcacgtcgcggaagtatcgagtttcctcgccgcgcatctgcgctacgtgaatccggccctgccgggtgaattgcaggatcgctactacgccgagacggcactggtcgccgaactgctcggcgcacacgaggttccccgttcgcgtgccgaggtggccgcgtatctcgcacgcatgcagcccgaactcgaggccgggccgcgtacgttcgacgtgatgtccatcctgctgaacgtgccggtcgcgaagccggtgctgcggccggccgcgtcactggtgatgcatgccggaatcgacctgctgccgccgtgggcgcagcgcatgctcggcgtgtcgacgttcgcgccgctgcggcgcgcggtggtccggcccggcatacgggtcgtcgcgcccgtgctgcgctgggcgctcgtgaacggcgcgtcaaagcgtgcgcgccgccgcgcgacggcagcaccgcccgacggcgcctcgtccacctgacgatccgcctcttcccgtcatttcaatttgctgtcaaatacatgtgacaagctgacgggcttgcacccgcgcacggtcgcacgcgccgtccgtcccgcctgtccgtgacccgcgcggtgttccgccaatccgaccgacacccgatacccgcgatgccacgcctgccgatccgtttcgccctcgccgccagcctgtccgccgtcctcgccctcggcgcctgtggaggcgacgatgtcgccgccgtcgcgcgttcggacgcgcaaacgccgtccggcggcaccccgaccgcgcctgccccggcgccgcccgccaccgtcacgccgcaaccgggcaagtggaaggctgcccgtgcgggcgacctgatcgacgtgacgctcggcgacctccatccgacgcagggtgcaatcggttacgaccagatctactacaagctcggccgctacgaactgcagcccgacaagaaattcgacgacttctgtgcggacgaaggcctcggcggtgtcgctgcggcgggctacacggccaagtcggtactgcgcgatcccgccagttacgcgtgcaagacgaccgacgcgaacgcccgcgaccggtcggtgctgaacccggtcgtgatcggcccgaacggcgatgcgctgtacctgaccgacggccaccacggcctgtcgacctactacgagacgcccgacggcggcccggcgctgcacgtgcacgtcgtcgtcaaggacaacctcagcgactactcgggcgacgcgttctggcagcagatgcagagccgcggttatctgcgcctcaagaacggtgacggcaagccgatcacggccgcccaactgccggccgggctcggcctgaaactcgggatgacgaacgaccgctaccgctcgctcgtctatttcacgcgcgacatcgcctacagcaagcccgcacaagccaccgactacctcgagttctactgggccgactggctgcgcgcgcaaccgggcacgttctcgctcgacggctacgacctgacgcgcggcggcgcaaccgatcccgatccggcaaaggccgacacgggctacctgaacgcggtctggaatgcgtcggcgcgcatggtcgcggccacggaccccgtgatcgacggcaagacgggcgccgacctcgggcgcgcggacgcgatcaacggcgggaagaaatacaacaagggagaattcgacaagctgcgccagccgatcgcggcggacaagcccggcaagatcgcgtacgcgctcgactacaagacccgccacgcgctgccgcagtaagcggcgagcgccacgcaggaaggaagccccggccggccatgccggacggagcctgccggttcagagcaccttgcggtacccgtcgtcgtcgctcgcggcgtccaggtgcgagacgtcggcccactgcacgacctgcgcgcggccatccacgtaatcgacgacgttgatgctcgtgttgagcagctgataattgcggggcgccgacagttcgatgccgtttgcaaaccggtacacgctgtcgagcacgccgccgtgcgcgacacacgcgatccggccgcccgggtgcgcggccacgatcggctcgagcgcgtgcagcacgcggtgatagaactcacgctgcgactcgccgccttccggcgcgaaacccggatcgcgcgtctgccacgccgcgtatgcgtccggaaacaacgcctcgatctcggtactgtcgtgcccctggaatgcgccgtacgagcgttcccgcagcccttcccgcagcagcagcggcaacccgagcgcatcggcgaagggctgcgcggtctgttgcgcgcgcatcaggtcgctcgaatagaccgcgtcgatccgtgcaccgtcacgcgcgtcgcgtgcgagccgcgcggccagctttgcgcctgcgcgagcccggtgtcggccagcgggatgtcgatatggccctggatgcgcttgatacgattccaggccgtctcgccatggcggatgaaaagaatctgcgtggtggccatcgcggggcgtctccggggaagaatcagggccgaacttgcagccagaatgtcacggggccgtcgttgacgagcgacacctgcatgtcggcgccgaactcgcccgtctcgacgaccggatggcgcgcacgcgcggccgcgacgaaatagtcgaaaagccgcgcgccttcgtcgggcggcgcggccggcgtgaagctcggacgcagcccgctgttggtatcggccgccagcgtgaactgcgacacgagcagcaggccgcctgcgcggccctcgccgtcgatattcgacaccggcaggttcatcttgccggcggcatcgctgaacacgcggtagccgagcattttcgcgagcagcttgtcggccgctgcgtcggtgtcgccgcgctccgcgcagacgagcgcgagcaggcccgcgccgatctcgcccgtcgtgcggtcgccgacgcgcacgtcggcgcgcttcacgcgctggatcagcgcgatcatgcggtcagcgtgacgcgcgcgaagcggcgcttgccgacctggacgacgaactcgccggcttcgactttcaggcccttgtccgacacggtcgcgccatcgatcttcacgccgccctgctcgatattgcgcagcgcttcgctcgtcgacggcacgaggcccgcctgcttcagcagctggccgatcgcgagcggtgcgcccgcgagcgtgaccgacgggatgtcgtccggcacgccgcccttcgcgcggtggttgaagtcctcgagcgcacgttcggcgtcggcctgcgagtggaaccgcgcgacgatttcctgcgcgagcagcaccttgaagtcgcgcgggttgcggccgccttcggcctcgcgcttgaagccggcgatctcgtcgaggccgcggaacgacagcagttcgaagtaacgccacatcagcgtgtccgagatgctcatcagcttgccgaacatgtcggtcggcttctcgctgatgccgacgtagttgcccttcgacttcgacatcttctcgacgccgtcgaggccttcgagcagcggcatcgtgagaatgcactgctgttcctggccgtactgcttctgcagctcgcggccgaccagcaggttgaacttctggtcggtgccgcccagctcgagatcggcgttcagcgcgaccgaatcgtagccctgcatcagcgggtacaggaattcgtggatcgagatcggcacgccgccctggaagcgcttcgtgaaatcctcgcgttcgagaatccgcgcaaccgtgtagcgcgacgcgagcttgatcatcccgtccgcgccgagcggcatcgaccattcgctgttgtagcggatctcggtcttctcgcgatcgagcacgagcgcggcctgctcgaaataggtcttcgcgttcgactcgatctgctcgcgcgtgagcggcgggcgcgtcgcgttgcggcccgacggatcgccgatcagcgacgtgaaatcgccgatcaggaaaatcaccgtgtggccgaggtcctgcagctgacgcatcttgttcagcacgacggtgtggccgatgtggatgtcgggcgcggtcgggtcgaggccgagcttgatgcgaagcggcgtgcccgtggccgcgctgcgcgcgagcttctgcgcgaactcttcctcgatcagcagttcgtcgacgccgcgcttcgtgacggcgagcgcatgccggacttcgtcggtgatcgggaaaacaggcttggaactgggttcggtgctcatcggtgccaggaagaatgtcgcaaaaacagggattttcccataacttgcgcgcccatcgcttaacggcgcgccgcgttgcgcggataatcgggcgcaaggcgcgcggcaccggcccgcgccgcacgatccaggagaacccaacgtgccgcaacgacagccgcaaaacgcccatccggccgacggcatctacttcgggctgatgtcgggaaccagcatggacggcgtcgatggcgtcgccgtgcgtttcgaggccggcaaggcgccggtcgtgctcgcggaagcgttcgtcggcttcgcgcaatcgctgcgcgacgtgctgttcgcgctgcagcagcccggcgacgaagagatcgaccgcgaatcgctcgccgcgaacgcgctggtcgcgcgctatgcggtgtgctgccacgaattgcagcgcacggccgggctgtcgcgcgacgagatccgcgcgatcggcgtgcacggccagaccgtgcgccatcgccccgagcgcggttatacgcggcagatcaacaacccggcactgctcgccgagctggcccaggtcgacgtgatcgccgatttccgcagccgcgacgtcgcggcaggcggccacgggcgccgctcgcgccggccttccatgcaacggtgttcggcgcagcgggcgagacgcgcgtcgtctgcaatctcggcgggatcagcaacatcacgatcctgcccggcgaaggcggcgacgtgcgcggtttcgactgcggccccgcgaatgcgctgctcgacgaatgggcgacccgccatctcggcaagccgtacgacgacggcggcaagttcgcggcgcgcggcaccgtccatgcagcgctgctcgacgcgctgctcgacgagccctatttcgccgcaccgccgccgaaaagcaccgggcgcgacctgttcaatcccgcctggctcgacgcgaagctcgccgcgttctcacacgtcgcgccgcaggacgtgcaggccaccctcaccgcgctcactgccgtttcggtcgcgcacgagatcgcacagcacgcagcgggctgcaaggccgtgttcgtatgcggcggcggcgcacgcaatccggtgctgctcgatgcgctccggcacgcgctgcgcgaggccggcgtgccggccacggtcgatacgacagcggcactcggcgtgccgcctcagcaggtcgaggcactcgcgttcgcgtggctcgcgtaccgtttcaccgcgcgccagcccggcaatctcgcgacggtcaccggtgcggccggcaaccgcgtgctcggcgcactctatccgcgctgatgcgatgccggccgcgcggcgagcgccgcatggaaaacgggcacaaaaacggggcatgatgccccgtttttcattccggcgaaccggcgtggatctgtcgtgcgctcagaccgagaacgacgagccgcacccgcaggtggtggtcgcgttcgggttcttgatcacgaactgggcgccgttgaggtcgtccttgtagtcgatctcggcgccgaccaggtactggtagctcatcgagtcgatcaggagctggacgccgttcttgttcatcacggtgtcgtcctcgttgacttcctcgtcgaacgtgaagccatactggaagccggagcagccaccgccctgcacgaacacgcgcagcttcaggtcgggattgccctcttcgtcgatcagttgcttgaccttgtcggctgcggcgtcggtgaagacgaacggaaccggcatttcggccgtcgttgctgcggattcggtaacagcgttcattgcgaactctccaaaaagctttagccgctattgtagggccgatcagaagatcgtgctgaagtccatgaaatcaataggttcttgtcgatttcatcaaacacgcatgcgcaggccgcggcagcacgcgcctggaaacgggcataaaaaccgccagcgcaaaagctggcggtttttccggcggacgccgcccggaagcggcgcggccatgaagcggaattaacgcttcgagaactgcttggcgcggcgtgccttgcgcagaccgaccttcttacgctcgacttcacgtgcatcgcgcgtgacgaagcctgcgttcgacagcgacggcttcagcgtcgcatcgtagtcgatcagtgcacgggtgatgccgtggcgcactgcacctgcctgacccgtttcgccgccgccgttcacgttcaccttgatgtcgaacgtctggccgtggttcgtgagttccagcggttgacgcacgatcatcagcgacgtttcgcgcgagaagtaatcagcgatgggcttgccgttgacgatgatgtcgcccttgccagccttgatgaagacacgtgcgactgcgctcttgcggcggcccgtaccgtagttccagttaccgatcatgtgggtccccttagatctcgagcgccttcggctgttgagccgagtgcggatgcgtcgcttctgcgtagaccttcagcttcttgatcatcgcgtaaccgagcgggcccttcggcagcatgcccttgaccgccttctcgagcgcgcggcccgggaagcgttcctgcatcttgccgaacgtcgtttcatagataccgcccgggtagcccgagtgacggtagtacttcttgtccagagtcttgttgcccgtgaccttcaacttgctcgcgttgatgatgatgatgaaatcaccagtgtcgacgtgcggggtgaactcaggcttgtgcttgccgcgcagacggcgtgccacttcgctggcaacacggccgagaaccttatccgtcgcgtcaatcacgtaccattcgcgcgtcacctcatgggcttttgcggaaaacgtcttcatgatcgatccaaaaattgctttgcccgatgtgttcttcctgcttgtctgtgtgcgcttcgaggcgcggtgcaggctctcctgttctttttccgtgggcatgaatgcggaaaagccctgaattataaaggaaataccgcaacgcggtcaaagggaatccgctccccgtgtccacggcggccgaaatgggccaaaatccggtcgtgccccgacaagccaggcgaaccgagcgcccgggaggcacccatcgacacgcggcacatgaccttgccgcgccagaccggccgaacacggaaaacaacaaacaagcatgatgaatcaacgacttacacccttcttcgcggccgtgatgctggccgccgcggcacctgccgtcgccgcccgcgccgactgcgaagccaagctcgaagccctcgatacacgccttgccgaagcccgtgccgcgcatgccgaggatcgcgtcgcccgcctgcgcgcggtgcgcgaacgcgtccgccacttctgcgcacgcgggcacggccatgcgtcggccgtccacgcgccggcgcccgatgcgcgcccgcgcggcacgccgcccgacgcgacctcgcagcctgccgcaaggcagcccgcgtgaccctgtcggcgcgcgcaaaccgcgcgccgatgtttgcatgggacgaaaaagcccgaacggctggttcgggcttaatccaccataggaggagggtggaggagacattcggaggttgccgcagcgcgacaaccaatgaggctcattatacgaacgcgtcgtcgactccacaagaaaatttgcattgcgaaatcaaacgccacaatatgaaatttaatgcggcgcgtttgaatcacgacttttctctttgaaatcaatgacctgattccggaaagcacgatcaggagccgccctcgtctagagcaaaacccctaagcccggaggggaattggctgtccggggcgccgctcgcgcggtacccgtgttgcgcgtcgtgcaccgcatcagccggtcgttgcgccgcgggctacaatgccggatcgaatccgaatcaggcaacgctggagtgcaagcatggaatgcaaagtaagctggatgggtcaggacggcatggcgttttccgccgagaccggcagcggccacctcgtcgcgatggacggcgcgcccgaaggcggcggtcacaacctcgcgccgcgcccgatggagatggtgctgctcggcaccggcggctgcacggcctatgacgtcgtgctgattctgaagaagagccgccaggaagtcagcggctgctcggtcacactgaaggccgaacgcgcgagcgaagacccgaaggtgttcacgaaagtgcacttccacttcaccgtcaccggccgcaacctgaacccggccacggtcgaacgcgcgatcaacctgtcgcacgacaagtattgctccgcgtcgatcatgatcgcgaagacggccgaactcacgcattcgttcgacatcgtcgccggctgaccgcacggcgagcacacatgaaaaagggccggcgctccgttgggagacgccggccctttcgcattcgaacggcaaagcaggccgataagccggattctgtgcacgctgcgcgccgaagcacgcaacgcgtggcagccattcctctaggcgcgccattgctgacgcgctcaagcttcctacccgcagacgagacggggccccatcctgcatccgaagatgcgcgcctgcctacttggaattgctccgggtggaggttaccgtgccggcgaacgtcgccgtcgccgcggtgcgctcttaccgcaccgtttcacccttacctgatcccggcttgcgccgggccatcggcggtttgctttctgttgccctgttccgcgtgtcgccacggatggccgttagccatcaccctgccctgtggagtccggactttcctcgccccgcgcgcccgaaggcggcgaggccgcgactgcctggcctgctttgcgacgcgcattctagcactgcgcgccgccgccggcagcgcgagcggcggccgctgcgaaatacggccggatcgtcgtagaacgcgggctcgacattcgcatcgcaccagcccggcacgccgagcactggaagcggcgcgaaatcgcggctcgtcagcgcgcgcgtcgcgagttccgcggcgacacgggcgtcgacatgcgcgatgcgttgcgtgtcgggccacgaaaatagtcggcgcccacttcgacgatccacgtgtgcgcggtgcaggatttgtaaggcgcgacgagtttctcgagcagcgcatggccgaccagccgcgcctcgcagcgcgtgccccacgcatcgcgcgcggcgaccagcagccgcggccagtcgaacccgcgcagcgcgtcggcgagcgcacggtcggccgtcacgaacaacgcggcgttctcgtcgaacagcgtgagcgcgtcgcgcaacgtgccgcgcacggggccgaccccgcccgccgcgtcgatcgccgcggcctggcgcgcgttcagtgcggccttgacgcgcggatacgcgaaccagacgagcgcgttgaagaagtcgtgcagattgtggcgggtcgggacaccgcccgtctccgcgatatgggtctcgtacgcgacgccgggcggcaatgctgcctgcggcacgaaccgcagcggccggccacggccgctggtgcgcggggcgtcgggcccggtatcgcccagggcgccgttcagcgcgtcgagcagcgcggcctcgcccgcccttgcggccgcctgtacaacgcggccgggatccgcgtacggcgcgagccacggcacggaccagtcgatccgcgcaaaatccgccgccccgctaccggccgcctggccaggttcgcgcggcggcgcgaaggtcacgccagtttccagccgatcgtctcgccgccgcgcagcggcacgacgggcgtatcgcccgcgaagatctcgcgcggcaactcccatgcctcgcgacgcagcgtgaccgtctcggcgctgcgcggcagcccgtagaaatcggcgccgaagaagctcgcgaaaccttccagcttgtcgagcgcaccggcgtggtcgaacgcttccgcgtacagttcgagcgcatgcagcgccgtatagcagcccgcgcagccgcacgcggtttccttcgcgtcgcgcgcatgcggcgcgctgtcggtaccgaggaagaagcgcgggttgcccgacgtcgcagcctcgaccagcgcgacacgatgcgtctcgcgcttcagcaccggcaggcagtagtaatgcgggcgaatcccgccgacgaacagcgcattgcggttgtacagcaggtgatgcgcggtgatcgtcgcgccgagcaggccgggcgccgcatcggcgtcgcgcacgtagtcggccgcgtccttcgtcgtgatgtgctcgaacacgaccttcaggcccggaaaatcgcggcgcagcggcgtcatcacgcggtcgatgaagaccttctcgcggtcgaacaggtcgatcgatgcatcggtcacctcgccgtgcacgagcagcggcatgccggtttcctgcatcgcctcgagcgtcttcgcgcatttcgcgagatcggtgacaccgtggtcggaattcgtcgtcgcaccggccggatacagcttcacgccgtgcacgaagccgctttcgcgcgcggcggatctcgtcgggcggcgtgttgtcggtcaggtacagcgtcatcagcggttcgaacgtcatcccggccggcagcgcggcgaggatgcgctcgcgataggcctgcgcctgcgcggtggtcgtcaccggcggcttcaggttcggcatgacgatcgcgcggccgaactggcgcgcggtgtgcggcagcacggcggccagcatgtcgccgtctcgcaggtgcaggtgccagtcgtcgggacgggcgagcgagagcgtcgccggggaggaagcgttcgaggcagtcataggaggcgtcgtgaggaacgtgcttgccgttggcggggccggaacacgcgtgcgcgggccgactgacggcaaaccgcaacacggggcctttggccagcggaatccgcttttaccgctcagggctcggtgatatgctagaagccgcattgtaccggggttcgcccggttcgttacccccgcctgagcctgctgccccaagtaaaatgtgccaactcttaggaatgaactgcgccgcgccgacggacgtcacattctccttcacaggtttcgcggcccggggcgggctcaccgatcaccatgccgacggctggggcatcgcgttcttcgaggacaaggcctgccgcctgttcatcgatcaccaggcatcggccacgtcgccgatcgccgaaatggtgaagcgctacccgatcaagtccaagaacaccatcgcgcacatccgcaaggcgacgcaaggccacatcctgctcgagaacagccatccgttcatgcgcgagctgtggggccggcactggatcttcgcgcataacggcgacctccaggactacgcaccggacatggacggcagcgtctatcatccggtcggcacgaccgacagcgaacaggcgttctgcgtgctgatgcaggggctgcgcgaaacgtttcccggcgcgcagccgccgttgcccgaactgttcgagcgcgtcggcgagctgacacgcggcatcaccgatcacggcgtgttcaatttcctgatgtcgaacggccaggcgctgttcgcgcactgctcgacgcggctgcactacctcgtgcggcgctggccgttctcgaccgcgcatctcgtcgacgaagacctgtcgatcgacttcgcgaaatacacgacgcccgaggatcgcgtcgcggtgatcgcgacgcaaccgctcaccgacaacgaagtctggaccgcgttcgagccgggcgaactgatcatgttccagtgcggcgacgtcgccgcgcggatgcggatcccggtgcccgaacgcgtgctcgagaagctgcgcaatccggcgctcgacgcatcggcgtcggcgccgcgtgacacgcgcgaggcgctcgccaccgccgccgacgtcgattccgacgacgcgatcgacttctgagccccgcgcgccagcgcccttcccgtgtcagccgctgtcctgcaaatcgacggctcgccgccgggtcatatcgctcgccccgcgccgattccggttcatccgggccagattcccgtatatcgaagcgaagcagcacaacattcgcccgattcgattcgtttcaatataaaacgatccaggcgagaaaataataaatcactcaatcggaatgcagataatccggaaaccgcattttaacgtatcgacctgacgcaaaccgtgcgccaccccactgatcccgcgatcgcaaattcgcacgcaaataatcggccaaatccttaccctacaaggccttcagttcgattcgtcacacaatcaaaaataccgaataaaaacggcacgattgccgcatttgttagcttcccgacaattcacctccttcccgatcagtagagtccgctcatcctcggtgtaacgaatcgcgaatgacggagatacggccacggacgccacacatccattcacgccattccccaccgcggattgcgatttcaccgcaccgcggtgaaaaccacatcaaaacaagagagaggggcttgtcgtgaatcactcatttcgatcgatatggagcgagaccaccggctgctgggtcgcggttgcggaaaccgcgcgggcgcgcggcaagcggtcgggcagcccatccggtgcaggccttcgcgccgcccacgcggcagcgcgccggacgccgcttcgcgccgcggcactcggtgccgtgctggccatgctgtcggcaagctccgcgtacgcatcgacgtgcggcagcggcgcggccgtcgcgagcggcggtacctgcgcgctcggcagcttcagcccgaccgtcaatgacaacctcgccggcgccacgaccgtgtcgggcggcgaccgcgtcggcctgacaggcgcatggaccggcgcaaccggcgacatgggctatacgccgatgccgttcgccaacacgcccatcatttcaggcaatccggatcagccgctggtgtcgctcggcggcaagacgcagagcgtcggcaccccgactcgatcacgggcggccatacgtccgtcgccacttacgactcgaccgcgttcgtcgcgtcgaacgcgggctcgaccgtcgtgcaggtctatcacgacgtgaacggcgaccagtacgtgaacacgcgcatcggcacggtcgcgaattcgggcggcacgctcgacgtatcgatcggcaatcccgcgaacgcgcccgcggcgaccggcaacgcgatcacgatcgcggccaagcagaccgacctgacctacgcggacggcaccggctcgacaccgagcgtcatcaactggaattcgcggaaccaggtctggttcatcaccggcgactatctggcaagcggcggccccgtcggccgcatcgagctcgacgtgccgacctacgcgggcaccttcaccgcgttcgacggcagcaagtggaccgtcaccgacgccgcgtcgctcgccgcgtacaacaactttctcgtgcgttcggtccagaacggcgcactcggctcgcaggcagcctacgacaatgcgttcggccaggccgtgacgttcgccacgcaaaccttcgagtatgcgaacaacgtgtcgcccgacgacaagaacgcgctcccagaaactatccgtcggtgatgcacggcacgggcgcgaacgcgacgctgcacatcggcaaggacggccagatcgacttccgcggcgccaatacgatcgacgcgagcgcggccgtcgtcgcggaaaacggcgcgcacttcgtcaacgacgggcgcctgtcgggcgacttcaccctggtgcgcctgttgagcggcgcgagcggcgtcaacaacggcgtgatttcgtccggttacacgtcgggcgacaatgtcggcacgggcggcaccgtaccgcccgacaatttcggcctcgatacgtacgtcgaaggcagcggcgtgtatgccaacggtacgggcaccacgttcgtcaacaacggcgtgatgaacgtcggtgcgtggaatctcgaccacaaccggctcgacctgcagaactacgcgatcgccgcgaccgacggcgcgaacgcatcgaacgccggcacgatcaacgtcggcgtcaacgcgacgacgctcgacagccaggtgatcggcggcctcgtcgccggcggcagcttcacgaacgaagccggcggcacgatctatctcggccgcgcggcccagtacgatgccggcgcgccggaggccgcgaacgacgtcgcgctgtccacgcacgcatacggcatcctgctcggcccgtcgggcaccgcgaacaacctcggcacgatcgtgatcggttcgcagacgcagaacggcgccgccatggcgagcatcaactcgtcgtccggcacgctgaccaacgcgggctcgatcgtcgtcaacggtgccgcgcccggcacgccgctcgccaacgtcggcatgctcgcggccaacacggcggcgaccgtgaccaacaccggcaccatcacgctgaacggggtaaacggcatcggcatcatggtcgtcgggaccggcacgaacgcgacggccgcgacctcgaccggcacgatcaacgtggccggcggcctcgatcccgcatcgggcacacgaaactacggcgtgtgggccgaggggccgcacgcgaaagccacgctcgacggcgcactcaacctgacgggcaccggtgcgatcggcgtgcacgcgcgctcgggcgcgacgatcgacgtcggcgccaacgcggtgccggcgttcatgtcgggcaccagccagatcggcttctatgcctatggcgccggctcgaagatcaacgtcgccgcgcagcacctgagcgtcgacaccgacgattcgacgctgttccgagtcgcgggcggcgctgcctatacgggcgcgtcggcagccggaacgctgacgaccgacgtcaacggccagcgcgcgcacggcgtgctcgcgaccgacgccggcaccgtgctgtcgaccggtaacgcgatctacaacgtcaacggcgcgaacgggatcgcgatcggcgtcgagggcggcgcgcaaggcacgatcgacgcgggcgcgacgatcaacctgaatgccgcaggcgcgatcgcaggcgtcgtcgacggccaggcgcacgacctcgccggcgccaatgccggcgcgccggtcgcgacgacgctgaccaacgacgcggccgttacgtcgtcgaccgcgggcgtgacgggcttcgtcgcgcagaacctcggcacgctcgagaaccgcgactcggtgctgctgacgggcgccggctcgacgggcgtcgtggtcggcacgctcggcacggtgaacaacgcgtcgacgatccgcgtatcgaacggcaccggtgcgctcgtgcagggcgcgtcggccacgctggccaacgcgggttcgatcgaagccgatgacggcgtcgcgggcgtgcgtctgacgggtgccggcgcatcggtcgcgctgtcgggcaccggcaccgtgatcgcgaacggcagcgccgacggcgtgctgatcgactcgaccgtatcgggcggcgggatcgcggccggtgcggcgtcgatcgcggccggcggctcgggcagcgggattcacaacctcggcacgaatacgacgatcgcgctgtccggcacacaggtcacgacgaccggcggcggcgcgaacggcatcgtgtcgacgggcggtggcgcgcgcatcgcggccgatgcggcgacggtcgtgcgcaccgccggcagcaacgcgctcggcgtccgcgtgacgggcgcggattcgacgctcgcggcgaccggcacgaccgtcgcgacgacgggtgccggcgcacacgcgatcgtcatggatggcggcgcgacggccctgctgtcggccgcaaagatcgccgcatcgggcagcctggccgacggcatcgtcgcacgcaacggcggccacatcggcgatacgggctcgacgatcgccagtgccgccggcaacggcgcaaccgccgacagcggcggcgtactcgcactgaccggcacgacgctcaagggcgcggcggccggcgtgctgacgtccgatacgctcgcaaacggcgcgacgagttcggtgctcgtcgacggcggcagcgtgacggccgcgaccggcccggccttcgccgcgcgcggcggcacggccgacatcgcggtgcgcaacggcacggtcgtgacggccggcaacggtacgctgctcgacctgtcgaacggcagcaacgccaccttcaccgcctcggccgtgaacctggccggcgacatcgtctcggacgcctcgagcaccggcaacgtgcgcctcgcgaacggcacgaccctgaccggcaagatcgacccggtcgcactgaccgtcgactccaccagcacgtggcgcatgacgggcagctccgtgctgagcagcctgaacaacgcgggcctggtcgcattcgccgcgccgaccggttcgccgacgctcgcgggcagctacaagacgctcacgaccggcagctacgtcggcaacggcggcacgatcgcgctcaacacgttcctcggcgccgacgcatcgccgaccgaccgggtgatcgtgaacggcggcacggcaagcggcacgacgggcctgaagatcgccaacacggccggcaccggcgcgcagacgaagggcgacgggattccggtggtcgtcacgaccaacggcggcacgaccaccgcatcggcattccagctcgccgggcccgtgcaggcgggcgcgtacgaataccggctctatcgcggcgggcaaggcgacgcgaacggctggtacctgcgctcgcaactcgatccgtcggacccgggcgacccgatccacccgtccggtggcggcgacggcggcgggaacggcaacggcagcggcggcacgctcgcgtatcgccccggtgtcgccggctacgcgctcacgccactgctgaacgccgactacggcttctcgacgctcggcaagctgcacgagcgcgtcggcgacatcgccaacctcgacaagcagcagcccggcaatcacgacggcgtgtggggcgcatcggcggccagagcctcgacgcgaacgcgggccgcttctcggccgacgagcgcaccttcttcgcgcagttcggcaaggactggacgctcgaccaggcgccgaacggcgccggcagcacgcatgcgggcgtgacggccagcatcggcgtgtcgaacgcgagcttcagcgacatggcacgcgccgatacggccaacctgtcgacgtcgacgggctcggtcgagatgcacgcgcagagcgtcggcggctactggacgaagtacctgtccgacggcacgtacttcgacagcgtcgggcaggtcacgcactacggcaaccgctatcgcgacagctacggcaacgaggcgtcgcaaaacggcttcggcgtcgcgctgtcgcaggaagtcggcaaacccttcgcgatcggcggcctgccggtcgcggtcgagccgcaggcgcagctgatgtaccagtacctgaagctgaacgggttcaacgacaacgtatcggcggtatcgggtacgacgacgaacgcgctgcgcggccgcgtcggggtgcgcatcttccggccgaacctgcagtccggttcgggcggcagcgctgccacgccgtacttcacggccgacgtgctgcacgacttcctgtcgccgggccagaccgtcgtcggcggcacgccgttcgcgacgcatctcggccgcacgtggtacgagctcggcgtcggcgtgaccgcgagcttcggcaagtcaggcgagctgtacgcgaacgcgaagatcgcgcgcaacatcggcggcgactatcggcgcggcatcgtcgggcaggtcggctaccgctacagctggtaacgcccgcgaacggcggacagctgacgaaaaaccgcccggcgctcggccgggcggtgttcgcatcgacgcgcgtgacccgcgcgaacgctcagtgcaggatcttcgcgaggaagtccttcgcgcgttccgatttcggattcgagaagaaatcgtccttgcggtcgtcctcgacgatcgcgcccttgtccatgaagatcacgcgatgcgcgaccttcttcgcgaagcccatctcgtgcgtgacgaccatcatcgtcatcccttcctgcgcgagttcgaccatcacgtcgagcacttcgttgatcatctcggggtcgagcgcggacgtcggctcgtcgaacagcatcgcgatcggatccatcgacagcgcgcgcgcgatcgcgacacgctgctgctggccgcccgacaactggcccgggaacttgtgcgcgtgcgccttcaggccgacgcggtcgagcagcttcaggcccttctcgttcgcctcgtccttgccgcggccgagcaccttgatctgcgcgagcgtcaggttctcggtgatcgacaggtgcgggaacagctcgaaatgctggaacaccatcccgaccttcgagcgcagcttcgacaggttcgtcttcttgtcgccgaccgactggccgttcacgaggatctcgccctgctggaacggctcgagaccgttcacggtcttgatcagcgtcgacttgcccgagcccgacgggccgcacacgacgaccacttcgcctttcttgacctcggtcgtgcagtcggtgaggacctgaaactggccgtaccacttcgaaacgttcttgatggaaatcatcttgtgacctttttctggagacccttgacgagagcagacgccaacgagcaaatcacgaaatagcatgcgccggcgaacaggaccatctcgacggtcgtgccgtcgcgatcgccgatgttggccgccgtgcggaagaagtccgcgaggctgatcacgtacacgagcgacgtatcctggaacaggacgatcgcctgcgtgagcagcagcggcaccatcgcgcggaacgcctgcggcaggatcacgaggcgcatcgcctgcgcgtagttcatgccgagcgcgaacgcggcgttcacctgcccgcgcggcaccgcctggataccggcgcggatgatctcggaataatacgcggcttcgaacagcgagaacgcgaccatcgccgatgcaagccggatgtcgatcgtcggcgacagcccgagcacgccctgcagcacctgcggcacgatcaggaagaaccacagcagcaccatcacgagcgggatcgagcggaacaccgtcacgtacgccttcgcgaaccacgcgagcggcttcacgccggacagccgcagcagcgccagcagcgtgccccagacgatgccgacgacgatcgcgatcagcgtgatcttgaacgtgacgaccgcgcccgtccacagcgtcggtatcgcgccgggaatactactccagtcgaactgatgcatcacttgcctccgatatagccgggcagccgcgtgcggccttcgatccagcgcatgaacgccatcacgacgaggttgatgatcacgtaggcgagcgtcaccgcgatgaaggattcatacgtctgcgcggtgtagtcgacgagctggcgcgcttgcgcggacaggtcgagcaggccgatcgtcgacgcgaccgcggagttcttgaagatgttcaggaattccgacgtgagcggcggcacgatgatccggtacgcgacgggcagcagcacatagcggtacgtctgccattgcgtgaagcccatcgcgaggccggcggcgcgctggcccttcggcagcgcgttgatccccgagcgcacctgttcgcacacgcgcgcgcccgtgaacaggccgagacagatgatcgacgcggtgaagaactgcgtggtgggcggcaactgcttgatccaggtgccgatcgacgcgggcagcagctcgggtatcacgagataccagacgaagaactgcacgatcagcggaatgttccggaagatcgacacgtacacggtgccgatcgcggacagccatttgttcggcacggtgcgcagcacgccgaacagcgacccgacgatcagcgcgatgacccaggcgacgagcgacacttcgatcgtcacccagaaaccggacatcagccatccgaaataagtcgtcggctcgccggtcgacacggggctcaggaagatgccccagttccagtggtaagacatgggcaagactccagcaaaagagacggaagaagcgtggcctcttccgtctcattagcgtcatttctgcatcaacggccgtgcggtcagtcgagcgccttgtcgttcgggttcgcgtacagcttcttcatcgaatcggacagcgggaagttcaggttcagccccttcggcgggatcgggttctcgaaccacttcgcgtagatcttcgcggcttcgcccgacttctcgacttgcgagatcgcgtcgtcgacgaccttcttgaagtccgcatcgcccttgcgcatcatgcagccgtacgcttcttccgattgcggcgtgccgacgatcacccactcgcccggctgcttcgccttcgcgcgctcgcctgcgagcagcgcgtcgtccatcatgaacgcgaccgcgcggcccgattccagcgtgttgaaggaatcgccgtgatccttcgcgctgatgatgttcatgccgagttgcttgtcgttgttcatcttgcgcagcaggcgctccgacgtcgtgccggcagtcgtcacgaccgtcttgcccttcaggtcggcgaaatccttgacgcccgaatccttcttcgtcatcaggcgcgtgccgatcacgaagatcgtgtcggagaacgcggcctgctgctggcgctcggtgttgttggtcgtcgagccgcactcgatgtccaccgtgccgttctgcacgagcgggatgcggttttgcgacgtgaccgggatgttcttgacctgcaggttcggcaggttcagcttcttcttcaccgcgtcgaccaccttcagctggaattcgcgcgaatagccgacaacctgctggttctggtcgtagtaggagaacggaatcgacgattcgcggtggcccagcgagatcacgcccgtgtccttgatcttcttcagcgtgcccgtctcctgagcatgcgcgccgcttgcgaacgcgcaaagcgccgcgaccatcaggactgccttttggtatttcattttggtcatctccttggctaaaacccgcgccagtgtatcaaagtaatatttttgaaagtactgttgtttaccgcacgtcgcagcgccctgacaaagccttcctcccgactccaggcgccccgaatgcgcgcggggcgatgccggattcggcaccgcccgcgagggttcatatccgcaaccgggtggattgcgtcatgaatggatcatagtcaatgatcaggggtagaggccacgcatttcgcgcgccatcaggatgcgcttgcacgccacgatgaacgccgccgtacgcaccgacaccttgtgctcttccgcgaccgcccacacgccggagaacgcttcgcgcatcacgcgctcgagacggtggttgatctcgtcttccgtccagaagaagctcgagaaatcctgcacccactcgaagtacgacacggtcacgccgcccgcattcgcgatcacgtcggggatcacgagcacgccgttcgcggtcaggatgtcgtccgccgccgtcgtcgtcgggccgttcgcgccttcgacgatgatcttcgtgcggatcttcgctgcgttcttctcggtgatctggttttccagtgccgccgggatcaggatgtcggtttcgaccgtccagaactcgtcgttcggcatcggctccgcgccttcgaagcccgcgacgccgcccgtgcgggcaacgtggtcgagcagcttgttcgaatcgaggccggccggctggtagatcgtgcccgtgtgatcctgcaccgcgatcaccttcgaacccgcttcctggaacagcttcgccgcgatgccgccgacgttgccgaagccctgcaccgcgatgcgtgcgccttcgatttccaggcccttcttcttcgccgcttcggagccgacgacgaacacgccgcggcccgttgcttccttgcggccgagcgaaccgccgagcgcgatcggcttgccggtcacgacgccggtcgacgtctggccctggttcatcgagtacgtgtccatcatccacgccatcacctgttcgttggtgttgacgtccggtgccggaatgtcggtgttcgggccgatgatgatgccgatttcgctggtgtagcggcgcgtgacgcgctcgagctcaccacgcgacagcttgcgcgggtcgacgcggatgccgcccttcgcgccgccgtacggcacgttcactgctgcgttcttcacggacatccatgccgacagcgccatcacttccgacagcgtcacgtcctggtggtagcgcacgccgcccttgcccgggccgcgcgacacgttgtgctgcacgcgatagccttcgaagtgcgcgacggtaccgttgtcgagctcgatggggcagtcgacgatcaggatacgcttcggacgcttcagcgtttcgagccagcgcgacagcgagccgaggtacggtgcgacgcgatcgacctgctgaaggtagttgccccacgggccgagatcgtcggcgtgcaggtaggacgggatggactgctgttgcgaagacatggatgctccaacgttcaacgaagtgcgcacattgtcgaaaaacccgtttttttatccaatgccgtttgcttattcgattatgcgtttcttgcatgatcgcgatttttcgcaaatctgcggtcgatttgcgcaagaacgcccgcgatcggccgtgcatcgcgtgctcgaaaaatcgtgttgcgcgggcgcgggccggccgccgggaaggtgcccgacaggcaccgcaagcccgacgacagccggccgggccggacgatcgacggttaaccgcccacggttaaccggcggattcgcgcagttcgtcgcgcacgacgtcccacaacgcacgcacgagcttctgtcgtggatcgtcgccctgcagcgcgagcttgtcgcagtacagccggatctccatcgtcagcgtgaacggatgcgcgccgccgcgcaccgaccggtcgagccggatcaggcggccgcccgccaccgcatcctcgaccgcgctgtgcggcaggaacgcgacgccgtggcccgcgagcgccatcgccttcagcccttcggccatgtcggtttcatagacgcgatcgaggaacagcggcgtcgacgcattcgcgacgatgacctccgtcatccggccaagatacgcgttcggcgtatatgacaggtacggcacgcgcgcgtcggccgtgccgggcagcgtatagcgcggccgccccgcgcggcccggcgccgagaacgggctgatcggctcgctgccgaggatcagcatgtcgtagcgcgccgggtcgagcgcgacgggatggctcgggtggtggtagcccatcacgagatcgcagccgccctcgacgagcgacagcaccgcatcgtgcacgttcagcgcgcgcagccgcgtgtgaacctggcccatcttcgcctcgatccgctgcagccagcgcgggaaatacgtgagcgacagcgtgtgcggcaccgcgaactcgatcgtcggcaccggcgcgccgacgtggccgcgcagcagcgtgcgcgcctcgtgcgcctgcgacagcatcgtcagcgcctgctcgtagaagatctgcccggcctgcgtcagccgcgtcggatagaccgaacgatcgatcaattcggtcgcgagccatgcctcgagcgcctggatgcgccgcgaaaacgccggctgcgacacgtgccgcagctcggcggaccggctaaagctgcgcgtttccgcgagcgaaacgaagtcttcgagccatttcagttccatgcaggcgggcgcggcgggcggcggtcgggaagaagcctgcattctaccggcgggcgggcccggccggcggccgcgcaagcggcccggcgcgctgccggatgcgggcgccggcacggcgtcggcacgcggcggcggcggctcgccgggcgcggccggaatcgttccgcgccgatggtaaaatgccggattctccctcctcgctcgacccggccctcaaagcccgcccgatcatgtccgacactcgtcccgatacgcttttcgccctcaccgcgctctcgcccatcgacggccgctacgccagcaagaccgaagcgctgcgcgactggctctccgaagccgccttcatgcgccaccgcgtcaccgtcgaggtgcactggctgatcgcgctgtcgcgcgccggcttcgcggaagtcccgcgcttctcggaagcctccgagcagtttctgctgcagctcgccgagcgcttcaccgcccacgacgccgcgcgcatcaaggaaatcgagcgcgtgacgaaccacgacgtgaaggccgtcgaatactggctgaaggaatcggtgaagggccaggaagaactcgaaaaggccagcgaattcatccacttcgcgtgcacgtccgaggacatcaacaacacgtcgcacgggatgatgctcgccggtgcgcgcacgcacgtgatcgtgccggcgctgcgcacggtccaccagcgcctcgtcgcgctcgcgcacgcgctggccgaccagccgatgctgtcgcgcacgcacggccagccggccagcccgacgacgctcggcaaggagctcgcgaacgtcgcggcccgtctcgaccgcgcgatcgcgcgcatcgagaaggtcgagatcctcggcaagatgaacggcgcggtcggcaacttcaacgcgcacctgtccgcgtatccggaattcgactgggaagcgttctcgcgcgacgtgatcgaaaaccgcctgaagctcacgttcaacccgtacacgatccagatcgagccgcacgactacatggccgagctgttcgacgccgtggcacgggcgaacacgatcctgctcgacctcgaccgcgacgtgtggggctacatctcggtcggctacttcaagcagaagacgaaggccggcgagatcggctcgtcgacgatgccgcacaaggtcaacccgatcgatttcgagaactcggaaggcaacctcggcctcgcgaacgcgacgctgcgccacctcgccgacaagctgccggtgtcgcgctggcagcgcgacctgaccgactcgacggtgctgcgcaacatgggcgtcgcgctcggctactcgctgctcgcatacgactcgctgatccgcggcctcgacaagctcgaagtgaacccgcagcgcctgaacgaagatctcgacaactgctgggaagtgctcgccgagccggtgcagacggtgatgcgccgctacggcatcgagaacccgtacgagcagctgaaggaactgacgcgcggcaagggcatcacgcgcgaagcgctgcaggaattcgtcggcacgctcgcgatcccgcaagacgcgaaggatcgcctgctcgcgatgacgcctgcgtcgtacatcggcaaggccgtcgaactcgcgaagcggatcgcgtaagcgcccgtctccgtacgtaaaaagcccgatgcgagcaatcgcatcgggcttttttacgatatctcccgggatggggttgaaaacggtctggaacccggggatggaggcactaggatcagcacaagctcccgtcgttaacgaacctcgtgaaattccaaatcacgttcctcctggagacttcacgtcagcctattcaagaacatctcctgcggcgtgcccaggtagtcgcacaggtaccacgcaaggccgtctatcggtggcgcgggcggctgcagccacagcgggtcttcgtcctgccggtagtaatcgccatactcgggctgcgtcctgctgcacgcctgcactacgggcatgaagctaccgggctcatagacatagtgcgttgtgcgcgcgccgtagccgtcttcgtcggcgatcttgttctcccacgccagcgtgtcgccgccccagccgtagagcagccccatctcgcccgcactagcaggacatagcgtcccatttcaaatcatcctcatttgcgtttctttgggtggcgctggcgcagcaattcgcaaacagctcttttctcgctcagaattgcaacatcgagaggtatctgctggaactcgtttttgagtgtggtgtgagccccgatagacagaaggagttccactgcctgcgcggcctcatgcaaaggcatgctatcgaaatcgcctctaatcttgatatccgcaccagcgttcacgacgacgttgatgtactcaaggttcccggtgcgcgaagcaatgtgcaacagcgtgctgtcaagagcgccgcgctgcttcacgtcttcgatgttcaacccaagaaactccgggtgccgtttgtaggcatcaaagacctcctgcaacgttttcttcgtcacggtcatttacttgtgcacttccaattgtcatgattcagtgaccgcacattgcttcagccaagcgttcccgggatcgactaacctctccaatggatgtgtatgaggacaagctcactgcgtagagaaagcgcgttgcggcaatccgttgcatccaattgccttgccgccaaaccactgggagccctcaaagctacatggagactgaaagttatctccttcgaaccgacaaccgatgaattcacagttcaggaaacgacaatccaaaaattagttccatagaacacgcaattgacaattctggtatctacgaagagacaaccattaaacaatccccaataccaattcaatccctctaattcacacgatagaaaaacggcatctacacttttcccatccaacgtaatttccttgaatgagcaatacctaaatacccccttcaaggttcgctgacaatgatagttcgtcgctgtattctgcacgttcaattagcatgtctgcctcacttaccaccaatactgaagcgggtagaagcgcccgtttatagggccggccctgcccgccaaaattacggtaccgggatcagattacgtggtgggaagaggcgcgacccgacgctgatgatccaataagcgatgaccccagccccaactgctttgacagcatcattttccgagggcggtacagcagcctgtgtacttgtcgaagttactggtgccgaacccggtccacctccgccacatttttcagcatacaacgcctcatcatcggcaagaccgtccttcaaatctcgaatgatgtcttcatgcccctgcacgctcattctcggtggtgcaccacggtacggcggataatacggaaggtcaagcgggttggtctttacttcgcatatccgcttattaatatcagatttcttgttctgaatctttctcttcaactgttggcactctgctccattggggtcaagttggcgcaccagtcctaatgggtcgatatatgccagaggatttctgttgacatatgtgtacgcattaaatccaccgaggaggccaatcggatcctgtgagacgtactgtcccaccatcggatcgtagtacctaaaccggttgtagtgcagccccgtttcatggtcatggtactgcccctggaaccggatgggattggcgactggtgcattcccgatatcttgcggatcgcttcctgcgccataccccacgcgcgatactccgcgctccacgcaatctcgctctgctcgtccgtcaactcctgcggcgtgcccaagtgatcgcactgataccaggctaagccgtctatcggtggcgcgggcggcggtggcatccacagcgggtcttcgtcttgccggtagtagtcgccgtagtccggctggtcgagcagttcaatggcgtcgtcgcgcaccgcctgcgccactggcacaaaactgcccggctcgtagacgtagtgcgtggtgcgcgcgccgaagccatcctcatcggcgatcttgctttcccacgccagcgtatcgccgtcccacccgtacagcgtgaagccgcattgcagctcgcggttgcgcctcacccgctcgccgcggttccagtgcggcccggcctcgcggcgttcctcgtaatgggccttgctgtacttcgacaggcgccggccgagagcgtcgtaggtgtaatcgaccgcaaggcgctcatcctcgtagtgtgtgagccggtcgaacaggtcccaagtgtagcggctctccttgccctggtgccagcgcttgctgaggttgccccacgcgtcgtactggtagtgggtgccggcgtattgcttgagcaggttgtccagcgccttgatgcgcggcatgcgctggcgctcggcctcgcgctgttcggccggatcgatcaggttgctggcagggtcgaacgcgaaggtttcgtggcccaggcggctttgtgcctccagcagccggcccaccggatcgtagcggtaggccagctggccgcgccgcgtgtcgttgatatcggtgagctggccgctggcgtcgtagcggtagcggcgcaccagcaggcggctgccgccagcggtttgcgtggccggctctttggcctcgtgggcaagtacctgctcgctcaaccgccccatggcatcccactgctgcttctgcagcaggcggttgccctgggtgcggacgatttcgcggtgcaggtcgtcacgctcgtagctgaccagttcgcgctcgtccagttgcagcgccagcaggtggccgctgccgtaggtgagccagctcaccctgtgcccgtccgggcgcacggtggcgatgcgctggttgagcgcgtcgtattcgtgctgccatacgccgaccagcggcttgccgaggcgggtgtagtgctggtgctcacgcaccaggttgccggccgcgtcgtggaaccattgcagtcggctgtcggcgttggtggccagcgccaggttgccgttgaggtcatacgcgaagcgttccacctgccaggcttgctcacgcggcggcgtctcgccggtttgcagccgcgcggcgttctgcaagacggcccatggcgtcgaaggtataggcggtgatgcgctgcccgttcaccgcgcgcgccagcttgccggtttcttcctcgtactcgtagcgggtggtcgcgccgtcgaagccggtttccgccaacaggcgacccaccggatcgtagtgaaactcggcttcgcggccgttctcgttgcgcagcgcggtgagctgaccgagcttgtcccactggtagcgcagggtctggccggccgcgtccacccggctggcgagcagcccggcctcggtgtagtcccattcggtacgccgccccagcgcatcgacgtgggtcagcaaacgcccttcggcgtcgcgctcgaagtgttcttcgctgttgtcgggatggcggatgacggcgagctggccggcctcgtaacgatagcgggtgacctgtccggccgcgtcagtgaactggatcatctggccgcgttcgtcgtaggcccaggtactggccttgcccgaacagtcgatgtagcgcgtgagccggccgctggcgttgtactcgagctgcttggtcttgccgctggcgtcggtgataccgatcggcaggcccatcaggttgtacgcgtattcggtcttgttgccgagcggatcgatattctcagtcaggcggccgcgcgtgtcgtagtcacgcagccagagcccaccctcggcgtcgctgatcttgatgagctggttcttcgtatcccacgcgtagtgcaccaccgtgccatcggcccggatgtattcgagcaggttgccgttctcgtcgtaggcgtaacggtcttcgctgccatcggtgtggatgtggtgcacgacgttcttggcagcatcgcggaacagccattcctgccgctggtccgggtggatgatgcggtaggtgtagccgaggctgtcgtagtagtgccgcgtttcctgtccgtgggcgtcggtgacgtaggtgaggcgaatgttcgggtcccactccaggcgcacctcgaagctgccgtcgtcggcccattcatgcacggcacgggcgtcggggcctgcgccctgccatgcgaggttcatcccgcggccggtacggtcggtgtagcgggtgatcaggtggtgttggtactggtaggtccagacctcggcgttctcgtcctgggccagcgtgaggtcgccggcctcgtcgtagcgatacaggctcagacgtcgcaggggcttgtcctcgcccatcagccacaggccggtgaggcggccagcctcgtcgacttgggtgcccagatgcgtgtgcggctggctcgggtcgtcctggtaggtgaccaggtccgacaacaccacgcgctcgtccacgcggtggtcgtagcccagcagcatgccggcgccgccgcgcaactcgatctgcgtgagcaggtagcggtcgccataacgctggtaggtctcgcggcgctcgaaccctcggcacaatgccagcctgctttcgccgacccggatcagcgtgaggtcttcgatacggtcgtcgtgcgcttcgcccaccttgggcagcgggtagtcgaagctgcggccatcagcagcgtggtaacgcagaccgtcgccaatcacgtcgaggcgcgtggtgtaggggtgatccagcgcgcgccgagttcgtcgtggtcgtaggcgtccaaactggagcggtaggtacgcgtccaggcgatgggaaacggaccgggcagaacgaaatcggtgtgcgagagggtttcggtgcccgtggcaaaactgatgctgccgccactgcacgactgcacgccaatcttgcactggttggcgtcctgctcggcaggccgctccttgacgcggacttcaagggactcgccggggatctggcgcccagcgatgctggtcgcgtcgggtttgatgctggcactctgcccggcgcccgcttcccgggcctcaagcgagcggaccaatcccgccgcaacccaccccacgctacccacctgggtagcctgaccctgttgccgcacctgcttgcccagcaatgcggcgaactggcgcaacgcctgggcgttggcgctgaccagcgtcgacgactcaagaggcgaactctgttcgaaagagggtcgggtaatcgcgttaccgcgaaggaattgatgggctgcgtcgtagaggttggaaaacgcagccgctggatcgcgcagttcggtcgttgccgatgtgcttgccctcagggcggccggcgcaaagggctccgcccgtgccaaggcctccaggccgttcgcaaggtcagagagcaggctttcgccgaaggcggccgccgcgtccagcagagcgggagtcttgactgtatccgctgcgcgaggttgtccagttctccctggatgctgtggttcagattgacggcaagagtgcgcaacgccgcctcgcccacccgcgcattcccacgctgcaggagttcctgccgcgccaggaacagggtgggccgcagcaccatgcgggcagcggcggtatccggctcgggcatcaggccgatcaggttcaggctgacgctcaaccagtcagaggcgtgaggttccgggtgggtcgtgagggtgacgatatcgccgagcaggtcggccaagttcaggatgttgagaacggcggaaagttcccggcgaccgtgcgcagacggtctaagttcacgctgccatgactgatggcgcccagccattcgtcaaacgctgaaatgctgagggccacgtcgcccaactgaatctggttgagcggagcaaccgagattgggcgctcgcgggatgtgttggtggaagtgctggatgtctggcctgccataggtctcccgaagccgagcacctgcggctacggtacggcgaaccaggttagccgcaagccctcagcaaatgtggatgtacatggacttcttcagacgccagcatgggcattgatcaacggcggggatatgagacgactccgaaaatacacgccgaaattccgcaactcgtacgaaattcaattcgacatgcctcccgctggatattgccttgtggcaatcgtcacggcactgaattgcctttcactccagcaaggtagccggcccacgtctggagcaaggacctcctttcgtccaacagcagagccttgttttaaatagcacgaacctcgttgctttcaacgcgggaaagctgccgctcaatcgcgcttggacagaatctcggtagaccgtatttcaatcgccacccgttgatttgaaactggtggttatgtcctacgggcgctaccgaggcccactgagttccacgaaaaattgtcagacactcagaacgaaatcatccgccccggattgagcgcgctcatcacgctcatcgcagccttcgcggccgggatcgcgatcggcgacaactggcggccgagcggaatcgcgcgatggtcgatgccggtcagcatcgagaaatcgtcgttgcgtccgacgaaatcgtcgcagatcgccttgccgatccgcaccgtctgcgcgacgccgtggccgctccagccctgcaccatgtacatcggcacgcggccgtcggtcttgcggctgtcggtcgcgccgttcagcgtgaagtcgctgacgccgctccagcagtaatcgagcgcgaactggccgtcgacctgcgggaacaccgtgttcagccgcgtcagcagatacgcgttgacgtcgggctgcgcccagcacgtgccggtgccctgcccgccgaacagcaggcggttgccgcgtaccggccggtagtagtcgatctggaactgcgtgtcgtacacgggcatgccggccggcatcagcatcgcaacgtcgacgtcgagcggcgccgtcacgctcacataggtaaagaacggcacggtcgtcgcggcgccgtcgtcgagcagccggaacgtcgtgttgtgcagcgcgagcacgacgcccttgcgggcggtgatcgtgccgcccggcgtcgtcgcgacgacgcccgcgggcgtctcgtcgagctcgactacctcggtgccctcgtacagcgtgccgcccttaagcctgaaaccgtggacgagcccgcgcaccagtgcgagcggatggatctgcccgccgatcgcatcgatcgccgcgccgtggtacagccccgaacgcacgtattcgtcgtgcaactgatggcggccgacgagcgtcacgcccgcgtcgccgagatgacggcgcgcatccgcgccgtccagcagcgcactcatgtggccggggtggacggccgccgtgatgtgcccgcgtttgcggtcaagctcgagcgcgtaacgcgcaccgatcgtatcgatcaagtccatcgattcggccgacgcgaagcgccacagccgcttcgcgtcgtcgtgcgacaggtggtcgatcatgtcggccgcttcccagcgcgcgaggccgggcgtcagttgcccaccgttgcgccccgatgcggccgagccgacgtggtgcttgtcgacgaggatcgtgtcgacgcccgcttcggcgagatgcagtgcggccgatgcgccgagcagacccgcgccgatcacgagcacgtcgcataccgcgtcgtgcgcgagcggcgcggtgttttcatggcgcgacagcgacgcctcgtaccagttcgccgggcgctcgccgtcgtggcgggccggatcgcaccagttccagttgtctttttcgatgttcagttgcgtttgctcgaaacgcgattcgccctggatcaggggttgattgttgaaagtcacgattgcacttgcatggtcttgggccgcctgtcgaagagccttctggctttgcgtgtggggcagccggttccacatgggtgtcaacgagaaaaggggcgcgatggcccgtgttgacggcgggcacgctcgtgccgcctggatcccggactgtgcgaaagcacgtattgaaaggtgccgggacacccaatttctacaccgcagaaataattctacagtgtagaatcagctttcgtcaagtttacagccggcgccgcaccggcacaccggcccgtatcgatgaaagacaaacccgcccagggcccgcgcggcctcgacaaggatgcgatcgtcgcggcagcgctcgcgctgctcgaagacgtcggcgaagccgcgttcagcgtgcgcaagctcgcgcagtcggtcggctgcgacccgatgagcgtgctgtaccacttcaagtcgaaggaaggcctgagccgcgcgatcgcgaacgcgctgtcgcgctcgctcgtgccggtcgacgccaccctgccgtggcgcgaacggctgcgagacctcgcgcgccagtaccgcgcgctcgcgctgcgctacccggccgcgttcgcactgctgcagcggcacatgagtaccgggccggccgatctcgcacacatcgaggccgtgcatcgcgcgctggccgacgccggcatccgcgcgcggcgctgccatcggtttgcgtcggctggtatgcgagcgtgatcgggcttgccgcggcagaagccggcggcctcacgcgcgccgcgaacgacgtcgagctcgcggaaatggaggcgctgtcggacgccgcgcatccgctcgtcaaggcggccgccccgctctacgcgcagctcgacccggcagccgtgcacgacacgatgctcgacgtactgctcgacggcatcgcgaagcaggcgcccacggcctgaccggcccgccggccaacaacgcaaaaggcgccccacggggcgcctttgcgtgatgaatgccgcgaaccgcgctcagtgctgctgcgcgatgccgatcttcagcatgacctgatcgacgatctgttcgggcgtcagctcgatgctgacctcgatcgcttcgtccgggcccggctcctcgagcgtgtcgagctggctcttcagcagcgacggatcgaagaaatggccggtgcggctcttcaggcgctcgtgcaacacctcgaacgaacccttcagatacacgaaccgcacgtcggtgtcggtgccgcgcagcacgtcgcggtacgaccgcttcagcgacgagcacgtgaacacggccgtctcgcccgcgcgctgcttttcctcgatggccgcgcggatcgtgcgcagccacggccagcggtcgtcgtcggtcagcggaatgccgtggtgcatcttttccttgttcgccgcgctgtgaaacgcgtcgccgtcggtatagctgcacgacaggcgttccgccagcatttcgccgattcgcgatttgcccgcgcccgacacgcccattgcgatcagaatcattgactaccccttgttacaaaaccatgctcagcagcagcgtgaagctcaggccgagaatcgagatgatcgtttcgagcagcgtccaggtcttgaacgtctggccgaccgtcatcccgaaatattccttgatcagccagaagccgccgtcgttcacgtgcgagaagatcagcgagcccgagcccgttgcgagcaccagcagttccggacggaccgccgcccccgatgccgccgcgatcggcgcgacgatgccgcaggccgtcgtcatcgcgaccgttgccgagcccgtggccagacgaatcagcgcggcgacgaaccagccgagcagcagcggcgacaggtgcgcctgcgtggccgttgcgacgatctgctgcgagatcccgctatcacgcaggataccgccaaagccgccgcccgcgccgacgatcagcgtgatcccggcgatcggcgccaggcactcgccgcagaacttctggatctggtcgcggttgaagccctgcagcttgccgaacgtgaagaagctcacgagcacggcgatcagcagcgcgacgtccgagttgccggcaaagcgcagcaggttgttcggcagcgtcttcggcgcgaacagcaggtcggcccagctgccgaccagcatcaggatcaccggcagcaggatcgtgaacagcgtgatgccgaagcccggcagttcgcgcttcttgccttcggtgtgcgtgtcgacgaattgcgcggcgagcgggttgttctccggcagcttcacgaacttcgagatcgtcagcgcgaacagcgggcccgcgacgatcgcggtcggcacgccgacgatcaggccgaatgcgatcgtcttgccgatatcggcgccgtactgctggaccgcgagcagtgcggccgggtgcggcgggatcagcccgtgcacgaccgacaggccggccaccatcggcaggccgacgacgagcagcgacttgccggtgcgcttcgcgacgttgaacgcgatcgggatcagcagcacgaagccgacttcgaagaacaccggcaggccgacgatgatcgcgacgaacatcatcgcccagtggatgttcttttcaccgaaccagtcgatcagcgtggtcgcgatccgttcggcgccgcccgattcggccatcatcttgccgagcatcgtgccgaggccgacgacgatcgcgatgtggccgagcgtattaccgttgcccgtctcgaacgacttgacgatcttgtccatcggcatcccgaccaccaggccgaggccgagcgacacgatgatgagcaccaggaacggatagatcttgaaccgcgcgatcatcacgatcaacgccacgatcgcgatcacggtatagatgagcagcatgctgccttggacagcccccatgtggactcctccttgggattattcgaaccgggcgatcgttgcgagtatgcccggctatgcaggtctccgaaacagcggggagaccccaccgtcaggacgctgaattttacttatctttacggttcgcggatagaaccggttccatcagcaaaaccctcggtaaaacaagcactaagcgcttgtcttccgagggtcaaaccatcattccgtacaagtcttaacggggaagctggctcgcggcttgcgcgagacgcgtgacttcggcccagtcctgcgcggcgagcgcggccttcggcgtgagccacgagccgccgacgcacaccacgttcggcagcttcaggaaattcggggcggtttcgaccgtgatgccgccggtcgggcagaacttcagcgccgggaacgggccgtggaacgcctgcagcatcggcacgccgcccgcttgttgagcggggaagaacttcacgatctcgtagccgaattcgagtgcctggatgatgtcgctcggcgtcatcacgcccggcagcagcggcaggcccgcgtcgagcgacgcgaggtgcagctctttcgtcagccccggcgacacgccgaacttcgcgcccgcgcgcttcgcctgctcgcaatgctcgggcttcgtgatcgtgccgacgccgacgacgatgtcgtcggcgagctggctcgcgcgctggatcgcttccaggccggccggcgtgcgcagcgtgatctcgagtaccttcacgccgcccgcgtgcaacgcgcgcgacacgtgttcaccctgctcgaccgagtcgaatgcgagcaccgggatgaccgggcccagcttcacgatttcagcaatcgtcttcattgaattggctccttgaaattcatgcggcgacgtggacggccgattcgccgaccagcgcgccgaaaaccgatgcgccctgctcggccggcgcggcggccgcgcggaacacgccgaacagttcacgcccgaaaccgacctcgttctcggcctggtgcagcggctgcgcgaccgggcgcgcctgccactcggcggcgtcgacctcgatgtcgagcacgccggcttcggcgtcgatcacgagcgtatcgcccgtcttcaccttgccgagcgggccggccagcagcgcttccggcgacacgtggatcacggccggcaccttgcccgacgcgcccgacatgcggccgtcggtgacaagcgcgacgtggaagccctgatcctgcagcacgccgagcagcggcgtcaaacggtgcagctcgggcatcccgttcgcgcgcgcgccctggaagcgcacgaccgcgacgaaatcgcgcttcagctcgccgcgatcgaaggcttcctgcacggcttcctgcgaatcgaacacgatcgcgggcgccgtcaccttgcggtgctcgggcgcgaccgccgaaatcttgatcacgccgcggccgagccggccctgcatcaggcgcaggccgccgtccggctggaacgggtcgcggatgccgcgcagcaccttcgtgtcgtggctctcggccgcgccgtcgacccacgtcagcttgccgtcgatcagcttcggctccttcgtgtagtgcgacaggcccttgcccgcgacggtcgtcacgtcttcatgcagcagcccgccttcgagcaggttgcgcaccaggaaggccacgccgcccgccgcgtggaaatggttcacgtcggccttgccgttcgggtagatcttcgcgagcagcggcacgacggccgacagttcgtcgaagtcgttccagtcgatcaggatgccggccgcgcgtgcgatcgcgacgaggtgcagcgtgtggttggtcgagccgcccgtcgcgagcagcgcgacgatcccgttgacgatcgccttctcgtcgatcacatggccgatcggcgtgtagtggccgcgttcgacggtcaggtcgagcacgcggcgcgcggcctcggccgtcagcgcggtgcgcagcggcgtgtgcggatgaacgaatgccgagcccggcaggtgcagccccatcagctccatcagcatctggttgctgttcgcggtgccgtagaacgtgcaggtgccgtggccgtgatacgcggccgattcggcctcgagcagtgcgtcgcggccgacctggccggtcgcgaactgctggcggatcttcgccttgtcgtcgttcgacaggccgctcgtcatcgggccggccggcacgaagatcgtcggcagatggccgaactgcagcgcgccgatcagcaggcccggcacgatcttgtcgcagatgccgaggcagagcgccgcgtcgaacatgttgtgcgtgagcgcgatcgccgtgcccatcgcgattgcctcgcgcgagaacagcgacagctccatccccgggttgccctgcgtgacgccgtcgcacatcgccggcacgccgcccgcgaactgcgcgacgccgccgttctcgcgcgcggccgccttgatgatctcgggaaatccttgtacggcgcgtgcgcggacagcatctcgttgtacgaggacacgatgccgatgttcggctcgcggatcgccttgatcgagaacttgtcgttgccctcgaggcccgcgaaaccgtgcgcgaggttcgcgcacgacagtgcgccgcgtgccgggaacttgccctgcgcgccgtcgatgcgctgcagataggcggaacgggtcgattggctgcgggcgatcacgcgttcggtgaccttcgccagagtggggtgcagcgatgtcatgctgggcgctcctgtatgccggccgacaccggcggttggaatcgtgggaacgatcgagtgcgtcgaacgaacgaagccagtctagtagaaaaactacaagcgcgcaatgtcgatccgcatgtgcgcaacccttattcccgccaccagcaaggctttacctagtgaaaaccctaatcatcggtatcccacgcgccatgaaatgccgacaaatcagctagtaatttgatgtagattttctacaattcgattgcgatacactcgctcatccgaacccgatttctgcctgcccgtccatgctgccccgcatagaagcgatccgcgccgagttgcgcccgtccgagcgcaagctcgccgactacatcctcgccgcgccgcgcgaggtgctcgacctcgcgatgaccgagctgtcgacgcgcgcgggcgtcagccagccgacgatcgcgcggttctgccaggcgctcggctgcagcggcttccgcgaattcaagatccggctcgcgcagagcgtcgcgccgggcgtgtcgtcggtctatcgcgacgtcgagcccgacgaaccggcgcccggcatcatcggcaaggtgttcgaccgtacgatcggcgcgctgatcgaggtgcgcaacagcctgtcggccggcagcgtcgccgaagcgatcgcgctgctgtcgaacgcatcgcggatcgagttctacggcgccggcggctccggcatcgccgcgcaggacatccagcacaagttcttccggctcggcgtgccgagcgttgcgtattcggacccgcacacgttctcgatgtcgtcggcgctgctcgggccgcacgacgtcgtcgtcgcgatctcgaacaccggccgcacgcgcgacatcgtcgacgccgcgcgctccgcgctcgcgtgcggcgcgaaagtcgtcgcgatcacgcagagccattcgccgctcgcgaagctcgcgacggtgagcctcgcgtcgaacgtcgcggaggaaaccgacgtgttctcgccgatgacgtcgcggatgtcgcatctcgcgatcggcgacatcctcgcggtcggcgtcgcgctgtcgcgcggccccgcgctcatggaacgggtcggccgcgcgaaggaggcgatcacgcgccgccggatcgacgacggcacgaaggattgagcaggcggcaggcagcgcgcgcgtaaacgacgaacggcgccccgaggggcgccgttgcgcagggttccgcaccggcaaccgcgccggccgcgccgctcaaaacggcttgatcacgaccagcgcgaccgccgcgagcatgccgagcaccggcagttcgttgaacacgcgataccacttgtcggtgcggcggttctcgccacgctcgaacacccgcagcaggtgcccgcaataggcgtgatagacgatgagcagcagcacgaccgtcaccttcgcgtggatccagccctgcccctgcccgatgccgatcgaaagccacagccacaacccgcaggccagcgccggcaccgcgatcatcgtcatgaagcggaacagcttgcgcgccatcagcaacaggcgccgcacggcggccggatcggtttccatcgccaggttcacgtagatgcgcggcaggtagaagagccccgcgaaccacgcggcgatcagaacgatatggaacgtcttgacccagagcatcgccatcggttgtgtgcctcgcttgttattggcggccttcgccgtgcccgagcacgacgtacttcagcgacgtcagcccctccaggccgacggggccgcgtgcatgcagcttgtcgttcgagatgccgatttccgcgccgaggccgaattcgaaaccgtccgcgaaacgcgtcgacgcgttgaccatcacgctcgccgaatcgacttcgcgcaggaaccgcatcgcgcggtcgtgatcctcggtgacgatcgcatccgtgtgatgcgagccgtaatggttgatgtgctcgatcgcggcatcgaggccgtcgacgaccttgatcgcgagcaccggcgcgagatactcggtgtgccagtcttcctcggtggcatcgacgagcgggccgacgcccgcatcggcgagcaccgcgcgcgcggctgcatcgacgcgcagctcgacctgcttgtcgcgatacagcttgccgagcggcggcagcagcttcgccgcgacaccgctcgcgacgagcagcgtctccatcgtgttgcaggtgccgtagcggtgcgtcttcgcgttgtcgcagacggtcagcgccttgccgaggtcggcgcgatcgtcgacgtacacgtggcaaatgccgtcgaggtgcttgatcatcggcacgcgggcctcgttgatcaggcgctcgatcaggctcttgccgccgcgcggcacgatcacgtcgacgtattcggtcatcgtgatcagcttgccgaccgccgcgcgatcggccgtcgcgacgacctgcaccgcatcctgcggcaggccggcggcttcgagcccttcgccgatcagcttcgcgagcgccgcgttcgattcgagcgcttcggagccgccgcgcaggatcgtcgcgttgcccgacttcaggcacagcgcggccgcgtcgatcgtcacgttcgggcgcgattcgtagatgatgccgatcacgccgagcggcacccgcatctggcccacctggattccgctcgggcggtacttgaggttgccgatctcgccgatcggatcggccagcgacgcaacctggcgcaagccctcgaccatcgtcttcagcgccttgtccgacagcgtcaggcgatcgacgaacgctgcatcgagccccttttcacgggcacgggcgacgtcgcgggcattcgcgtccttcagtgcctgcgcgtcgcgttcgatcgcgcgagccacggcgtcgagtgccgcgttcttcgcggccgtgctggcgcgcgccatcgcgcgggaagcgtgccgggcgcgacggcccaggtcggtcatgtactgatcgatatccatcgtgtgactcgagaagcgcgccgcgctgggcggcatgaattcgtggggaagcgtggacggcggccggagagccgcgcccgtgatcgaaacattgtatgcgggttgcgcagcgcgcgctgaaggcccggacgggacttagcgtcgcacgcggcccgcggtcggcggtcgctcgccgcgggcaccggccaccgtcatcgcgagctggaacagcccgtcccacggatcgggcggcggttcgtcctgcgtgcggcggcccggcacgacggccgtgagccccttgacctgccggtcgagcttcgcggcaaacgcgagtgccttctcgagcacggcttccgacacacggttcagcgcggggccgatcagccgctcgcgcggcccccacacacggttctcgcgcagcaacgtcgccagcggcttgccggccgtcgtgccgcgcttgatccgcagcagcgtgcgcagttcctcgacgacggcccacatcaccagcacgatcgcctcgccctcgcccttcagcccgtcgatcatccgcgcaagccgcgcggcgtcgccggcgagcatcgcttcgttcagcttgaagacgtcgtaacgcgcgacgttcagcaccgcgtcgtgcacctgttcgaacgacagcgcgccctgcggatacagcagcccgagcttctggatttcctggtgcgcggcgagcaggttgccttcgacgcgctcggcgatgaactgcagcgcacgccgcccgtcctcgccgggcgcggcgcgctggccctgcatcgcgagacgctgaccgatccagttcggcagctgcgcgcggtcgaccggatcgatcttcagcgcgacgccaccgttctgcagcgcggtaaaccaggcggatttctgcgtggccgcgtcgaggcgcggcaacgtgacgagcatcagcgcgtcggggttgggcgtggccgcgagcgtcttcagtgcgtcggcgccttccttgccgggcttgcccgacggaatgcgcagctcgatcagctggcgctcgccgaacagcgacatcgcctgggtcgcgccgagcagcacgctccagtcgaaaccgcgctcgaccgtatgcaccgaacgctcggtgaagccggccgcacgcgcggccgcacgaatgcggtcgcacgcctcctgcgcgagcagcggctcgtcgccgtacacggtatagagcccggccacccccttcgcgaggtgcggctccagtgcatcaagtcgcaattgcatcggtgcgtatgccgtcgatcagagcggcggcggcggcaacggcgcgcgcggcgcgacacccggcaccacgtcttccggcgccggcgtcagcgagtggacgatcgcgagacgccgcatcagctggtcaaccgcgtcgttctgcatgtcgccgtacaggatgtcggcttcctgcgccttcgcgttcgtgtactggtcgctgtacgtcatcgcgcggttcagcgcgatcgcgctcggcgggatcagcacggtgccgtccttgctcgtgagcgtgtagctcagcgtatagaacagtgcgtattcctgcgccgagccgaacttgttgagcgtcagcgtattctgcccgcgcgactcccacatgcgcagcacggcgtcggcgtcgtccgccgacttgacgatcttcgtgtcgctgccggcctcgacgaggcgcacgaagcgcgcctcgaccggcgccggcgcgccgacgatcagcaggtgcttgaacgcgtagtcctgctggccgcgcaactggaagccgcatgccgacagcgcgaccgcgctgccgacggcgagcatcaaaaacgatctgcggatcaccttcgctccttctgggtacgtccgacgtccgacggccggcggccgtcagacgacgatgttcacgaggcggcccggcacgacgacgatcttcttcgccggcttgccgtcgctgaacttcgcgaacgcttcgtcggccaccgccgcagcttcgatcgcctcgcggctcgcgtccttcgcgaccttcagcgcgccgcgcaccttgccgttcacctgcagcacgagttcgatctcggcctgctcgagcgcggcctcgtcgaccttcggccacggtgcgtcgagcagcgggccgaattcgtccgcatagccgagcgccttccacagctcgaacgtgacgtgcggcacgaccgggtacagcacgcgcagcagcacgccgtacgtttcgcgcagcacgccgggcgtcgcgcccttcgcgccgtcgatcgcgttcagcatcttcatcgcggccgacacgaccgtgttgtactgcaggcgctggtaatcgaaatcggcctgcttcagcacgctgtagatttcgcggcgcagcgccttgtcggcttcgccgagcgcggccgcatcgaagcccgcgcgcgcggcgagcgcttcacggttcgtcgcaccgaagctccacacgcggcgcaggaagcggctcgcgccctcgacgcccgcacccgaccactcgagctgctgctcgggcggcgcggcgaacatcgtgaacaggcgcgcggtatcggcgccgtactggtcgatcagcacctgcggatcgacaccgttgttcttcgacttcgacatcttctcgatgccgccgagcacgaccggctggccgtccgaattcagcgtcgcgccgaccgggcggcccttgtcgtcgtgcgtgaccgtcacgtcggccgggttgtaccaggtcttcttgccggaagcgtcttcacggtagaacgtctcgttcagcaccatcccctgcgtgagcaggttcttcgccggctcgccgaacttcacgaggccgaggtcgcgcatcaccttggtccagaagcgcgaatacagcaggtgcaggatcgcgtgctcgatgccgccgatgtattgatccatcggcatccagtaatcggtgcgcgcgtcgaccatcgtctcggcgtccggcgccgtgtagcgcgaagtaccacgacgaatcgacgaaggtgtccatcgtgtcggtttcgcgcttcgcggccgcgccgcacttcgggcacgaacagttcaggaacgcttccgacttcgcgagcgggttgcccgagccgtccggcacgaggtcttccggcagcacgacgggcaggtcctgctcgggcaccggcacatcgccgcacgacgggcagtggatgatcgggatcggcgtgccccagtagcgctggcgagatacgccccagtcgcgcaggcgccacgtgacctgcttgtcgccgaaaccgccggcgttcaggtcggccgcgaccgcgtcgacggcttccgtgtagcgcaggccgtcgtacttgccgctgttcacgcagaccgcggtttccttgtcgccgtaccactcctgccatgcgtcgagcgagtactgctggccttcggccgagatcacctgcctgatcggcaggtcgtatttcttcgcgaacgcgaaatcgcgctcgtcgtggcccggcacgcccatcaccgcgccttcgccatagctcatcagcacgtagttgccgatccacacctcgaccggctcgccggtcagcgggtgcgtgaccgagaagcccgtcgcgacgcccttcttctccatcgtcgcgacgtcggcctcggcgacaccgccgcgcttgcattcgtcgatgaacgcgagcagctcgggcttgtcctgcgcgaggcgcgtggccagcggatgctcggccgcgatcgcgcagaacgtgacgcccatgatggtatcggcgcgcgtcgtgaacacgcgcagcagcttcttctcgccgtcgagttcgtacgggaagccgaagttcacgccgaagctcttgccgatccagttctgctgcatgatcttcacgcgctcgggccagccgaggccgtcgaggtcgttcagcagctcatccgcgtactgcgtgatgcgcaggtagtacatcgggatctcgcgcttctcgacgagcgcgcccgagcgccagccgcggccgtcgatcacctgctcgttcgcgagcacggtctggtcgaccgggtcccagttcacggtgcccgtcttcttgtacgcgatgcccttctcgagcatcttcaggaacagccactggttccacttgtagtagtccggcttgcacgtcgcgatctcgcgcgaccagtcgatcgcgaggcccatcgactgcatctggcccttcatgtagtcgatgttgtcgtaggtccacttcgcgggcggcacgccgttcgccatcgcggcgttctcggccggcatcccgaacgcatcccagcccatcggcatcagcgtgttgtagccgttcatccgcagatagcggtacatcacgtcgttgatcgtgtagttgcgcacgtgacccatgtgcagcttgccggacgggtacggcagcatcgatacgcagtagaacttcggcttctgcgaatcttcctgcgtcttgtaggcatcggctgcgcgccagtcgccctgggcggcggcttcgacgtcggcgggtacgtatctctcgtgcatggtgtggttcggactaggctttaagcggcgcgacggcgcgcgcaggagtggatcgaaaatcgtgcttgcccggcggaccggcaggttcgctgttgccggacctgttcacggtttccgggaattttccgggcaacccgcagcatgcccgggtagcctggaaaattccgggttacctgaaaagagcctgccaaccgggaaaaacgttgattataccgcccgcgccggcccattcgaccggtcttgcggcgggcggcccgatcccgcgccagggacgggcccgccggatccgctcagcggttggccggcacggcaggcgccgccgcggaaccgcccgcctgcggcggcacgtcggtcacgaagccgatccgcgtcaggccgacggcctgcgcggcgcccatcacctgcgcgatcacgtcgtagcgggtcgcgcgcgacgctcgcagcctcagctcgggcggcgcgccgcgcgcggcggcccggaagcgcgcgggcagcgcgtcgagcgccaccggcgtgtcgtcccagtacagcttgcccgcgtcgtcgatcgacaaggtgacggattgcggcgtgtcgcgcgcgacgctggccgcgaccttcggcaggtcgagccggatcgcgtgcgtcatcagcggcgcggtgatgatgaaaatgacgagcagcaccagcatcacgtcgatcagcggcgtcatgttgatctccgccatcggcgcggacgtcttgtggtgctcgagtccgccgaatgccatggtcgctcctccggaatgggcgcgtcaggcttcctgcgcgcagacgaacacgtgcaggtcgcgcgcgaaaccgtcgagttcctcggcgagctgccgcacgagccgcccgaggatgttgtaggccagtaccgcgggaatcgcgaccacgagcccgaacgcggtcatgatcagcgcctcgccgaccggccccgcgacgctctcgatctgcgcctgcccgctcgcggcgatgctgccgagcgcgtgatagatgccccacacggtgccgagcagcccgacgaacggcgcggtgctgccgatcgacgcgagcagcacctggccgaattcgaggcgccgctgcgagcgcagcatcgcgtgccgcaacgcacgcagcacgcgttcgccgcgctcgacgcgcgcggccagcgcggccgggtcgtgatcgtcggccgcatcgcgcgcggcttcggcgagcggcacgaacacgcgctcgcgatcggcgccggcgagcgcggttatgcccgcgtcgagcgacggcgcgcgccagaacgcggcgagcgcgcgcggcccctgccgcttcgcgcggaccagcagccaggctttcatgaggaggaagcaccagctggcgacggacatcgccagcagcacataggcgacggcatgcgtgatcgcatcgccgctttcgaggtagtggacaacgccggtgggtatcgccatcggagtttccccgtggggtcagcgcaggccgagcacgtcctgcatgtcgaacaggccggcgccgcgcgccgacaggaagcggaccgcgcgcagcgcgccctgcgcatacgacacgcggctcgacgacttgtgcgtgatctcgatgcgctcgccgatcccggcgaacagcacggtgtgatcgccgacgatgtcgccgccgcgcaccgccgcgaagccgatcgacgacggatcgcgttcgcccgtcacgccgtggcggccgtacaccgcgcaatcgtcgagcgagcgcccgagcgcgccggcgaccgcttcgcccatcatcagcgcggtgcccgacggcgcgtcgaccttgtggcggtgatgcgcctcgatgatctcgatgtcgtagccgtgcgagaagtgcttcgccgcgaattcgagcagcttcagcgtgacgttcacgccgacactcatgttcgccgcgaacacgatgccgatattgcccgccgcggcctgcagcccggccttctgctcggcggtgaagccggtcgtgccgatcacgagcttcacgtcgtggcgcagcgcggcctcgatatgggccatcgtgccttccggacgcgtgaagtcgatcaggtagtcggcctgcgcgaacacggcgtcgagatcggcggtcagcctgaccccggtttccttgccgaggaacgcgccggcgtcctggccgaggaacggcgaatcggcgcggtcgagcgcgccgacgagctgcgcgtcggaatcgttgagaacggcttcgatcagcatccggcccatacggcccgatgcgccggcaatcgcaatcttcatggctttctacacgacaggtctaaaggcgggcggcgcatgccgcctgtttccgcgcgggcttattgcgccggcgcggtgagcggctggttctgcagcgtgtcggagccttgcgggccgaccggcggcgacgcctcgttcgacgcgttcggcggcggcggacgatggaactggaactgcggctggatcgccggaaccgcgcccggggctggccgcccggcaccggcgcaccgccggcagcctgcgtggacggcgtgaaccgccgcgcggccgtgccctggcccgacacctggttggtcgcgcggttcgccgcgcgggcggcctgcgcgttcgcatcctggtcgaccaccgcgccggacgccggcacggtggacgggctcgcgacggtctccggcgccggcgcgctcgccgcctgtgcggcgctcgcggcggcggcagcctcggcggccttcttcgccgctgcggccgccttcgccttcttgccgccacggtcgccgtcgatgtcggccagcaggtcgagttccgaaggcaggttgtccgcccccgtccagcccgcgacgcgatcgcccgagaacgtcacgacgagatcacgctgctggacgaccgccgtcgagccgcgcttgaagtagaagaggtaatcccagcggtcggcgtggaacatgtccgccagcagcggggtgccgagcagcgcgcgtacctgctcgcgcgacatgccgacctgcagctgcgaggctttctcctgcgacacgaagttgccttgcacgacggtgatccggtaggggtgatgctctgcgcgatgcgctgcgtcacgctgtcgtacgacgaacaaccagccagcgcggcaacgacggcggcagcgatgatgacactccgcatgcggctcctctgaaagtgcgaaagagattctggaatcatttccctcaccgtgcaggcccgcgtcgcaggccgcgcgtgtttctggaacggcgaaaagccggtaacattgaagccctgcattgtactctagggatgcctagccatgaccaatccgacggatctcaagaatatcgggctaaaggccaccctaccgcgcctcaagattctcgaaatcttccagcaaagcccggtgcgccacctgaccgcagaagacgtctaccggaacctgctcaacgagcagctcgacatcgggcttgccaccgtctaccgcgtgctgacgcagttcgagcaggccggcctgctgtcgcgcagcaacttcgaatccggcaaggccgtgttcgaactgaacgaaggctcgcaccacgaccacctcgtgtgcctcgattgcggccgggtcgaggaattcttcgacgccgagatcgaaagccgccagcaggcgatcgcgaaggagcgcggcttccggctccaggagcactcgctcgcgatgtacggttcctgcacgaccgagaactgcccgcaccgcaagcactgaaatccagccgcgcgcgcgcatgcaggacggcccggacggcgattcgcattccgggccgtcttctttcgggatacgcaggaggcgcccgcccaggctttcgcacacccttcgcgttgcctgcccgggcggctccgggtgacatcaggccgccggaggagccggcctgcctgccttcgtcatgccgcgcccgcgcgggccggttcgaactccagcgcccatgcgcgctcgagcgggatttcgtcgcagttcggctgcgggccgccgcgatcgacgatcacgaaatcgctgaccgcatccagcgcgagcagcggatggtgccagacgcccttcgcatagttcacgccctgccagccttccgcgaggaacgcgcgcatcgcgtcgggccggaactcgccggccggcgcgacgacgatcgcgtaacgcgacaccgccgcgagcgggatgaacgcctggctgccatgcggatggcgctccatcagcgtgaccgcaaccggcagcgcacgcggctgcgcgcggaacacgctgacgagcgggcggccgccgtccgcgcacacgtcgatcgtcgcgagatcgtggaagcgctcggtcgtgccgccgttgatcggaaaatggcgcgcgccttcgagcgcgatcacgtcgccgaacggcgcgaacgcttcgcgggtcaggcgctcgacgcgcaggatgcgggatccgctcatgccgttgccctccttcaagccggctcgccccacagacgcaggcgcgacacgccgccgtccgggaagatgttgaaacgcacgtgcgtgacggggccgagcgccgcaagctggtcgaacgtgtggacgtggtccatcgacagcttctgctcgccgagcagttcggcccagaacatcgcctgcgtgacgagcgagtcgtcggtgccgcccgccaccctcgcggcctgcagcgagcagcggtcggggaaattgcccttgaagaacgcggtatcgacctcgacgcgccggatgatgcccggccgcgcgagcgcgacgatcgcccagtcgttgccgggctcgcggcggcgccgcgtttcccagccgtcgcccatgttcgcgccgcgcccggcatcagcatctgcgatgccgggccgaagtgctggttgttcgcggccaccaggtagccgccgttctcgatcgccgcgagatcgacgagttcgccggccggcacctggcgccagtcgcgctgcggctggccgtacacgcgcagccgcgcgaggccgccgtccgggtacaggttcacgcgcaggtgcgtataaggctgcgcatcgtcgacgctcacgtagcgatgcgaattgccctgcagcgtcgtcgccgggacgatcgtgcgccactcggcgttgtcggacggcgtgtcgccttccgcgacgcacgcgtcgatcgacgcggccggcgggaagttgccggtgaaatggctcgtgtcgaggtcgacgccgtgaatcacgcccggccgcgcgagccgcaccacgcagaagtcgtggccggtcgtgcgcttgcggcgcgtttcccagccgtccatccacttgccgtggtcgtcgtacttgccggggatgaacacggccggctcgggattcagcatgcgctccttcggcgcgaagaactcgtcgctggcaaagagcgcctgcgccccgaggcgcgggtcggcgaggttcatgtaacgccgcgtaaacgccggcgcatccggatcgaggatggggctgccatgtcgtctcctgtagtttgatgaagggccggcgcatcgaggcgccggccacatgaatgccaggtgcgcggggcggcccggggcaaggccgcccgcgcggggtcgcgctcagagcgcgtgagcctgatcgccggcgaccggcgccgtgcggtcttcctcttcggccggcacgtagcgcagctcgcggttcagcacgcgcttcgcgcgggcccggtcgatgtcgttctcccacaccgcgacgaccaccgtcgcgacgcagttgccgatcaggttggtcagcgcacgggcgatgccgacgaaccagtcgaccggcaggatcagcacgaggccgagcacgggaatcgcggggatcgccgacagcgtcgccgcgaggatcacgatcgccgagcccgggatcccgtgcgcgcccttcgacgtgacgagcgacacgagcagcacgacgatcaggtcgtgcgtcgacagcggcgtgttggtggcctgcgcgatgaacagcacggcgagcgtcaggtagatcgagaagccgtcgaggttgaacgaatagccggtcgggatcacgaggccgaccgtcgaatccttcacgcccatgtattcgagcttgcgcatcacctgcggcagcaccgcgtccgacgacgccgtgccgagcacgatcgacagttcctcgcgcaggtagcggatcagcttgaacaccgagaagcccgcgagccgcatcaccacgccgagcacgaccgtgacgaacacgaagcagctcaggtagaacaccgcgaccaggtagccgagctgcttgagcgacgcgacgccgtacttgccggtcgtgaacgcgatcgcgccgagcacgccgagcggcgcgagcttgatgatgaagccgatgatccggaagaacacgtgcgacagctcctcgatcagcgagttgacgcgttgcgccttgtcgccgagcagcgacagcgcggaaccgaacagcaccgcgaacacgaggatctgcaggatgtcgcccttcgcgaacgcgtcgatcgcggtctcggggatgatcttcatcaggtagccggccgtgtccttcaggctctcggcgttcttcgcgtacgacgcgagcgacgacgcgtcgagcgagcgcaagtcaatgttcatcccgacgcccgggcgcgtgacccacgcgagcacgaggccgatgccgagcgcgagcgtcgtcatcacctcgaagtagatgacggccttcaggccgacccggccgaccttcttcaggtcgcccgcgttcgccatcccgctgaccacgacgcagaacacgatcggcccgatcaccatcttgatgagcttcaggaagccgtcgccgagcggtcgcagcgactcggcgaaatgcgggaagaacgcgcctagcgcgatccccaggatcaatgcgacgactacccggccaaacagcgaattgaggaatttcgacacggcgctctcccgatccaacggttgcagtttcgtctgttcatactggtaagaccagtgatgttatggtcgatagtaggaagccgatatagtggcgtcaaggacggacaaaatagggatttcccgcccctcccacccgcctgacacgcaccggacaggggcagatcgtggctttcccgtagggcgtccatgcaccgcctgcgtgcggattacaatgccggtcagaccggccaaagttcacctcatgaaaaacgttccgcataccgtgaccgacgccgccatcgcgacgatccgcgaccggatcgaggcaggcgtgtatccggtcggcagcctgctgccggcccagcgccagctctccgaggagctggagatcagccgcgcgtcgctgcgcgaggcgctgtcgacgctcgaggcgctcgggatgctgcgcatccgcgcgggcaagggcgtgtatgtcgaaagcgcgcaggccacggccgcccatgcgtggcggttcgccgagcagtcgtcgccgcccgatacctaccagatgcgctacgcgctcgaaggattcgccgcgcgaatggccgcgcacgtcgtcaccgacgacgacatcgcgtggttcgaggacaatctcgccgacctgcacgtcgcgctcaccgaaagcgagctcgacgcggcatcgcagctcgacttcgacttccacatgcggatcatccatctcgcgggcaacgcggcgatcgaatcgatcctgcgcagcagcgccgacatcatgaaggaaagccagcgcatgccgttctaccggcgcgagctgctgctgtcgacgtggaccgagcaccgcgcgatcgtcgacgcgctgatcgcccgcgatgcggccgccgcgggcaccgcgatcgaaacgcacatcgcgaacgccgcgcagcgcgcgggcatcttcttcccgacaccgcgcacctgacggcccgggcggccacgcgccgcgcgcgccgccccgtcgtaccggtcaacctcccgacggatcccgatacgcgagcgcacgctcgatgaacgcgcgcgccgcgacgctgcggtacgcgcccttgcgtgtcagcagcgcagccgtgcgcgcgggcagcggcggatcgatctccagcgcgcacaggtcggcactctcgcgcgcgaccgcgtcgggcagcaccgtcgcgagccggccgcaccgcacgagctccagcaccgcgctgaccgtattcgtctcgatcgcgatcttcggcctcgcgccgtgctcgatgaaatagcggtcgatgctctcgcgcgtcgcgaacgcgcggctcagcagcaccagcggctcgccgccgagctcggccggcgtcagcgcgcggcgccgccgcgcaagacggtgcgtgcggcccgtcacgagcgcgagcggctcgtcccacagcggcagtgcgtcgacgtccggcgcgcgcggggcatgaaagcgaagcccgcgtcgagccggtcgtcggcgagcagcgcctcgatgcgttcctgcggcatcgcgtcgatcgtcagcgtgacgttcggatagtcggcatggaacgcgtcgatcagcgagccgctcaggtaggccgcgaaggtcggcatcatcgcgagccgcaatgacccgccgccgaggccggcgacgtcgtgcagcgcgcgctgccccgtatcgagttcgtgcagcgcggcgcgcgcgtggcgcgcatagacctcgccgaactcggtgagctgcaccgtgcggcccgagcggtcgaacagctgcacgccgagcgtttcctcgagctggcggacctgctgcgacagcgtcggctgcgacacgtgcagcgcgtcggccgcgcgcgtgaaactgcgctgctcggcgacggccaggaaatagcggatgtggcggagtagcatggcggccgacgtattggttttaccaatgaagagcataacgatccagtcttggacgctatggttcgattcccgcatcatacgcacatccgttccggcgcatcgcacctgctttgcgcatcggaacggcccgcccgggcccgcctgcctgcgcccgccgcacgacgatccgccgcccgcccgatccgggcccggccgcgatccgcccggcgcgcatcggttcaccgccgatccgttgatgccggccccgatttccgtcaccccgcgcagccgacagcccccgtgccgccggccggcgccgctgtttttcgcgaccatggaaccgcatcaagacaaccatcctccctgacccgcggcatgacgctgctgttcgcgtgcgcgtgcggcatcgtcatcggcaacatctattacgcgcagccgctgctcgccgcgatcgcgcacagcttcggccgcgcgccgaccgaactcggctatctcgtcacgctgacgcagctcgggtatgcggcgagcctgctgctgatcgtcccgctcggcgacgcggtcaaccgtcacacgctgatcgtgcgactgctgatgctcaacgtcgtcgcgctggccgcggtcacgttcagcacgaacttcacgatgttcgtcgtcgcgaacgtcgcggtcggcttcgtcacctgttcgacgcagctgctggtgccgttcgcggcgtcgctcgccgacgcgcgctcgcgcggccgcgcggtcggcaccgtgatgagcgggctgctgctcggcatcctgctcgcgcgcgtcgcggccggggcgatcgccgacgggttcggctggcgggccgtgtacggcatcgcctcggtgatggtgctcgcgctgacggccgtgctcgccgtgaagctgccgaaggatcgccgcgacgcgcgcctcgactatgcggcgctgatgaagtcgctcgtcgcgctggtgcgcgcgcaaccgctgatcgcgctgcgctccgcctacggcgcgctcgtgtttgcgtgcttcagcctgctgtggacgggcctcacgttcctgctgagccagccgccgtacagctattccgaagggcagatcggtctgttcggcgtcgtcggcgcggtgggcgcgctcgcggcgacgtcggccggccggctggtcgatcgcggacacggcaatgccgcgacgggcttgttcgcggcggccgtgctcgcgtcgttcgcgctgatcgcgaccggcgcgcactcgctggcggcgctgatcgcgggcatcctgctgctcgacgtcggcgtgcagggcgtccacatctcgaaccagagcgtgatctatgcgctggccggcaacgcgcgcagccgcgtgacgacgatctacctgacgagctacttcatcggcggcgcgctcgggtcgttcgcggcgagcgtcgcgtacggcatcgacggctggcgcggcgtgtgcatcgcgggcgcggcgctcgcgggcgtgctggtcgtgtcgtggctcgcgtcgcagcgcgccggcgcgcggcaggtcacgcagtaattcagcggggcgttttctcgtcaccatgaaagggcacgccccgcgaagcgcgggcgtgccctttcacgatcgcgtcgagacagtcgcgcgccagtgcgtgaccgtcacgcagcctcgtcgacgaaatcgatcagcaccttcatcgcacgctgccggtcgccggccagttcgaacgcgaggttcgcgtcgcgcatcgggaacacccgcgtgacggccggccgcaggtcgacgcgccccgcattgatgagctgcaccgcgagcgcgaattccgcgtgaaagcggaacgaaccgcagatcgacagctccttcgcaaccacgacgttctgcggcaggctgacgtcgccgccgaggccgagctgcacgacaaccccgcgcggacgcatcacgtccagcccgtcgcgcagcgcgcgcattgcccgaacactcgatcatcacgtcgaacgtgcccttgtcggcgctgtagcgctcgacccatccggcgtcggccgccgcgttgatcgtgcggtcggcgccgagcgcgctcgccacttccagcggcgcctcgacgacgtcggtcgcgacgatctccgccgcgccgtgcacgcgcgccgccgcgaccgcgagcacgccgatcggcccgcagcccgacacgagcacgcgcttgccgatcagcgagcccgcgcgcgacaccgcatgcagcccgaccgcgaacggttcggcgagcgccgcgagcgacatcggcacgtgatcggcaaccttcacgcactgcaccgcgtcgcacacgagcgcgttgcggaatgcgccctgcacgtgcggcatccgcatcgcgctgccgtagaagcgcatgtcgaggcactggttcggcagcccttcgaggcagtagcggcacgccccgcacggccggctcggattgaccgcgacgcgatcgccgaccttcaccgacgtcacgtccggcgcgacttccgcgaccgtgccggcgacctcgtggccgagcaccatcggctgctgcagccggatcgcaccgaagccgccgtgccggaagtaatggagatcggagccgcagatgccgcccatcgcgacctcgacgcgcacctgacccgggccgatctcgcccgcgtcctgctcttccacccgcaggtcgttcggcccgtggatcacgacacacatgcaacgcatacgcatgacagcctcctcagacgaccggcgtgaccagcggcgcgccggcgaagtgcgcggcaaggttgtcgcgcaccagccagcccatcgcctggcgcgtctcgatcgtgccgctcgcatggtgcggctgcagcagcacgttcggcaacgcgaggaaacgcgggtcgatgcgcggctcgttccagaacacgtcgagcgccgcaccggcgatcgcaccgcgctcgagcgcgtcgagcagcgcgggttcgtcgacggtcgtgccgcgcgacacgttcaccagatagccttgcggcccgagtgcgtcgagcacggcggcgccgacgaggtgacgcgtcgccggcccgcccgcgagcgtgacgatcagcaggtcgcaccagccggccagctcggcgaggtcgccgaagaagcagtgcgggctgtccgcgcgcggcgcgacgtcgaagtagccgagctcgacgtcgaagcccgacagccggcgcgcgatcgtcgagccgatccggccgaagccgaccacgccgacgcgcttgccgtacagccgcgtgacgagcggcatgtcgccgtcgcgccaggcaccggaacgcacgtacgcgtcgccggcgccgatgcggcgcatcatcgcgagcgcgagcccgacgccgaggtcggccacgtcgccggtcagcacgtcgggcgtgttcgtcacgcggatgccgcgctcgcgcgcggcggccaggtcgatcgcatcggtaccgacgccgtagcacgcgatgatctcgagcttcggcagcgcggcgatcagcgcggcattcgcgccgagatcgccgcgtgtcgcgatcgcgcgcacgccggcgccgtgctcggcgaggaacgccgcgcggtcggcggcttcccacagccggtggacgtcatagcctgccgacagccatgcgtcgtcccacggctggtaagggcccgtcatcagcagttcgggccgctgggtcgattcgtgcgccatctgcgcttgctcctgtcgaggtaagttgaatgcaaaggcaggccgggccgcgtcagccgcccggcccgttcatgcgtgccgcgcgagcgcatcggtgcccggggcctgcgccacctgtgccgcgtcgagcggatcgtcgagatcgcggttcagcgtttcgggcatccgcgacgtcgtgaacagcgtgatcagcgtcagcagcaccaggtacgcggcgatcggcacccaggcgcgcacgccggccgcgtgatcgccgccgtgcagcgcgatcacggtcgcgatgatcgtcgcgccgacgagcggcgcaatcccgcccgcgagcacggccgacacttcgcgcgagaacgacacgcccatgtagcgatggcgcgcgccgaacagttcgggcagcagcgcggcctgcgcgccgagcatccccagttcgcgaagccctgcgcgaccgagatcgcgatcacgctggcgaccacgttcccctggctgaagatccaccacaccgggaacgcgagcgcgagctgcagccacgcgaacgtgcgatacacgcgcacgcggccgaagcggtcgctgagccggcccgccagcggcaccgtacacgcgccgacggtcgccgcgcacaccagcgcgagcgcgccgatcggccccttcatgccgatcacgcccgcgagatagctgacggcgagtgcctggtagatcgacgagccgccgttctcggccatccgcaggccgatgccgatcagcagcgagcgcttcgaatgctgcacggcgctcttcagcggattcgccgatacctgcgcacgcttctcgagccgcacgaaggtcggcgactcgtgcagccgcacgcgcatgtagatcccgaccgcgacgatcaccgcgctgaacaggaacggcacgcgccagccccagccgtcggtgacgcggtcgaggttcgcgagcagcaggaaatagaccgcggccgccagcaccgtgccgagctggatgcccaggaacggcagcgacgcatagaagccgcgcttgccgggcggcgcgtattcggtcatcagcaccgcggcgccggcctgctcggctccggcaccgaggccctgcaggatacgcagcagcacgagcagcccggggcccagtagcccgccgtttcgaaggtcggcagcacgccgatcagcgtgctcgcgacgcccatcagcagcaccgtcgccgtcagcacgaacttgcggccgatccggtcgccgagcacgccgaacacgaccccgccgagcgggcgcaccgcaaacccgacgaagtaggtgccgaagctcgcgatcagccgcatctcggcggtctgcgcgggaaagaacagcggcccgaaaaccagcgccgatgcgagcgtgtacaacgcgaaatcgtagtattcgagcgcgctgccgagcgagcaggtccatgccgcgcggttgagctgcttcgtgtcgacgccgcggcgctcgacggtctcgcccggcgcaccggaccctgcatcgtgccgcgcgggcggcggggaaatgcgatccatcgttgtctcctgtctcctgccttccgttccggaacccggcgcgtaccgcgaccgggacatcggcccgctcgtgcggcgggctcttctgggaattcggatgccggccgcggccggcgcaacggcgctgcgcgcatggcgcgctcgcgccgccgctcagacggcgctggtcaggccgccgtcgacgaacagcgtctggccgttcacgaaatcggacgcggccgatgcgaggaagatcgccgccccgcacagctcgtcgacgcgcccccagcggccggccggcgtgcgcttgcacagccagtccgagaacgcggcgtcgtcgaccagcgcgcggttgagttcggtttcgaaatagccgggcgcgaggccgttcgcctggatgccgtggcgcgcccagtcggcgcacatccctttggtcagcatccgcaccgcgcccttggtcgcggcatacggcgcgatcgtcggccgcgcgagctcgctctgcaccgagcagatgttgatgatcttcccgcggccgcgcgcgatcatgtgccgcgccaccgcctgcgcgacgttgaacacgccgtcgaggttcacgcgcatcaatgcctgccagtcgtcgggttcgaatgcgtcgagcggcgcgcggcgctggatgccggcgttgttcacgaggatgtcgatcgcgccgacgcgcgcctcgaaatcgtcgatcgccgcacgcacctgcgcatgctcggcgacgtcgaataccgcgtagtcggccgtgaagccttcctcgcgcaggtgccgcacgagcgtcgcggccttctcctcattgcgatcgttgatgacgatcgccgcgccggcttcggccagcccgcgggcgagcgtcagcccgatcccgcgtccggaaccggtaatcaatgcgcggcggccgtcgaggcggaaccgttcgagcgcgtgggtcatgcgtgtctcctcgtgccagtcgagccggcggcccatcgcggccggtctcgtgttgacggtatcttcggccgccggccgggcaccgcgccaatggtctttttgatccggttatcatgaaatctgattaccgcccacgcctgcccgccgcccatggaactcaagcaattgcgcgccttcgtcacgctcgcggaagaactgcatttcgggcgcgccgcgcagcgcctgttcatcgtgcagcccgcgctgagcatgcagatcaaggcgctcgaggaagaactcggcgcacgcctgttcgagcgcgaccgccacaaggtcgaactgagcgataccgggcgcgtgttcctgcccgaggcgcgtgccacgctgcagcaggccgcgcgcgcggaacagatggcgcggctgtcgagccgcggcgagatcggcacgctgcggatcgcgttcgtgtcgtcggtgctgcccgcgctgctgccggccgtgctgcgcacgatgcgcgagcgttatccgctgatcacgctcgaactgaaggacatgccgacgcccgaccaggtcgccgcgctgcgcgaccggcggatcgatttcgggatgatccggttgccggccgcgtatgcgggcatcgacacgcgcgtggtgctcgaggaaggcttcgtcgtcgcgctgccgctcgaccatccgctcgccgcgcacgacgccatcccgccggccgcgctgcgcggccagcccgcgttcgtgctcgcgcgccgctacgcgccgggctttcacgacgacatgctgctcgcgctgagccgcgcgggcacgacgctcgagatcgcgcaggagttcgggagttcacgacgatgctcgcgctcgtcgcggcggggatgggaatcgggctgatgccggcggaggctgccagcgcgctgccgccgaacgtgctcgcgcggccgctcgacctggccgggcaccgcaccggaatcggcctcgcgtggaccgatctcgacagcccgctgaagcgcgcgttcgtcgacgcgctcgaacacgtgacggcgaacgccgggcaataaaaacccggccggaaaaccgggccgggctcgttcgccacgccggccgccttgcggcggccgcgcaacgtgcgggattacttcgcgttcgcgaatgcgacagccgtatccagcatgcggttcgagaaaccccactcgttgtcgtaccagctcgacaccttcacgaggcggcccgacaccttggtcagcgttgcgtcgaacgtcgacgaagccgggttgtggttgaagtcgatcgacaccagcggtgcgtcgttgtagccgaggatgcccttcagcgcgccttccgatgcttccttcatgatcgcgttgacttcctcgaccgtcgtgtcgcgcttcgcgatgaacgacaggtcgacgatcgacacgttgatcgtcgggacgcggatcgcgtaaccgtcgagcttgccgttcagttccggcagcacgaggccgacggccgaagcggcgcccgtcttcgtcgggatctggctgtgggtagccgaacgcgcgcggcgcaggtcttcgtgatagacgtccgtcagcacctggtcgttggtgtaagcgtggatcgtcgtcatcaggccggtttcgaggccgatcttgtcgttcagcggcttgacgagcggcgcgaggcagttcgtcgtgcacgatgcgttcgagatgacggtgtgctcggccttcagcacgtcgtggttcacgccgtagacgatcgtcgcgtcgacgtccttgccgcccggtgccgagatgatgaccttcttcgcgccgcccttcaggtgcgcgctcgcctttccttcgtcgtgaagaagcccgtgcattccatcacgacgtcgacgcccagctcgccccacggcagttctgccgggttgcggttcgccagcacgcggatcttgtcgccgttcacgacgaggtaatcgccgtcgaccgacacttcgcccgggaacttgccgtgcgcggtgtcgtactgggtcaggtgcgcgttggtcttcgcatcgcccaggtcgttgatcgcgacgatctcgagatcgtgcttcttgccgttttcatagaacgcgcgcagcgtgttgcggccgatacggccgtagccgttgattgcgacgcgaatcgtcatggtctatctcctgatggctgaaaaattcgtttcgtgcagcttcacgtgcgacgcgcgcggggcagcgcgcgtcgcgtatgtctttaggccagcacggccttggcggtctcgacgacgtgctcgacggtgaagccgaagtacttgaacagtacgccggccggtgccgattcgccgaacgtgtcgatcccgacgacgccgccttcgaggccgacgtacttgtgccagaacgcggtcacgcccgcttcgatcgcgacacgacgcacgccgtgcggcagcacgcgttcacggtattcggcgtcctggcggtcgaacacgttggtcgacggcatcgacacgacgcgtgccgcgatgccttgctgcgcgagcggctcgacggccttcatcgcgagttcgacttccgagcccgtcgcgatcaggatgatcttgcgcgcgacgatctcttcgtcccagtccttcagcacgtagccgcccttgtcgatgttcgcgatctgcgcatctgtacgcgggttgaatgccaggttctggcggctgaagatcaggctcgacggacggtcggcggcgaccgcgtgggtccacgcgacggccgtctcgaccgtgtcggccggacgccacacgtcgtggttcgggatcaggcgcaggctcgacacgtgctcgatcgactggtgcgtcgggccgtcttcgccgaggccgatcgaatcgtgcgtgaacacgaagatcgacggcaccttcatcagcgcggccacgcgcagcgcgttgcggctgtagtcggagaacgtcaggaacgtgccgccgaacggcttgtggccgccgtgcagcgcgaggccgttgatcgcggcgctcatgccgaattcgcgcacgccgtagttgatgtggttgcccagcacgacgcccgggccttccggattcgcgcggacggccttcgacgccttccagttggtcaggttcgagccggtcaggtcggccgagccgccgagcagctccggcagcgcggcagccagcccttcgatcgcctgctgcgacgccttgcgggtcgcaaccgtctcggcgcgctcgttcgcgccggcgatgatcgccgcggccttttcagcccagtcggccggcagcttgttggccatccggcgctcgaattcggcggcttctgccgggaacttcgcgcgataggcggcgaacgtcgcgtcccattcggtttccgcgcgcttgcccgcttccttcgcatcccatgccgcgtagacttcctgcgggatcacgaacggctcccacttccagccgagcgcttcgcgcgtcttcgcgatttcttccgcgccgagcgccgcgccgtgcacgtcgtggccgccggccttggtcgccgcgccctggccgatcaccgtcttgcagcagatcagcgtcggcttgtccgacagcttcgccttcgcgatggccgcgtcgaccgcgtcgacgtcatggccgttcacgttcgggatcacgttccagccgtaggcttcgaagcgcttcggggtgtcgtcgtggaaccagttcacgacgtcgccgtcgatcgagatgccgttgtcgtcgtacagcgcgatcagcttgttcagcttcagcgtgccggcgagcgagcaggcttcgtgcgagatgccttccatcaagcagccgtcgccgaggaacacgtacgtgtggtgatcgacgatcttcgcgccgtcacggttgaactcgtcggccatcagcgcttcgccgagcgccatgccgaccgcgttcgcgagaccctggccgagcgggccggtggtcgtctcgacgcccggcgtgatgccgtattccgggtggcccggcgtcttcgagtgcagctggcggaagttcttcagctcttccatcggcaggtcgtagccggtcaggtgcagcagcgagtacagcagcatcgagccatggccgttcgacagcacgaagcggtcgcggtccgcccagtgcgggttcgtcgggttgtgcttcaggtggcgcgaccagagcgcgacgccgatttcggccatgcccatcggcatgccggggtggccggagttcgcttgctggacggcgtccatcgcgagcgcgcggatcgcgttggccatcagggtggtggaggcgggagacgaagtcgtcatgtcgagtccggagaacgagtcgaggaaacggggcacggcggcatccggaagctcgggcgtcgatcgttcccggcgcgcggtgcggcgcctgacggacgcgaagcggacggagcctacggacgaggctgcaaagctcgtcattttaacagatggcctgacatttcccttgtcggcgcgtagtgttccggcacggttttccgtcaaaccgcccgcctcctataattcagacgtcggaactccctgccctggcggcccgcccgtgagcacgacccttctctttcatcccacgcccgacgccgcgtacggcttcccgaacgcccgtcggctcgcgcacgtcgcgtcgccgcaccagcagattgaagtctgggaaacgccgcagctcggccgcctgtttacgctcgacggccggccgatgacgtcggtcggcgacgaatacgtgtatcacgagtgcatgacgcacccggccgcgctcgcgcatccgtgcccgaggaaggcgctcgtgctcggcggcggcgacggcggcgcggcgcgccagttgctcaagcacgcatgcatcgagcggatcgtcgtcgcggagctcgacgacgaggtggtcggcatggcgcgtcgttatctcgacgacgtacaccagggcgcgctcgacgatccgcgcgtcgaggtcgtgatcggcgacgccgcgcatttcgtcacgtcgaccgtcgagcacttcgatctcgtcgtgttcgacctcacgccgcccgattcgccggcggccggcctctatacgcgcgagttctacgcgcgactcaagcggatcctcacgccgtgcggcgcgatctcgatgcacctcggctcgccgctgttccacacggcgcgcatcgccgcgctgctcgacgacctgcgcgcgagcttctcggtcgtcgatccgttgtccgcgcacgtgccgctgtacggctcgcagtggctgatggcgatcgcgagcgacacgctcgacgcggccgcgctgttcgcgcacgacgtcgacgagcggctcgccgcccgccgcgtccagggtttgcgctactacgacgcccggctgcatgcgtccctctttgccctgccgcgcgctgcgcgatacactgggcgttcgccgctgagcgtcggcgcggcgcctcgctccgctttcccgtcgtgtcttcgcaaaatgcgtgacgtgcggcacggggcgaatcgccccggacgccgcgccgcccctgaacgaacgccgaagcatggaatcagcgcaagcgccgaagcgcccacacaggagattttcatgaccgatccacgtccggccaacgtgccttggttgacaccctacctggccgtacgcaacgcgcgcgcggccatcgatttcttcaaggccgcattcggcttcgagctgcgcgacgtgcacgacgaggacggcgcgatcatgcacgtcgagatggcctaccgcggccagctgatcgtgatgttcgcgcccgagggtgcgttcggctcgaccgcactcacgccgaagagcgcgaacgccaccgcgccgcagtcgttctacctgtatgtcgacgacgtcgacgccacctggcagcgggcgctcgacgcgggcgcgaaatcgctgagcccgccgcaggatcagttctggggcgaccggttcgcgcagatcgaggatctcgacggctaccgatgggcgctcgggcgccgtctcgacgcatgaccccaaccgctacacgcatgaacgaagccaccaccaccgcggccgtgccgcgctttttcgtcgacgcggcactgcgcgccgacgccacgctcgcgttgccggccgatgtcgcgcgccacgcgcaggtgctgcgcctgcagcccggcgacgtgctcgcgctgttcgacggcaccggcggccagtaccgcgcgcggctcgtcgagatcgacaagcgcagcgcgctcgcgcagatcgacacgttcgagccggccgaagccgagccgccttatcgcgtgacgctcgcgcaaggcatcgccggcggcgacaagatggactgggtaatcgagaaagccgtcgagctcggcgttgccgcggtcgtgccgctgtcgaccgcgcgcggcgtcgtgaagctcgccggcgagcgcgcggacaagcgcgtcgcgcactggcgcggcgtcgtgcgcgcgtcgtgcgaacaatgcgggcgcaaccgcgtgcccgacgtcgcgcagatcgccggcttcaacgcgtggctcgatacgctgccggccgcaccggccgacggcgagctgcggctgctgctgtcgccgcgcgcgagcatcccgttcgcgtcgctgcccgacgcgccgcctgcggcaaccgtcacgctgctgatcgggccggaaggcgggctgtcgcccgacgaggaaaacgcggcccgcgcacgcgggttcaccgcgctgtcgctcgggccccgcgtgctgcgcaccgagacggccggcgcggccgtgctcgccgcgctcgcggcgcgctggggcgggtggtgatcgcgaggcgcggccgggcacgccccgcggcatgacgccggcgcacggcgacgcgtgtcagcgcgccgcgctgaacggctcgatgtcgatgacggggaagtctggagcgcggatgccaaagcgtcgaggttgtccgcgtcgagcgcgagcgccggcccggtgatccgcagtttgcgcgccggcggcgtcgcccggatcgccgtgatcagcgggccgcgatagcgcaggttcatcatcatctgcaccgcctgcacgatgctgaccggcctgccgccctgctggaacgtggccgcgtccaccgtgtcgttccagccctggatgaagccgccgacgtcgatccgcgtgttcaggtcgatccaccgctgcttcttcgcgtccgcgctgtcgtccgacgcccgcagcgcgtcggacgcgcggctcacgtcggcatcgtgcttcgcgcgccatgccatgtagccgagcgcgaacaccatgttgtccggcaggatgtcgtcgtcctgcacgacgtcgaacaggcgccgcggcgcctgttgcgcgacgaacgccggcgtcaggatccacacgctcccgttgcgcaacgcgccggtcgtcctgccgagcgcgggctcgccgctgtcgaccgcgatgcgcgtcagcaggccggcgtcgaccagttcgtccagttgcgccgccagcgccggcgacgcgtgaatcgcggcggccaccgccgcgtactggtccggtgtcgagcgcgtgcgcagatcggcgagcagccgctcgacggccgcgtgcgccgccggcgaaaccggcagcgcaaccggctcggcggcgttgtcgcccgccacagccgctccgcacatcgaaacagccaccgcgacaaccagcatccctcgcgtgaggatcttcatcgttcactccccgttcgaatgcacggcatgccggccatgtgcagcggccgggatcgcgtcgcttacttgtcggcttctccgcccgccgagccgatcggccccagcaacgcatcaaccagcggcgacagcacgtcacccggagaacccgtgagccagcccttctcgttcgtgccgtagagatcgacctgccccgtcacgggcggcccatcggggcctcgtcgtagacgcgcgccatgcccgagaaaaacgcggcgaggaaggccgtccgggccttgtcggtcttcaggcgcgggttgcccagcttctccttcagcgccttcacgccgggctccacatcgacgacacggcacgaaaaatcgaccgtcgcgatcgattcgcccgccacgtactcgttcggcttctgcgtcgaaccggtcgccttgcattcggaacgggccagcacatgctgatacgacgtgatcgacgcgctgatcggttcgcgcaatgccgcacgagacctggccggcatcttcgatagcagcgcggcgatcatgttgtcgcgcatcgtgtcgccgagcttcgggatcgccgcgacgtcgagtgcgtccttgccgtcgaagcgcgtgcgcatggcatcgttgaactgcgccgccttggcgacgtcgccgttgacgaaggtgccgagatacagatcggtggtctgctcgggcgtcagcaccgccgcgtgcgcggcaccgcccgcgacgagcgcggacagcacggccgcgcgcgtcgcgcggaacaacggaaaacgcgcgccgcggcgcgcatgaagggaaacgtccatcggtcgggtcatgtcggtatcgaattgatcgggcctgcgcgacagcctcattgctggctggcggcaaccgccgcgacaaccgggccggacagcgcatcgacgacgggcttcagcaggctttcggggctgtcggtcgtccagcccttgctgtccgaaccgaccatctccacctgccccttgatgcgccggctgaccggggcgtcgttgaacgcgcgcgccacgtccgtgaacgtcgtcctgacagccgcgaagcgctgctggtcggttttcgcgttcgcgcgcgctttcgtggccgcgtcgcccggcggcgtgacgtcggccaccttgcactcgaaactgaccgtggcgagttcctgccccttcccgcctgcacccggcgtgcgcttgacgccggtgacgttgcattgcgagcgccgcaacgcccccgtgtacgcgaccagcatcgagtcgagcgacggcgccagcgcctcgcgtgcggattccgacatcaatgccagcgtctgcccgagcatctgttcgcgcatgtcgccgtacatgtcggccggcagcagcatgttccgggcctccttcggatcggcggtctcgcgcaccgtgtcgttgaattgctcgaccttggccgcgtcgttgttgacgatggcgcccagataaacgtcgacggtctgttcgggtgtgagcgccgcggcctgcgcggcaagcgggatgccgagcgacagcgcacacgcggccagcgcgcggacgagcggacggcgcgcacgggcgcgcgccgcaaatcgggtagcggtcatgggaaaacggccctctcgaatgattggtgttgtgcgcccggcgcggcggccgcggccgggctgaccgattgtcgcggaaaaaggtgcgcgatgaaaggcttttgtcgggccgggcgcggcgcgtgcagcgcatcgcgcgcggacgcaaaaagcccgctcgaagcgggctttgggcgggtgtttcaccggatcggccgttggccggcccgtgcttacgcgaacgagtagaacacgcggaacgcgaccttgcgctcggcccagaattcggccgcctcgcggaacacgtcgagcagcgtctcgcgcccttccttgtcgaatttctgcgcgatcggcagcccttcgaggacgatcacgaaaccgggctgcgcgcccgccttcgcgacgaggtcggtcaggcagtcgtacaacgcgtcgtagttcttcccgaaatgtttcgggaacaggaacgacgtcgcgatcgtttccatcacttcctgcttcgactgcgcggcgccgcaatacgcatacaggaaatgctggccgagccggccggcttcgtcggcaagatcctgcacgcggaacgcgcggatcgactgcacgagattgggtcgcacggtcgtgaaaaggctcataggctcctcgttcgatgaaagcccgggctcggcttcctgttgctccggcgtgccgccggcctgcgccgccgcgtgcagttgaatcacgcgctgaaacaggttgccgtcgccggccgcgaacagttccgccgccgccgtttcgtgcgcgtagatggagtcgctcatgccattcgtcccgaagtcattcaacaatacgtttaaaactgttgtagtggtcgcccgtgtaataacagttgtcgatccggcgcaacggcccgccacagacgatccggcgcgcgccgcgattgcgggcacgtggcgtcggtaccgtgtactcatggtagtagccgcgcttcgcttttggcaggatccgctcgcggttgccaaacacgacgccgtctttctcgtacggataggggccgccggcgccgatcaagcccagcgtggtcacggcctcgcgcggaagactggcggtcgggatcgtatcgagcccgctcgccgcgacgtcggccgcaacggcctcccgtgcgtaagcggcggaaaccagactgcccgtcggcgtgccgacgatacccatcgcgaacatcgcgaagacggacgcgagcgcgccgttgcggagccacttgcgtgccatgaaccagggttcccgctgttaaatcaagtagttgacgaccaacaaaggcgttagcgtagcgttattggccgcgcgaatcaatgtccgtttgggaatcgaaagcatcgcgatgtccggaattacgcatttttaccgaaatcacactacatttatcttacacgggataaaataaaggcggcatctctcgtacggcaagacctgcctccttgccgcgctcgctaccaggagtggagagatgctgctgttgccttgagggaagcgcgtttgcgccctgcccgcggcgtgcccattgcgggcacgcctcttttgctttgtttacatttcgcccgacgcgccacgccggttcgaccggcctggcgcgttcgttttggctcagcgcgcggcgttcacgtcggcgaccagcagcgccgccatgttgacgatgcgacgaacggtcgccgattcggtcagcacgtgcaccggctgtgcggcacccagcaggatcggcccgatcgcgatgttgttgcccgcagccgtcttcagcaggttgtacgcgatgttcgcggcgtcgatgttcggcaggatcagcaggttcgcttcgccttccagcgtcgattccggcaggatttccttgcgcagcgccgcgtcgagcgcgacgtcgccgtgcatctcgccgtcgaccttcagctccggtgcacgttcctgcaggatcgcgagcgtatcgcgcatcttcttcgccgaaggtgcattgctcgtgccgaaattcgagtgcgacaccagcgcgaccttcggctcgatgccgaagcggcgcacttcttccgcggccatgatcgtgatctccgccagttcctccggggtcggatcgacgttcacgtgcgtgtcgacgaggaagatctggcggcccggcagcacgaggccgttcatcgccgcgtacacgctgcagcccgggcgcttgccgatcacctggtcgatgaagtgcaggtggcggtgcgtggtgctgatcgtgccgcagatcatcccgtccgcttcgcccttcttcaccagcatcgagccgatcagcgtggtgcggcggcgcatctcgacgcgcgcgagctgctcgctgatgcccttgcgcgccatcatcttgtagtacgtctgccagaagtcgcggtagcgctcgtcgtgctcggtgttgacgaccgtgaaatcggtgcccggcgtcaggcgcaggccatagcgctggatacggtgctcgatcaccgacgggcggccgatcaggatcggcttcgcgagtttttcgtcgacgatgatctgaacggcacgcaacacgcgctcttcttcgccttccgcgaatacaacgcgcttcttctcttccggcgcggcgcgcgcgatctggaagatcggcttcatcgtcgtgccgctgtggtacacgaactgctgcaggtgctgcttgtaggcttccatgtcctcgatcgggcgcgtcgcgacgccgccgtccatcgcggcctgcgcgacggccggcgcgatcttcacgatcaggcgcggatcgaacggcttcggaatcaggtattcgggcccgaacgacaggtcctggatgccgtaggcggtcgcgacgatgtcgctctgctcgtgctgcgcgagctcggcgatcgcgttgacggccgcgatctccatttcacgcgtgatcgtcgtcgcgccgacgtcgagtgcgccacggaagatgaacgggaagcacaggacgttgttgacctggttcgggtagtcggtgcgaccggtcgcgaggatcgcgtcggggcgcacttcgagcgccgcttccggcaggatttccggcgtcgggttcgcgagcgcgaggatcagcgggcgctcggccatgcccttcaccatctccggcttcagcacgccggcggccgacaggccgaggaagatgtccgcgccgtcgatcacttcggccagcgtccgggcttccgtttcgcgggcgaaacgctccttgtccgggtccatcagctcggtgcggcccttgtagaccacgccggccaggtcggtcaccgtgatgttctcgagcggcaggccaatgtcgaccagcaggtcgagacacgcgagcgcggccgcgcccgcgccggacgcgacgagcttgaccttcttgatgtccttgccgacgaccttcagcccgttcgtgacggccgcggccacgacgatcgcggtgccgtgctggtcgtcgtggaacaccgggatcttcatccgcttgcgcgcttcgcgctcgacgatgaagcagtcaggcgccttgatgtcttccaggttgatcccgccgaaggtgggctccagcgcggcgatcacgtcgacgagcttgtgcggatccgactcgttcagctcgatgtcgaacacgtcgatgcccgcgaacttcttgaacagcaccgccttgccttccatcaccggcttcgacgcgagcggcccgatgttgccgaggccgagcaccgccgtgccgttcgtgacgacgccgaccaggttgctgcgcgcggtgaagcgtgccgcgttgagcggattctcgacgatctcctcgcacgcgtacgccacacccggcgagtacgcgagcgcgagatcgcgctggttgatcatctgcttggtcggggcgatcgcgattttcccggggtcgggaattcgtgatagtcgagggcggcttcgcggagcttggctttggaggaggattgggtggacatgtgtctcgtgacgggcggattagaataactgttcgacggcattgtagcgccaatcatcggccgccagaccggcgattcgggtgcaacagccgcgacaaaaatgtaccggatggtgcagaagcgccgccgttcgcctcgtacaatgccgttccttcaaccgttccggatcgcccgccgtgccagccgccctctccgagttttcactgatcgaacgcttcttcacgcgccgcgccgcgcaggggcgcgcgcgtcgacgctcggcatcggcgacgattgcgcgctgatcgcaccgcgatccgggaaattgctggccatttcgacggacatgctggtggaaggccgccacttctttcccgatgtcgcgcccgacgccctcggccacaagacgctcgcggtcaacctgtccgacctcgcggcgatgggcgccgaaccgcgcgccttcacgctcgcgtgcgcgctaccgcgtgccgacgcggcgtggctggaagcgttcagcaacgggctgttcgcgctcgcggagcgctacggctgcgagctgatcggcggcgacaccacgagcggtccgctgaacctgtgcatcaccgtattcggcgaagtcgcgcccgacgccgcactgcggcgcgatgccgcgcgcgacggcgacgacgtctgggtgtccggcacgctcggcgacgcgcgcgccggcctcggcgtcgcgcgcggcgaatgggcggccggcgcggccgaagcggctgcgttccggcgcgcgctcgagcgccccgagccgcgcattgcgctcggcctggcgctctcgggcgtcgcgcacgcggcgctcgacatctcggacggcctcgccggcgacctgcagcacatccttgcccgctcgcacgtgtgcgccgagatcgatgccgacgcggtgccgcgctcggccgcgctcgcgacgctgccgcccgacgtgcagcgacgctgcacgctggccggcggcgacgactacgaactgtgcttcaccgcgccggcggcggcccgcgcggcggtcgaagcggccggcctgacggccggcgtgccggtcacgcgaatcggtacaatacgcgcgttgtccgcgccgtcggaacagcccgcgatcgcgtggcgcgacgccgccggcgcgccctcgccctcacgttgcacggcttcgaccacttccatgcagactgacccgacgcccgcgcacgccgcggccgagcccggctccgcacctggcggacacgcgccgcggcgcgcgaccgcgcgcttcatgctgtcgcaccccgcgcacctcgtgtcgctcggcttcggcagcgggctcgcgccgctcatgcccggcacgttcggctcgctgttcggctggctcacgttcgtcgtgctcaatcgctacctgacggtgcccgaatggtgggcgctgatcgcggtcggcttcgcggcgggcacgtggctcaccggcttctccgcgagaaagatgggcacgtccgatccgggcgccgtcgtctgggacgaaatcgtcgcgatctggctcgtgatgctgttcgtcacgcccgcgaccttcatcggccagctatgggcgttcgtcgcgttccgcatcttcgacatgctcaagccgccgccgatccgctatttcgagcgccgcctgaaaggcgggctcggcatcatggtcgacgacctggtcgccgcgttcatgacgctgctcgtgatcgccctgtggcgctccgtcgtcggctgaccgatttcccgactcccgtttcccgacgcgcatgccaaccgattccgtcgtccaccagcttgcgatccgcgcaggcaacaagctgcgtgacgagcacctgacgctcgccaccgccgaatcctgcaccggcggcatgatcgccaccgcgatcaccgacatctccggcagcagccagtggttcgagcgcggcttcgtcacgtactcgaaccaggccaagatcgacatgatcggcgtgccgcccgacctgatcgacaagcacggcgccgtcagcgagcccgtcgcgcgcgcgatggccgaaggcgcgctgcgcaacagccgcgcgcaggtcgcgctgtccgtcaccggcatcgcgggcccggccggcggcagcgagaagaaaccggtcggcaccgtgtcgttcggctggagcaaccggctgcacaccgacgtcgagacgctcgtgttcaagggcgaccgcgatcagatccgcacgcaggcggccgcgcatgcactgcgcgggctgctgaaactgctcgacgagcgcgagggctgaccggccggggcgcccgccgcgcccctgccggcccgcttactggatcgcgtcgggcttcacgacgatccagttcttgtccgccgtgaccggcaggccgagggacttctgccgcgcggccgattcatccgaccacgcgcggatctgcgccatctgcttgtccttcttgttcacccacacgcgcacgccgccgcgcgcgacgtcggtcgcgttcagcagcatgtagccgtcggacgtcggcgtgtcgcccgcgacgagcaccggcttcttccactggtcgatccagccgacgatcgagccgagcttgccttcgtaccacgtcatcgggttcatcaggaacggcgtgatcacgaggctgcggttcgcggcctcgtcgtacttgccggccttgatctgcaaccgggacgtcgtcagcgcgccggtcgccgggttgcgcagcagcgtcgtcacgccgatcacgttctgcggcttcacgttgtagccgtacttcgggtcggacagcacgagccgcgcgagctcctcgtgcgcggccgtcatcacgtagacctcgatcccgttctcgcgcagcacgttgtacagctcctgcatcccgcggaagaaacgcggcgggttcaccgtgccgtcggccaccttgtcgccctgccagtagcggatcgggatcggcttgccgtcggcgagcatcgcgtcgacgtggcgcttcaggtcggccagcgactgcccggcgaacgcctgcgcgatccacgggtagcagaccaggtcgtcgatctcgcagagccggtagtaatagctcgtcagcgattccttgtagtcggcggaatccttgaacgggatcagcttcagcgacggatcgagcgtgtcgcgcgtcagcacgccgcggttctcgaggtacggcagcagcgactcctcgaggtcgtagcggtaggtcgtgttgtcggcgtcgaacaccgcgtagtcgccgcggtgcgcgtgcgctgcgatcatcgcgttcaacgccttcgcgctgtcggccggccagtgcgacaggtccgccgcgtgggcgaagctcatgcacaacgacgcggcaagcgcgctcagaagacgtcgggacagcttgggcatggcgtcactccctttcttgacagtttcgttacagatcgatgacaagcgcgagcatcgcgcgattggcgcgcgggcatgcggtgcggaaacgacgggaagttgcccgtgcgcgtcagtgcgacgcccgggaacgcgggaaacggaggcggtaaggcggagaaagcggcacgggcccgcgaacgcgggcctgccggaaccggctgcccgcgcgggcagccggcgccagcgtcgatcagcgatgcgcgttgatcgtgtcgcgggtcttctgcgcggcgagcgccgcggcttcggcgaaatcctcgcccttgctcgcgtacaggatcgcgcgcgacgagttgatcatcatgccggtgccgtcggccgtgcggcctgcgttgacggtcgcctgcacgtcgccgccctgcgcgccgatgccggggatcagcagcggcatgtcgccgacgatcccgcgcacgatctcgatttccttcgggaacgtcgcgccgaccacgaggccgagctggccgttcttcgcgttccacttgttcgccgcgagatcggccacgacctggtagagcggccggccgttcgtgtcgaggaactgcaggtcggagccgcccgggttcgacgtgcggcacagcacgatcacgcccttgccttcgtgctcgaagtacggctcgaccgagtcgtagcccatgtacgggttcaccgtgacggcgtccgcgcgatagcgctcgaacgcttcgcgcgcgtactgctcggccgtgctgccgatgtcgccgcgcttcgcgtcgaggatcacgggcaggcccgggtgctggaggtggatgtgcgcgatcaggcgctcgagctggtcttccgcgcgatgcgcggcgaagtaggcgatctgcggcttgaacgcgctcgcgtattgcgcggtcgcgtcgacgatctgccggcagaattcgaagatcgcgtcgggctggccctcgaactgcacgggaaagcgcgacggctcgggatcgaggccgacgcacagcagcgaattcgtgcgctgccacgcggcgcgcagcgattcgatgaaagtaagcggggaagacatggcgggtactcgcagcaaaccgttggtagaccgcgtattttacccgcgtcgccggcgcgcctcgcgtgtcgcgccattgccgcgcgcatcggcgcgctcgacggtgaacgcgaaccgccgcgtgagccgctcgccgggcgcgagcagcgtcatcccgtgcgcggtcgcgccgcccggcaggttcaccgcattgatcggatgatcgaccggctcgaagcagaagaaatcctcccgggcggggtatagagcacgtacgcatcggcgtcggccgccaccgtcagcgacagtccgcggcgcggccagctcaccgtcgcgtggccgccccagccggtgaatgcgtgattgacgagcgcggccggcagcggatacgcgacgccgaactgccaggccggcggcacgctcacgtgccgcaccggcaggaaatcggcgcccgacagccacagcccgccggcggccgcggccagttcggtcacgtcgtcgcgcaccaggaacggatgcacgccgagcccgaacggcaatcgcgcgcgccccgcattctcgatcgtcagcgcgatcgacagcgtcgtatcgtcgagctcgaacgactggatcgcgcggaacgcatacggcgcaccggcggtgcgatcgagcgacagctgcagcgacgtggcggtcgcatcgtccacctgccatggcgcgagccagccgtcgccatggatcggcagcggctcgtcgcggcggttgcgcggcaccgcgacgctgcgcccgtcgcattcgaaacgcgcgccgccgatgcggttcgagtaaggcagcagcggataacacgcgagctggttcgggtccgtcgccgtctccgggtggtcgcagcggcggaacaccggcatcaacgcgccgttgtcgccgcgccagtcgaagcgcgcgatgccgccgccgagatgcggcagcacgtcgagccgcagcgccgcgttcgacagcgtgacggccgccgcatgcgcggcgccgacgccctgcgcgaaggcggccgtctgcgggccggggctaaccggctgcgcggcggcggccaggcgcgcgcggcgcgactggctggtggacgacgatgcgcgcgaggacgtggcggtcatgatgaactcctttccttcgtcgaagaaacgatgcgggtcgtgcgaacggtcaggcccagccgccgtcgacgatcacgtcctgcgcggtgatcatccggctgtcgtcggccgcgaggaacagcgccatccgcgcgagatcggcgggcagcagttcggcgtcgatgcactggccggccttgatcgccgcgcggcccgcgtcgtcgagccacagccggcgctgcttgtcggtcatcacccagcccggcaccagcgaattcacgcggatgccgaacgggccgaggtcgcgcgcgaggccgcgcgtcagccctgcacggccgccttcgccatcacgtagacgggataaccgccgttcttcagcatccagctgatcgagccgagattgatgatcgcgccgccgccctgctgcttcatgtcgtcgatcaccgcctgcgcggcgaagaactggtgacgcaggttcaccgcgatgcccgcgtcgaacgattcgggcgtcacgtcgccgatcgcgtggcgcgcgtcgttcgccgcgttgttcacgagcaccgcgatcgcgccgatgcgcgcgcggatcgcgtcgatcgcatggcgcagcgcgccgacgtcggtcaggtcgcactggatgaacagcggcgcgtggcgtacgtgcgcaaggctgtccgccagcgcggcgccggcggtcgcgtcgaggtcgacgaacgcgacgcgtgcgccctgcaacgcgaagtgttcgacgaacgccgcgccgatgccggtcgcgccgcccgtgatcagcaccgcgcgatcctcgaggctcggataccgtgcatagcgcgcgtggctcgtggtgtgcgcgtcgtgcgcggaagtgtcgatggtcatgcggttcgtctccgtcagggcaggccgggtcagtcgcgaacgccgcggttcttcagctggtcgagcagcacggccgcgagcaggatcgcgccgcgcacgaggtactggtagaacgcgtcgatgttcagcaggttcatcacgttctcgaccgtgcccatgatcagcacgccgatcacgacgccggagatcgtcgcgcggccgcccatcagcgacacgccgccgagcacgcacgcggagatcacgttcagctcgaagccctgcgcggcgttcggctggcccgacgtgatgcgcgacgcgaggatcacgcccgcgagcgccgtcaccgcgccctggatcaggaagatgtacacgcgcgtgcgttcgacgttgatccccgcgagacgcgacgcctcgggattgccgccgatcgcgagcgtgttgcggccatacaccgtctggttcaacagcacgccgaacgcgatgaagcacagcagcgtgacccagatcggcagcgacacgccgaagagcgtgagcccgccgagcgcgatgaacgtatccgacgacacgccgaccgcctgccccttcgacacgatgaagccgagcccgcgcacgatctccatcgtcgcgagcgtcgtgatcagcgcgttgatgcgcaggtacgcgatcaccgcgccgttcacgaagccgatcgcggcgccggccgcgaccgcggcgacgatcgcgacgaacgtgttgtcggtcgcgttcagcaccatcgcgcacagcacgcccgagaacgcgacggtcgagccgatcgacaggtcgaagtcgcgcgacgcgagacagaacatcatcgtgcacgcgaccatgccgatctgcgagatcgacagcgcgaggccgagcatgttgtcgatcgagaagaagtgatcgaccgtcagcgacatcgtgatgaacatcaccgcgaagatcgcgatcaggctgtattcggtcaggtgctgccaccacttctggcggtcgctctgctgcggcaccagcgcgtcggccgtgggcttcacggcggcgctgccgaggttttcgttgacttgcatgattgtgtctcctgctcctgcatcgcgcggcccgtgccgcgcgtccgattcgattgtcgtgtcccgcgtcaggccgcctcgacggcgctcgtctgcggcagcgccaggctcagcaccgcgtgctcgttcgcccgttcgcgcggcagctcgcccgcgatccggccttcgcgcatcacgacgatgcggtcggacacgccgagcacttccggcaactccgacgacaccatcacgatcgcgcagccgcgctctgcaagccggtagatcacgtcgtagatctcgtgcttcgcgccgacgtcgatcccgcgcgtcggctcgtcgaggatcacgaccttcaggtcgggctccgcgagccagcgcgacaggatcgccttctgctggttgccgcccgacaggaagcggatcttctggcgccggttcggcgtcttgatcttgagccgctggatgaagcggtcggcggtttcgctttcggccttgcggttgatgaacagccccgcgcgcaacgaatggcggcggcagctgatgttgatgttctccgcgaccgacgcgatcgcgatgatcccttcttccttgcggtcctcggggcacagcacgatgccgtggcggatcgcgtcgccggtgcgcttcacgtcgatgcgcgcgccgtcgagcgtcagcacgcccgcgcgccggtgatccgcgccgtacacgagccgcatcagctcgctgcggcccgcgccgaccagcccgaagaagccgacgatctcgcccgcgcgcaccgagaagctcgcgggttcgcgcagggcatggccgtcgacgccttcggcggagaaccgcacgtcgccgagcgtgcgcggcgcgtaatggtagatatccgaaatctcgcgcccgaccatttcggcaacgagccgttcgcgcgggacgtcggcgagcgattcgtgcgacgcgatcttgcgcccgtcgcggaagatcgtgcacgcattgcagagccggtagatctcgtccatccggtgcgagatgtagatcagcgcgcggccctgcgcgcgcaggtcgtcgacgagcttgaacagcacctcggtctcgcgatgcgacagcgaactggtcggttcgtcgagcgcgatcacccgcgcattgcgcatcagcgccttgcagatctcgaccatctgccgctgcgcgatcgacagccgcccgagcttcgcatcgggatcgagatcgacacccatcgccgcgagccgctcgcgcacgtagcgcttcgcctcgcgcttccgcacccagccgaacgcattcggcaggcggccgagcagcaggttttccgcgaccgtcaggtcgggcacgtactgcagctcctggtgaatcaccgcgatgccggccgcgatcgacgcggccgcattcgcgaactgcacgggctggccgtcgaccagcacgctgcccgcatcgggctggtattcgccgccgagaatcttcagcagcgtcgacttgcccgcgccgttctcgcccatcaggccatgcacctcgcccgcatgcacgtcgaacgagatgccgtcgagtgcgcgcacgccgggaaataccttgccgatattgtcaaaacgcagtgccgctgacacgtcgtctctccacttccggaatcgatcgaccgccggccgccgcatcgccgcggcagccggcgggccgcttacttcgacgcgagccccatctcgtcgcgcaccttcgacacgttgtcgcgcgtcgcgagcatgcccgtcgtcagcgtcagcgccggcggtgccttgccctgcgtgatccacgcgtacatcaggtcggaggtttcctcgccgtggcgcttcgggctgatgatcacggtgccgtagaagcccgtcggctgcggcttcttgaactcgttcagcgccgaatcggagccgccgatgccgatgccgatcatgttgtcggccttgaagccgcgcccttcggccgcacgcactgcgccgagcacggcctcgtcgttcaggccgtacgccacccagtgcttgaactgcgggttcttcgtgagcgcgatgttcgccgcgttgaacgcgttctccgtgtctgtcttcgcctgcggcgcggcgatcacgttcgccttcgggaagccggcggccaccagcgcgtcggtcgcgccgctcgtgcggtcgtgcgcggtcggcagctgctcgtaggtgatgtcgatcgcgccgacgtccttcatgtcccagccgcgcttcttgatctcggccgcgatgccgtcgccgacctgcttgccgatgttgtacgcggagatccccatgtgcggcaccgactcgatcggcttgcccgcgccgtcgacgaggcggtcgtcgaccgtcatcatcttcaggttgtgcgacttcgccttcgcgacgatgcccggcccgagcttcacgtcgggcgtgcagatgatgaagccctgcgccttctgcgcggacaggttgtcgatcgcgctcatcaccttctcgccggacggcgcgccgatcttcacgagcgtgaagcctttcgccttcgccgccatctcggcgaacttccactcgtcctggaaccacggctcttccggctgcttcaccaggaagccgatcttgaccggatcggccgcatgcgcaaccgggctcccgatcaccaccgcggccgcagcggccagcgttacgaacgttctgcgtttcatctccagtgtctccttgtcttcatcgaacaggatgcagccgcttgttggtttcgacgcagcgtgcgcgcggccgtcgcacgtgcggtctttcgaatcgctacgtcaatcgtgtcagtcgtggtacagcgccgcacgcccgccgtcgacggtgatgcatgcggcattgatgaacggcgcctcgtcggacgccaggaacacggccgtcatcgcgacctcctcgggccggccgatccgcttcatcggctgcagcgcgagcgtgtcggcgcgcgcggcggccgggtcgggctgcgcgtcccaccagtcgcgcgtgagctgcgtctcgatgtagcccggcgcgatcgcgttcacgcggacgttgcgcgccgcgtattcgatgccgagcgcacgcgtgagaccgagtacaccgtgcttcgcgaccgggtacggaaagcagcccgggatgatcctgaatgcatgcgtcgacgcgatgttcacgatgctgccgcgaccgcgttcgaccatcccttccagcgccgcgcggcagccgtgccacacgccgtcgaggtcgaccgcgaagcagcggcgccagtcgtcgtcggtcatcgtcagcggatccgcgaacacgttgatgcccgcgttgttcacgagcacgtcgagcgggccgaacgccgcctcggtccgcgccacggcatcgcgcaccgcatcctggcgcgcgacatccgcctgcagcgccagcacgcgcgcgccggcgatgtcgtgtgcaatcccggcggccgtgtgctgcgcctgcgggaggtcgagatcgacgagcgcgacggccgcgccctcgcgaacgaacgcgcgggcgatcgcggcgccgatgcctcggcccgcgcccgtcaccatcgcgaccttgtccgcgaggcggcccatcatgcggccccaccgcgcgccgcgcgcaggccggcctggaacgcacgcgcgttcgcggcagtctcgtcggccggctggccgggccggtacagcgccgaaccgagcccgaagccgttcgcgccggccgcgaggaacggctgcatgttgtcgggtgcaatcccgccgaccgggatcagcggcaccgcgcggtcgatcaccgcgcgccacgccttcacgacgaccacgcccaactgctcggccgggaacatcttcagcacgtccgcgccgttcgcgagcgccgcgaacgcttccgtcggcgtcgcgacacccggcgcgctcgcgaggccgcgctcgcgtgcgcggcggatcacggccgcgtcgctgtgcggcatcacgatcagcgagccgcccgcatcctgcacgcgatcgacatactccgcgcgcagcaccgtgcccgcgccgacgatcgcgtcgtcgggcagcgcgcgccgcagcgccgcgatgctgccgaacggctccggcgaattgagcggcacctcgacgatccggaagccggcttcgtacagcgcacggccgtggtcggccgcttcggcgggcgtgatcccgcgcaggatcgcgatcagcggacacgcgtcgaacgcgcgcatcagcgcggcgtgaggcgtgtacggcgcgggtagcgtaaggtcggacggcatcaggggttcctctgcaatcggttcattggtcggcgcagacgggctcgccgtccgcgcgcacgagcccggcacgcgacgcgatccgccacaggccgcgctcggtagcatgcgcgacgactcgcgcgtgcgggtggccgaattcctggagcgcatcggcgtagcgcgcgcacaggccgtcgtcgccgatcagcagcagcggctggtccgcgagcgcgatgccgcgctccgcgagcatcgcgtcgagcgcgttgagctcatggccgatcagcaggccggacaggtagtcgccctgcgcatcgggcgcgagccggtcggtcaggccgagcgtgcgcgtgctgaaaatcgtcgcgagcagccccgtgtgccgcgcgccgcgcgcgaccgatacgccgcgcacgaacgccgcgcgatcgggcgacgcaccggcgcgcatcgtgcggccgaggatcgtgtggtcgcgcagcaccgcgaacagctcgccggtcatgaaggtctggaaccgctcgatcagcccgtccgtcacccacgcccatttcgcatgcgtgcccggcaggccgatcagtacccctgaacgatcggcgccaagcgtgggatcgctcgcgagtgcgccgactatctgcgtttcttcgccgcgcatcacgtcgggcaattcgcccgtggcgatcacgcccggcacgatcgagatcgtcgccccgcgcgaggtcgtcaccgtgatgaggcccgcgacgagcgcgtcggcgccggccggcaccgcgacatacggcgcctcgcgccagccctgcgcgctgccgaccatcccggcggcgagcaccggcaggccgggcgagcggtcgagccagtcgccgcaggcttcctcgaacaccgcgtcgaacgcgcgcgcgccgccgcccggcacatgcatgacgcccgccgggcggctgcgcgtgtcgatgagcgcgccgtgcgcgtcgtacagatacgcgcgcagcgaggtcgtgccccagtcgagcgcgatcagcgacggggtggcggaggtggcatccggaacgggccgggtcgaagtcgtcatcgtttgatcctgcgggtaccctgcggcgggctccagcccagttccgcggaaatggctcgcgcttcgcgctgcacgagcggaatcagttcgtccatccggtcgtgcggcatgtacggaatcgtgctcgccaccgacaccgccgcgacgaccgcgcccgatgcgtcacggatcggcgccgccacgcagcggatcgacgcctcgttctcctcgaggtcgaacgtatagccgcccgctgcgtaatgggccatgcgctgcaggaacgcgctcgtctcgggccggttgtcgggcttgaaattgacgccggccagcgcgcgccgtgcggcctcgaacagcgagcgccacaggtcgggatcgaggtcgagcatcatcgccttgccgatgccggtcgacgcgagcggcatccggtggcccacgcgcgagcgcatctcgaggccgcgcgtaccgggaatcttgtcgatgtacagcacgtcgtcgccgtcgcgcacgccgagatggatcgtgtcgagcgtcgcttccgcgagcgcttcgaggtgcgggcgcgcgaccgcggtgagcggcatctgctcgagcgcgatcgtgccgagttcgatcagcttcgggccgagcaggtagccgccctgcacctgccgcaggtagcgcgcctgcacgaggctgctgacgaggcgatgcgtcgtgctgcgcgtcgtgccgagcgcggcgccgatcgcacgcatgtcgcgcgcgccgttcgcgatcgcctcgagaatcgccagaccgcgcagcagcgtctgcgtaccggcctgctgggcagcgagatcgagcggcgtgctggtcgcgccgatgctgtcggtcagcgacgcatcgtccggcgtcgcgcgccgggcgtcgagggcaagggagtcgggcatcttggtcatggggcaggcttcttcaacggaaccggtgaagccgttcgcgcgacgccggaactgcgtccggcatcgcggcgaggcggcggtcgatgcaccgaataaagcgcccggcgaacttcatggaaggtgtctccgtgtgcgtcgggcgccgcgcgatgcgtgggtccgaagctgtcgatgtgcttcggattgtaggagcgcacgcactcgcctccaatatttgaatgcgttgcccagataatgagaattcggcggaaatccgcggcaggcacgccgtaacggccgcgccatgtgcacggggcggaacccgccgtgtcgcaggttccgcccccgttggttcaccgcgcgccgcgcttactgctggctcgtgctgcgtgcctgcatgtagcgctgtacgtccgcgaacgacacgcggccgttgccgctcgagtcgatctgccggaagtggttcgcgacataaccgaggccggccgcgcgcgcctgcgattcggtgatcgaacccgtgttctgcgagtcggccgcgctgaactgccgcgcgagcttgcgcaccacctgcgcatgcagcgcggcgcccgtcgtctgcgtgccggcggtcggcttgcgcgcggccggcggcacgtacggatcgccgagctgcgcctggcgcgcgcgcgccggcgcggcggcgtcgctcgcctgcgcgaacgcggatacggatgctgcggcgccgacacatgcgagcgccgcggcaacgacgatgaaacgattcttcatatcaggctccagtctggaatgaggtcgtcgacggccggcgcgacgccaccgcgggcgcctgtcgccggccggcgcagcatcagtgcgcggccgcgttgtagaaggtcacgaggtcggctttctcctgcggacgcgacgtatcgtcgagatagaccatgtgtccgccctgatagtccctgatcgtcaggttcggttgcgtcccgagccgcgcgaggtcgagctcggtctggtagaacggcgtcgcgatgtcgtgatacccgttcagcgacagcaccttcagttgcggattcagcgtcagcgccgcggcgaggtcggggatcgtgtcgggcatcgcgagcccgtcgtgcgtccagtcccacgtgttgatcgcgttgctgctcaacgaatacgccgactgcgcggtgtacttcagctcgttcggcaggtacttgccgatcgtgtcggtgaacggcttcgtgatgaacgagctcgacggatcgccgtccgcggcaagcgggctcgacaccggcacgttcacgcgcgcgtcgtagcggccgatcagcgtgcccggaatcagcgacagctggaagctgttgtcgaagaaggtcgggatcacgttgaagtccgcattccacagcgactgcttcacgccggtcgaattcaccatcgtcgtgacgagggccggcggcggcggcgtatggctcgccaggtacgcgttcacggcgggcgcgtagctgccggccgtcagcaggcgcatctggtcggcatactgcggcaggttcgacgggttcgggttgtcgagctggtagtacgcaccgacggtgccatacgacggcacgaaacccgcgcaactcaccgggctcgacccgttgttcgagttgccgatgtagtcgctcgccatgtcgcagttcgtgttgtagttcaggatcgacgactgcagcacgatgccgtcgagcttcacgccggccgtctcgagcaggttcgcgagcacgtcggtgcgcggcgtgccgtacgactcgccgaacaggtatttcggcgatgcactgcgctggttcacggcgaggtagcgcgtgacgaaatcgcggaacgcgccgccgtcctggtcgacgccccagaacgtctggttcgtgttcggcgcgatcgcttcggagaagccggtgccgatcgcatcgacgaacacgaggtcggtcgtgtcgagcaggctttcctggttgtcgacgaacgggaacgtcgacgtgttcgcgttcgggtcgcccgtctggatccggcgcgggccgaacgagccgaggtgcagccacaccgatgccgagccggggccgccgttgtacaggaaggtgacgggccgcttcgccgcgggctggttgtcggccgtataggcgacatagaagaacgaggcttcgggtgcgcccgtctgcggattgcgcgcgacgaggtggccggccgtggccgtgtagcggatcgtcttgccgttcagcgtgatctggtgatgcgtgacggcggccttttcaaccgcggcggaggcgtcgagcgacgcgttcgcgctcgacgaataactgttcggatcgttgtacgccctgtccacctgaccggcgggatcggctgagttgtcggcgctggcagcagcggacgatgtcacgtcgtcgttgcaggccgtcagaatcagcgaagaaaacaccactcccaacaacagcttcgctttgctcgctggcatcgttgctttccttctctcggatgtttttgtatcgagcagccggataagccgcccccgcctcgatcgcggccgataagccgaggcgctggccaatatacgcgaggccgtcagctttgaaaaattttgaaatatttggccggcggccggtgcggcgcacacctttcaggaatgcttcggttcgcgaaacgttgcatttcacgtgcctttcacggactttcgcgtttacccgggaatactaaaaattccaggatttcgtgccatatcagccaacaaacgcgcgtgatcgcgagcattgctcagcaaagcgaaatagacggattcgtctaatggatgtgacccgaaatgcgcgtgatgcgcatgcgctgcagcgcacaaacggcccgcgagcgacccgcgtgcagcgcacgggcgtcgaaacggtcaatgtgacggcgcgctcgcgccgttcactccgattgcggcagttcggccgctcccatccggcgggcgatgactgccgcgcgctgcgcctggtaggccgagccgcggtgcgcgtcgaaccagcgcggcttcggcagcatcaccgcgaggcgcgccgactgccacgcgccgagccggctcgcgggaatccggtagtaatagcgtgcggccgcctcggcaccgtacacgccgcgcccccactcgacggaattcaggtagatctcgaagatccgctccttgtcgagcaccgtttcgagcatccacgtgatgatgagctcctgccccttgcggatgtagctcttctcgcgcgacaggaacaggttgcgcgcgagctgctgcgtgatcgtcgagccgcccgcgacgatccggccgcgcgccttgttcttctcccacgcctgcaggatcgcgtcgacgtcgtagccgttgttggtcgcgaaggtcgagtcttccgacgcgatcagcgcgcgcttcaggttgcgcgagatctggtcgtaaggcacccactggtgctggatctgcgcgggcggcttgtcgcgcgacagccaccacgcgtcggtgcgcatgaacgcggtcgagcccgggttcacgaacgaccacagcgcgatctgtacgagatagaacagttgcgtcgcgagccacgcacccgtgaacaccgatcccgcatagacgatccagcgcgtcgggctcaccgtccgcgtgtgctgcgtgccgctcaccgccaccacgtgccgcgccccgttcagctcgccgcgagcgcctggcgcagcgcggccagcaccggtgcgccgtccggacgcacgccgcgccagatgaagaacgattcggccgcctgctcgacgagcatcccgagcccgtcggcggtgcgcgcgccgagcgacgccgcatgctgcatgaacaccgtcggctgcgcgccgtacatcatgtcgtacgcgagcgtgcccgcgccgaacgcggccgcgtcgcactccggcagcgcggcatcgaggctgccggccgtcgcgttgatcaccacgtcatatggctccgcgcgcacgacgtccgggccgccgcccgcgagcgtgcaacccgcatcgtgggcggcctgcatgaactggccgacgagcgcctcggccttgctcgcggtgcggttcacgatcgtgatcgacagcggcgcgcggtcgagcagcggcagcacgacaccgcgcgccgcgccgcccgcgccgagcagcaggatgcgcgcgcccgccagcgacacgccgagattcgcttcgatgtcgcgcacgaggccgacgccgtcggtgttgtcgccatggatacggccgtcggcgtcgatgcgcagcgtattcaccgcgcccgccgccgccgcgcgcggcgacagcgtgtcggcaagcgcatgcgcctcgagcttgaacggcaccgtcacgttcgcgccgcgaccgccttcggcgacgaatgcccgcacggccgcgtcgaaaccgtcgaccggcgcgagccggtgcgtgtattcgaccggctcgcccgtctgcgcggcgaactgcgcgtggatgaacggcgacttgctgtgcgccaccgggttgccgaacacgacatagcggtcggcgccgctcgtcgacgcagctgcggtcatgatgcgcgccctcttcttcggcgttgccgcccgtggcttcgccgccttcaccaccttcaccaccttcgccggctgccgcgccgtccgcctccgccagcgcttccgcctcggtttcggccgtcgcgtcttcggcgtcgatcagcgtatcgtcgccgccttcggcgtcatcctcttcgtcggccgcatcgccgctcgtcacggtcggcgcatcgagcacgttcagcaaccgcacggatgcctcgatcgtcagctcgtcgagcgacatcacgtcgagcagcacgcgcgtgccgcgcgcatgcacgccgagccccggcacgtgcagcagcagcggaatttcctcgaggcgcacaagatcgcccttcaccacgctcgcgacgacctgcttcttctgctcctgcgcgagccagcgcaggcaccagaagtactccatccggcgctggtagtcggcgtaggccgtatacgtgtcgtcgaagccctgcacgaccgcgtacaggtcggcgtccttcggcttgaacggtgcggcgagcttcgcggtgacgccgtgctgcacgcacgcgagcagctgccactggttcacgaggtcgacgtagcggcgcagcggcgacgtgctccatgcgtactgcgcgacgccgagaccttcgtgcggcgcggccgtcgtctgcatccgcgtgcgcttcgggcccggtgcgccgaagccgcgctgcgagcggtagatgcccggcaccgtgtgatcgtgcaggaacgcgccccaggtcgagttcgcgaggatcgcgagctccgacacgatcaggtcgagcggcgagccgcggcggcgcggcgtgatcgtcacgtgctcgccttcgacgtagaagttgtagtcggtgttgcgctgcacctcgcgcttcaggccgtaacccgcgcgcgcgacctggcgcttctcgaacagcgcctgcgcgagcggccacagcacggcgatgtcgtccttgtgcggatagtcgccggtgccggccgcgagcgtctcttcgttgacgagctcgtcgaggttgttgtgtcgcaggttgttcttcacgaacacgagctcggcgcgcgtctcgttcgcgacgatctcctgcgtttcgcggttgacgatgatgtacagcgacagtgccgggcggtagtcgccctctttcagcgtgaacacgtcgacgacgtcgtccggcagcatcgtgatcttgtcgcccggcatgtagacggtcgacaggcgcgtgcgcgcgatcgcgtcgatcgcgtcgccgcgcacgatgccgagcgccggcgccgcgatgtgcacaccgatgcgcacgcggccgtcggagagatgctcgaccgagaatgcgtcgtcgatttcggtcgtcgtgatgtcgtcgatcgagaacgcctcgacgtccgcgcgcggcagatcgtccggcagcgggccgaccgtgacggccgggaagcccgtgccgtgcgggaagaactccgcgaggaagcgcgcctcgtgcagcgcgcgcggcgacgcgatgccgccgcagtcgagcatcagccgcgccggcgacacgccgcgcgcaccggccgccgcctccatcgccttgtattcgatcgcgttcttgtccggccgcgtcagcagcccgagcaccttgcccgcgaacgcttccggcagcctgccggccttcagttcctcttcgtactgcgcctggacgagcgcctgctggcgcttgcgctcgagcgacgcgagcgccatcttgagctgctcttccggcgcgcgctggtactggccgcgccccttgcggcggaagtagacgggcgagccgtgcagtcgcaacaccagcgccgcacgctccaccgggccgtacgtcgcgccgaagtattccgcggccagcgccgtatacgcgaactcgtcggtcggcgcgcattcccacaggaaatccaggtcgatctgctgcgcggccgtgtcggcttcctgcatcagttcgcccgcggccggcttgtcgaattcgatcagcacgtctttcgcgcgcaccttggcccgccgcccgccgggcaactcgacctgaaatgcgtcgccctggcgcgacagcacgctgcccgccttgaaactgcccgattcctcgaagaaaacgttcactcagtactctcgttcagactgccgggcgccgcgtccgcggcgccgcatgatgatgggaattcgatcggcacgtggccggattaagacgtctttccgtcgcaaaacgcgagaacgtcgtcgacatagtcggcaaattcgctgatcccgtgatcgctgccttcgatcacgcgcgtcttcgcgcccgggtagtgcgcgagcatctcgcggtaatcaagcacttcgtcaccggtcgccgcgaacagatagtagcgttcggcacgcgtgattgccggcacgcgcagcgcgtcgagttcatgcaggtgatggcgctcgacgacgatcgtgccgccgccgtgccacagcggctgttcgcccaggtgctgctcgagatcgcgctgcggcacgatggccggattcagcagcacggccttccagccgtgtttttcggccagccaggtcgcgtaatagccgccgagcgagctgccgatgacggtcacgtcgcgcgcgcccgccacctcggcttccgcgaccgcgatcgcttcgagcggcgacaccgacagcgacgggcaccgccactcgccgctgcggccgagctcggccatgcgcgcggcgagctggcgcgacttctgcgattccggcgacgaccggaagccgtgcagatacaggatcacgagcggctcccgagcgcatcgagcagcttctgatggacgccgccgaagccgccgttgctcatcacgagcacgtggtcgcccgggcgggccgctgcgacgacggacttcaccagcaggtgcaggtcgtcgaacgcgtgcgcgcggtcgccgagcggcgccagcgcctcggccagattccagccgagcgcgtcgcgcccggccggcgcgccgtaaccgaacacgagatcggcgtcggccaggctcgccggcaattgcgacttcatcacgccgagcttcatcgtgttcgagcgcggctcgagcacggcgagaatgcgggaattctggcggccgatgcgtgcacgaaggccggcgatcgtggtttcgatcgcggtcggatggtgcgcgaagtcgtcgtagacggtcacgccgtccacgctgccgcgcacttccatgcggcgcttcacgttgcggaacgacgcgagggacgcggcggcctgcgcgggcggcacgccgacgtggcgcgcggccgcgatcgccgcgagcgcgttcatccggttgtgatcgccctgcacctgccatgcgacttcgccgacgcgttccgcgtgcgaatacaccgcgaagcgctcgtcgaccggcacgccgtcctcggccggcagcgcctgccagccgccgtcgacgccgaaccgctcgacctcgctccagcagccgcgcgccagcacacgctcgagcgcgtcggaacggccgttcatgacgatccggccgacaccgggcacggtacgcacgagatggtggaattgcgtctcgatcgcggcgagatcggggaagatgtcggcgtgatcgaattcaaggttgttcagcaccgcggtgcgcggccggtagtggacgaacttcgagcgcttgtcgaagaaagccgtatcgtattcgtcggcctcgatcacgaagaagctcgaatcggtgagccgcgccgacacgccgaagttcagcggcacaccgccgatcaggaagcccgggttcagaccggagtcttccagcagccacgcgagcatcgatgacgtggtcgtcttgccgtgcgtgcctgcgaccgcgagcacccacttgccggccagcacgtgctcgccgagccattgcgggccggatacataaggcaggccgcgatcgaggatcgcttccatcagcggattgccgcgcgtgacgacgttgccgatcacgaacagatccggtttcaggtcgatctgctcggcgccgtagccctcgatcagcgtgatgccctgcgcctcgagctgcgtgctcatcggcggatagacgcccgcgtcgcaacccgtcaccgtgtggcccgcctcgcgcgcgagtacggcgagaccgcccatgaaggtgccgcagatgccaagaatgtggatgtgcatagatgaatgctttcgcgccgccgggcgccgtcgattcggaaaggatgtgtgtgcggcgcgccggacgggccgcgcggccggcgcccggccaacggctttgccgcgacacaaagagcactattgtaactgacggcctgccgtgcccggcggcccgaacgatgcgcgcgagcagcgccggcacgccgggcggcaggccgccgcacccgcgctcgggcgccgcggcgatcgagtatgattgccggatcatgtctcgcaaacctcttgtcgacccgcggcgcctccgcgaggaaattgcccagtccgccgcccgcctgatcgcggaggacggcctcgactatgccggcgcaaaacgcaaggccgcgcgccagttgctgggcgactcgcgcgttgcaggcgaatggctgccggataacgaccagatcgaggaagaactgcgcgaatacctcgcgctgttccagagcgacacgcagccggacgaactgcgccgcctgcgcgaagtcgcgctcgactggatgcgccggctcgccgagttccatccttatgtgacgggtgccgtgctgaacggcaccgcgaacgcgcattcggatatccatttgcaggcattcaccgacaacccgaaggacgtcgcgatctacctgctgaaccagaacgtccagtacgacgtgtccgagacgcggcatttcgcgggccgcgccgacgtcgagacgctcagtttcctgtggcgcccgcggcgcgacgtggatgcgatcggcatccatctcgcgctctatgcgagcgacgacctgcgcggtgcggtcaaggccgacgcgcgcggccgggtcgcccgtgcggatgccgccgcgctgcgcgcgctcgtcgaagcaggcaaggccccttccgaaccggaatgattcaacgatgatgatgaaacgcatgttggcgctcgcggtcgtcgcggccgccgccgttgccggcaggctcgccgccggccattggttccgcggcaccgccgatgacgggatcgccgtcgccgcgcccgccgcacagggcagcccggtcgaacagttgtgggcggcctcctgacgggtgtcgacggcaagccggccacgctgtccgccttcaagggccagaaggtcgtcatcaatttctgggcgtcatggtgcggcccgtgcgtcgaggagatgccggagctcgtcgcgctgtcgcaccaatacaaacagaagggcatccgtttcatcgggatcggcgtcgattccgaacagaacgtgaagaactttctgcagaaggtgaaggtcgactatcccgtcttcgtcagcggctatgcgggcgccgatctggcccgcaatttcgggaataccgccggcgcgttgccgtttacggtcgtcatcgaccaaaccggcaagattcgcgagacaaaattgggacaaatccagccggccgagctgaaaaagacgctcgacgcgctgtaacctgcccgaacggcagcccggacgttgtcggcgatttgcccgtcgatcgccgcaatttcgcgtgaattcgccgatactttgcatgcgcgccggtaattcttgcaggtcccgcgcgctcggccgttcggcaaaactagacaaatttctctaaatagcgctaaagttcgcgcaattccgcagaaatagaagcgaccatgacacgattgctggtgctgcacggccccaacctgaaccttctcggcacccgggaaccggaggtgtacggccgcgtcacgctcgcacagatcgatcaggcgcttgccgcgcgcgcccgggaagccggcgccgaactgtcgtcgttccagagcaaccatgaaggcgcgctggtcgaccgcatccaggccgcgcgggaggaacagaccgatttcatcctgatcaatccggccgcgtatcgcacacgagcgtcgcgatccgggacgcgatcgccggcgttggcatcccgttcgtcgaggttcacctgtcgaacgtgcatcgccgcgaagcgttcaggcaccactcctacttttccgaccaggccgaaggcgtgatctgcgggctcggctggaaaggttatctgtacgcgctcgagtacgcgctggacaagctgcaaggcacgtcgcgcggctgaattcgcgatctagattcagcgccggcccctaaccggcgctttcacgtattgaaaggggaattcccgatggatcttcgtaagctgaaaactctgatcgacctcgtttccgaatccggcatctccgagctggaagtgacggaaggcgaaggcaaggtgcgcatcgtcaagaacgcgccgccggtctacgtgcagccgacggctgggtatgccccgcaagtcagcgcgcccgctccgtcggtcgcgctgccgaccgaaggcgctgccgcgccggccgctggcggcgctgccgcaccggctgccccgcagggccacgtcgtgacgtcgcctatggtcggcacgttctatcgcgcgccgtcgccgggcgcggacccgttcgtccaggtgggcgacacggtcaaggaaggccagacgatctgcatcatcgaagcgatgaagctgctcaacgagatcgagtcggacaaggccggcgtgatcaaggaaatcctcgtcgagaacggccaggccgtcgaatacggccagccgcttttcgtgatcggctaagtccgccgcgcggcctgcgggccgcgctccgccgatgctcgccaggcgccgttcgcgcgcccctcgaagagacgaatactcgctatgtttgaaaaatcctcattgccaaccgcggtgaaatcgcgctgcgcatccagcgtgcgtgccgcgagctcggcgtcaagacggtggtcgtctactcggaagccgacaaggaagccaagtacgtgcgccttgcggacgaagccgtctgtatcggcccggccccgtcgaacctgagctacctgaacatgccggcgctgatcagcgccgcggaagtcaccgacgccgaagcgatccaccccggctacggcttcctgtcggagaacgccgatttcgcggaacgcgtcgagcagtcgggcttcacgttcatcggcccgcgcccggaaacgatccgcatgatgggcgacaaggtcaccgcgaagcagacgatgatcaagaccggcgtgccgtgcgtgccgggctcggaaggcgcgttgccggacgatccgaaggagatcgtcaagattgcgcgcgcgatcggctatccggtcatcatcaaggcggcgggcggcggtggcgggcgcgggatgcgcgtcgtgcacaccgaggccgcgctcgtcaacgcggtcaacatgacccgcgaggaagccggccgtgcgttcggcaacccgcaggtgtacatggagaagttcctcgagaacccgcgccacatcgaaatccaggtgctgtccgacgcgtacaagaacgcgatctggctcggcgaacgcgattgctcgatgcagcgccgccaccagaaggtgatcgaggaagcgccggcgcccggcattccgcgccgcctgatcgaccgcatcggcgaccgctgcgcggacgcctgcaagaagatgggctatctcggcgcgggcacgttcgaattcctgtacgaaaacggcgagttctacttcatcgagatgaacacgcgcgtgcaggtcgagcatccggtttcggagctgatcacgggcgtcgacatcgtgcaggaacagatccgcatcgcggccggcgagaagctcacgctgcgccagcgcgacatccagttccgcggacatgcgatcgaatgccggatcaacgccgaagatccgttcaagttcacgccgtcgccgggccggatcacgtcgtggcatacgccgggcggccccggcgtgcgcgtcgattcgcacgcctacaatggctatttcgtgccgccgaactatgattcgatgatcggcaagctgatcacctacggcgcgacgcgcgagcaggcgatcagccggatgcgcatcgcgctgtccgaaatggtcgtcgaaggcatccagaccaacatcccgctgcaccgcgagctgatgatcgattcgaagttcgtcgaaggcggcaccagcatccactacctcgaaaaccggctcgcccagaagcagcaggtcgcaccggaagaagcgtaagcatgagctatcgcgaactcgtcgtcgaactggcccgtgagcacgcggaggcactgtccgacgcgctgctcgaactcggcgcgctgtcggtgtccgtggaagacgccgacgccgacacgcccgacgaacagccgctcttcggcgagccgggcctcgtgcccgaccgcaccgcgtggcagcactcgcgcgtggtcgcgctgctcgcggccgagcatgagccggccgtgctgctcgccgcggctgccaacgagatcggcatcgctgaaacgccgacgttcgtcgtccgcgaagtcgaggaacaggactgggtgcgactcacgcaatcgcagttcgagccgatcccgatcggcgagcggatctgggtcgtgccgtcgtggcacgatgcgcccgatcccgatgcgctcgtcctcgaactcgatccgggcctcgcgttcggcaccggcagccatccgaccacccgcctgtgcatggaatggctcgagcagtcggtgaaacccggccaatcggtgctcgactacggttgcggctcgggcattctcgcgatcctcgcgaagaaatgcggggcgaaccccgtcatcggcatcgacatcgatccgcaagccgtcgaatcggcacggcagaacagcgaacgcaaccgtgcggaagtcacatacgggctgcccgatgcgtgcccggacggcgaattcgacatcgtcgtcgcgaacatcctgtcgaatccgctgaagctgatggcgtcgatgctcgcatcgaaggtcaagccgggcgggcgcatcgcgctgtcgggcgtgctcgcgcgccaggcggacgaagtcgcggccgtctacgcgcgctacgtcgacatctcggtctggcgtgaacacgaaggttgggtatgcctcgccggaacccggcgcgaaagccattagaatagcgctgtccttcactctggccagcaggccgcccggctcgacatgcttcttgcgacgcgctgccctcattgcgaaaccgtcttccggctgcagcaggaacagctctcgctgcatcaagggctcgtgcgctgcgggcattgccacgaagtcttcaacgcatccgagtcgctcgttcccgagcacgcgcagcagcctgagccggccctgaccgaaccggctgccgcgccggacgaaggcaacgcgcaccatccggccccgccggcccggctgttcactaccgatgcgccggccggggcatcttccgacaccgattacaagccggaaggctgggacatgtgggcgccgtggctcgacgccggcgtcgacccgtcgctgcaacacaacgtgcagaccgtgcgcaccgagccgctgattccgctcgcccttccgtccaccgacgccggcgtcgttcacttgtcgggtgcgcccgcgccgttcgccctccccggccgagctggacacttccgctgccgtcgcgcaaccagccgaatcgctgcagacgcgaacgccgcgggataccgaaccatcggtcgcgcccgtcgagcgcgacccgcgtgagccacgcttcgtcgcacaccgtccgtcggacgcagataccgctcacgatgccgccgaacccgtcggcaccgcgcacttcgccgtgccggacgacgaacgtgcgccgcgcgaaccgcgttttgcatttgcaccggcaccggccttcgccgccgccggatccgaacccgacaccggtaccggcgcaaaggcaccgcacgaagagaaaccagccgcggccgccagcgcgccggccgcaccgttcccgctgcgctgaccgacgacgatcgtcctcacttcgccgtcacgcgcgagacgcgcgccccgcagcggcgcggaatgctcggcggctttttcggcggcctcgtcgccgccgtgctggccgtgctgctcgtcgcgcaactcgcgtggtggcaacgcgaaacgctgatgatccactggccggtcacgcagggctggttccggcaggcctgcgcgccgctcggctgcacggtcgcgccgccgcgcgcgatcgacggcctgcggctcgacgcgaccgacctgcgccagctcgacggcccgcgcgagctcgagctgaaggtaccgctgacgaaccgctaccgcgtcgcgctcgcctacccgtcgctcgaactgacgctgctggacgacaccaaccacgtgaccgtgcgccgcgtactcgcgccgcgcgactacgtgcgcccgggcacgccgatcgacgccgggttgccgcccggcacgacgcagacgatggtcgtccgcctcgaaacgaacggcacgcccgcctcgaatttccgcgtccagatcttctatccgtgacgcaccgcggcgcgcgcatgcgcgcccgtctcaacccgcgcgcccgagcggcgcgctcattcggagcacgaacatgagcaaagttacgctgggtggcaacccgatcgatctcgccggcacgttcccggccgtcggcgcgcaaggcgccgatttcaagctggtcggcaaggatctcgccgacctgtcgctcgccagcttcgccggcaagcgcaaggtgctgaacatcgtaccgagcctcgacacgccgacctgcgcgacgtcgacccgcaagttcaacgaagccgcatcgtcgctcgacaacacggttgtcgtcgtcgtgtcggccgacctgccgttcgccgcgacgcgcttctgcacgaccgaaggcctcgagaacgtcgtgacggcttcgacgttccgcaccggccgcgcattcgcgaacgcgtacggcgtcgacgtgacgagcggcccgctgaacggcctgaccgcccgtgcggtcgtcgtgctcgacgcgcaggacaaggtgatccacgcggaactcgtcagcgaaatcaaggacgagccgaactacgatgcagcgctcgccgcactgaagtaagctttcttccgctttcccctgccgcgccgcgccttcgcgcggcgttgtcgcgcagggtccctcatttctacaggaacgcacaccttggctacgttgatttgcggctcgatcgcctacgactccatcatgaccttcgaagggcggttccgcgagcacatcctgcccgaccaggtgcacctcatcaacctgagcttcctggtgccgacgatgcgccgcgaattcggcggctgcgcgggcaacatcgcgtacgcgctgcacctgctcggcggcgatgcacgcatgatgggaacggtgggcgcgctcgacgcgcagccgtatctcgaccggctcgaccagctcggcctgcgccgcgaccacgttcgcgtgctgcccgatacctatacggcgcaggcgatgatcacgaccgatctcgacaacaaccagatcgcggcgttccacccgggcgcgatgatgcagtcgcacctgaaccacgcgggcgacgcgccggacatcaagctcgcgatcgtcggccctgacggcttcgacgggatggtgcagcacgtggaagagctcgccaaggccggtgtgccgttcgtgttcgatccgggccagggcctgccgctgttcgacggtgcgacgctgcgccgcagcattgaacttgcgacctatgtagcggtcaacgactacgaggccaagctggtgagcgacaagacgggatggtccgaagatgaaatcgccagccgggtcgacgccctcgtcattacgcgtggcgagcacggcgcgaccatccgccacaagcagggtgcggagcagattccagtcgtaccggccgagcacgtcgccgatccgaccggctgcggcgacgccttccggggcggcctgctgtacggcatcgagcatggcctcgactgggcgaccacgggccgcctcgcgagcctgatgggctcgatcaagatcgcccaccaggggccccagacttacgtactgacgcgcgccgagatcgacgcgcgcttcgagactgcattcggttacagtctcaaatgaatattgtgggagagcaaagatgttgacgaaaaagaccctcacgctcgcggccatgctgacggcctcgctgacgctcaccggttgcttcaccgcgccgggctcggcggatgtctatagcgtcggccaggcgcagcgcgaacagacggttcgcatgggcacggtcgaaagcgtccgtgcagtgcgcatccagtccgacggcggcggcagtgcgatcggcacgctcggcggcggcgcactcggtgcggtggcaggcagcgcgatcggcggcggcaagggatcgatcctgaccgcgatcgcgggcggtctcgtcggtgcggtcgcgggcaacgcggtcggcgaaaacctcagcacggcgaacggtgtcgaaatcaccgtgcgcctcgacaacggcgatctgcgctcgatcacgcaggcagcaagcggcgaagcgttccgcgccggcgaacgggtgcgactgctgtcgagcggcggcgtcacgcgcgtcacgcactaacaggtacctcagctcgcggcgcaagccgcggtcgaacgcatgtgcgaagctgcacatgcgttttttcgtccgtactcgccgcggcccgcatacgggcagccggcacacaggctcccaggcacatcgacaaacacggacgaaaaatcccgccacctgagccagatggcgggactgattgagtagcgctactcaacccacggacaccatgtgagtgtccgggtggtacgggtcagcctcgattacggacggctgccggtcgggaacggccatgcagctgccgggttgagcgcggtcttcacgcccgatgccggcgcaaccgatgcggtcgacgcggtcgttgccggcgcagccttcttcacgacggccttcttcggagctgcagccttcttggccggagcagcagccttcttcgccggagcagcggccttcttcgcaggagcagcggcagccttcttcgcagcaggcgcagccttcttcgcggcagccttcttcgcaggcgcagccttcttggcagcagccttcttagcaggcgcggccttcttcgcagcagccttcttcgccggtgcggccttcttcgcagcagccttcttcgccggtgcggccttcttcgcagcaaccttcttcactgcgactttcttggctgcaaccttcttcgctgcggccttcttcgccggtgctgccttcttcgcagcaaccttcttcaccgcgaccttcttggctgcaaccttcttcgctgcggccttcttcgccggtgctgccttcttcgcggcaaccttcttcaccgcgaccttcttcgcagcaaccttcttcactgcagcagccttcttcgccggagcagcagccttcttcgcaacggtcttcttggcagcaactttcttagcagccggtttcttcttggcggtagccatgttgttctccttcaggttcagatgagagtcagttcaaactacacccttcgtcaaaacccgcttcccgcggacgctgttcaggacgtgcgcttcgaagcgggctattcatcggcgtacgcggataccacgcgcttacgctaatgaatacggtatggcgcgcgtgaccacccggcctcgcgcgccaaatcgtcggtagccggcgcacctcgcgccgctacccctaatcgcttgatcaagcggaccgccacacggccgtccgctttttccggagggaagtttgcccatcccactgaagggttcgcaaagtgcctgtcgtgtcgttgggccgttaaggcaccgggcatgctttgcatcaggcgttcttgctcctaaaccttgggccggggccgagaggccaccggctgctcacatcatgtgacgggttcgctgctgcgggttattcccaggacagcgcaccgcccgtctgatactcgatcacacgcgtctcgaagaagttgcgttccttcttcaggtcgatcatctcgctcatccacgggaacgggttttcctcgttcgggtacagcggatcgaggccgatctgctggcaacggcggttgctgatgaagcgcaggtagctcttgaacatcgacgcgttcaaacccagcacgccgcgcggcatcgtgtcttcggcgtagcggtattcgagttcgacagcctgcttgaacagctcgcggatctcggcgcggaattccgcggtccagagatgcgggttctcgagcttgatctggttgatcaggtcgatgccgaaattgcagtgcatcgactcgtcgcgcaggatgtactgatattgctctgcagcacccgtcatcttgttctggcggccgagcgcgaggatctgcgtgaacccgacatagaagaacaggccttccatgatgcaggcgaacacgatcagcgacttcagcagcttctggtccgcttcgagcgtaccggtcttgaaggccggatccgtcagcgtgtggatgaacgggatcaggaattcgtccttcgcgcggatcgacgtgacctcgtggtacgcgttgaagatctcgccttcgtcgagaccgagcgattcgacaatatattggtacgcgtgcgtgtggatcgcttcctcgaacgcctggcgcagcaggaactgccggcactcgggcgccgtgatgtggcggtacgtgccgagcacgatgttgttcgccgcgagcgaatcggccgtcacgaagaagccgaggttgcgcttcacgatgcgacgctcgtcctcggtcagaccgttcgggtccttccacagtgcgatgtcgcgggacatgttgatttcctgcggcatccagtggttcgcgcaacccgccagatacttttcccacgcccacttgtacttgaacggcaccagctgattcacgtcagtctggccgttgatgatgcgcttgtcggcgacattgacccgcgcttccgaaccgccggcgggaacagccgatgcttgcggcggcaccgcaagatcgccttcgaaaatgtcacggacctgatgggcggcaggcgttgcagcctgcattccgacagccatcccggcggaggtgcgcattgcgttttgctgcgctccgctcgcgggggttacggcagtcttctcgtcatcccagttgagcataaattctcaccatcaatttagaacggtttgtaccatcttttcctgagcgataaaagggttcgctcacgaaaatcctttttcgattcgcgttgcgacctcgatacaacactttgagcaacgcatcgtcattcatgcagcgcgcgatgtgagtcgcgcgtgtatcgcgaggtgcgctcgacgcatcgaacgctgatcgaaacacgacgtcgtcggggatgtttcgatcgcttgtcactgcctgcaacgcaggtgccgcgttacagattccttatcatttttagttgagagcggcgcacacttcaacctcgatcggtcgtcgtgtgcgccgcccttgcctgcttctcaggtcaggcgcactgcgttactggcacgcttcgcattcgtcgaagccaggatcgcccggacgcatcgtgcacaccggaccatccgcctcgaccggcgcaagcgccggcgctgcgttgaccgcgcccgacgacgcatcgccgcccgccgcaccaaagccgcccgctgcgccttgcgcgccgccgctgctcgagccgccgctcgtcggcactgcgttcagtgcgccgtgcgcgaccgtcgatttctcgacgtgcgtcgccgccatcgtgcggaggtagtaggtcgtcttcaggccgcgcaaccatgcgagcttgtagacctcgtcgagcttcttgcccgacgcgccgcccatgtagatgttcagcgactgcgcctggtcgatccacttctggcgacgcgatgccgcttcgaccagccacgtcgggtcgacttcgaacgcggtcgcgtagatcgcgcgcaggtcggccgggatgcggtcgatgcgcgacagcatgccgtcgaagtacttcaggtcagcgaccatcacttcgtcccacaggccgcgttccttcaggtcgcggacgaggtactcgttgaccaccgtgaattcgcccgacaggttcgacttcacgtacaggttctggaaggtcggctcgatacaggccgacacgccgatgatgttcgagatcgtcgccgtcggcgcgatcgcgacgcagttcgagttgcgcatgccgtgtgcggcgatccgcgaacgcagcgacgtccagtcgagcgactccgacgtgtcgacctcgacgtagccgccgcgcgcttccgtcagcagcttcagcgtgtcctgcgggaggatgccgcgatcccacagcgagccgcggtagctcgagtagcggccgcgctcttcggccagctcggtcgacgcgtagtacgcgtagtagcagaccgcttccatcgaacgatcggcgaactcgaccgccgcttccgacgcgtacggcgtgcgcagcaggtgcaggcagtcctggaagcccatgatgcccatgccgaccggacggtgcttcaggttcgagttacgcgccttcggcaccgcgtagtagttgatgtcgatcacgttgtcgagcatgcgcatcgcgacgctgatcgtgcgcttcagcttctcgtggtcgagcgcgtagctgccgtcggcctgcttcaccaggtgggcgacgaggttcaccgagccgaggttgcacaccgcgatttcggtgtcgctcgtgttcagcgtgatttccgtgcacaggttcgacgagtggacgacgccgacgtgctgctgcggcgagcgcacgttgcacggatccttgaacgtgatccacgggtggcccgtctcgaacagcatgccgagcatcttgcgccagagttgctgcgccgggatcttcttgaacagcttgatctcgccgcgcgcgaccttctcttcgtaagccgtgtaagccttctcgaaatcggcgccgaacttgtcgtgcaggtccgggcaggtcgacggcgagaacagcgtccagtcggcgccttccatcacgcgcttcatgaacaggtcgggaatccagttcgccgtgttcatgtcgtgcgtacggcggcggtcgtcgccggtgttcttgcgcagctcgaggaattcctcgatgtcgaggtgccacgattcgaggtacgcgcagaccgcgcccttgcgcttgccgccctggttcaccgcgacggccgtgtcgttcacgaccttcaggaacgggaccacgccttgcgacttgccgttcgtgcccttgatatgcgagccgagtgcacgcacgcgcgtccagtcgttgccgaggccgccggcgaacttcgacagcagtgcgttttccttcagcgcttcatagatgccgtcgagatcgtccgcgaccgtcgtcaggtagcacgacgacagctgcgagcggtgcgtacccgagttgaacagcgtcggcgtcgaactcatgaagtcgaagctcgacagcacgttgtagaactcgatcgcgcgcgtctcgcggtcgatctcgttcagcgacaggcccatcgcgacgcgcatgaagaatgcctgcggcatttcgatgcgggtgccgtcgacgtgcaggaagtagcggtcgtacagcgtctgcaggccgaggtagccgaactgcaggtcgcggttcgcgtcgagggcttcgccgaggcgcttcaggtcgaactgcagcagcttgtcgtcgagcaggccggcgtcgacgccgcgcttcaggaactgcgggaagtattccgcgtaacgggccggcatctcggcctggacgacttcctcgccgaggatctcgcgacggatcgtgtgcagcaggatgcgggccgtgacctggctgtatgccgggtccttctcgatcatcgtgcgcgctgcgaggatcgccgagtcgtagacctggctcatcggcacgccgtcgtacaggttcttcaccgtttcggcgacgatcgggtcagggttaaccgcagcgccgaggccgtcgcatgccgacacgatcagcgcgcgcagcgcgttcaggtcgagcggacgcgtgacgccattgtcgacgacgttgatgccggtgctcgactcgccgcccgctgccgccgcttcctcgcccgcatgctggcgctcgaggtgacgcttctcgcgatacagcacgtacgcacgcgcgacgttgtgctcgccgccgcgcatcagcgcgagttcgacctggtcctggatgtcttcgatatggaacgtaccgccgttcgggcggctgcgcacgagcgcgcgcacgacgttgtgcgtcagctgttcgacctgctcgcgcacgcgcgccgatgccgcgccctgcccgccattgacggccaggaaagccttggtcaccgcgatcgcgatcttcgaaggttcgaacgatacgacgctgccgttgcggcggatcaccttgtagtcggcgaacgtggcctgcggcgcgagcgccttcgcgccctgttcggtcccgccgagcggacggctcgaggcgctctcgtactgggacgtcgcgttgtcggtggtttgcatgtgcaaagctcctggtgttggatggtgcggagagaaccgcggattaaaacgaacgctgcgcaacgcggtgcgcgagcggtaagaggcgagcgatgcgccgggaagccggttcggtcgatgcgcgacaaccgagccggtcgtgtgcttcgtcatgtataccctgccccgtcgaagttcgctgcgctgatcgcgacgcccggaccgcccggcctgacgcgccgccctgagaaccctgtccgccagcgttggccgccggccggtgccgctcgggtttccctgcgacacacactatatctagtgcagaactgctcaactggcaccaagtatagtggacattcggaggacgtccaaacggataatttacgatggaggtcttgacatcgctcacgcgcagacacgacaaggcattggtcggagaaaaactttctccggtcaaaaaccccgcgatcagtgctgacggaaaggaaagtattcggcggaaaacccggcatcgctcgcgaagcgttgccaatcgaaatgcgggcccgggtcggtcttgcggcccggcgcgacgtccgagtgccccgcgaatgcgtcgaccgggtagcgtgcggcgagcgcgcgggagagtgcggcgagcgtcgcgtactgcgcgtcgtcgaacggcacgtcgtccgcgccctcgagctcgatgccgatcgagaagtcgttgcagcgcggccggccgaagaattcggacgagcccgcgtgccacgcacgctcgtcgcacgacacgaactgcacgagttcgccgctgcggcggatcaggaagtgcgcggacacgcgcacgccgcgcaggtggctctggtaataggggtgcgcatcgcagtcgaggcgattcaggaacagtgcctcgatcgcgtcgccgccgaactcgccgggcggcaagctgatgttgtggacgacgacgagcgtcggcaccgcgcccgcgggccgcacctcgtaattcggcgacggcgcgtggcgcgcttcgcgcacccagccgtgtacgtcgaccgacagtcgtgctgcgtcgttcatcgggcgtcgtggccgctcgcgcgtgcgccgtggcgctgcgcgtgctcggtgctgcagaagtattcgccgcccgcgacgacggcatcgcccttcggcgcatgcacgccgcattcggcgcagcgcaccatcggctcgggcagcgagcgagcggcgtcgccgttcggccgcgcagctccggggccaccagcgccgggcgcgccgtcgtaaccggcgccgcggccggtgcgcgcctgcgcgtgctcctgcgcgtgctcctgcgcctggcgcagcttgcgcgcgagccacgaacccgcgaagaagagaaggatcaggagaagaatctgtcgcatcggaaacctgcgttcaaaccacggaacggtgcagcagcacctcgaaaacgaaccggctgccgacatacgcgagcagcagcgcggcgaacgacacgagcacccagcgcgcggcaccgcggccacgccagcctgacgtcttgcgggcgaccagcaggccgccgaacatcagccacgacaggatcgcgaatacggtcttgtggtcgagccgcagcgcgcgcgcgtcgacctgctcgctgaacaggatgcccgacgcgagcgtcagggtgagcagtacgaagccggcgccgatcaggcggaacagcagcttctcgagcgtgagcagcggcggcagcgtctcgagccagctcgcgatccagcccgtcgagccgtcgcgtccgccgctcctcagcgactgcaggcgccgctcgaccatcagcatcaggatcgcgtgcagcgcggcgatcgcaaacagcccgtatgcgatgttcgcgatcaggaagtgcagcttgaacagcggcgctgcggcataaggaagcacccgcacgccgccgaacacgagcggcagcagcgacgcaccgcacgcgagcggcagcacgagcagccgcaggctgtcgagcgggaagaagaagctctcgatccagtagatgccggcgccgagccagaacatcgcggacagcgcaaacgcgaagccgaacaccatcgcgtcgtgcgggaagatggtcgtatggagcagcacgccgtgcgcgacgagcgcggcgaacagcagcgcgcggccggccccgctcatcccggacgcggcggacgcgggaaccggcacggccggcacgctcgcgacgagcggcgtcgcgccctggcggtgcgtgcgccagcctgcgacggcaaggccgccgtacaggaatgcggtgagggcatacagtacaatatccatgttcgaagtttacactaggcccccttcccgcgacggctccctttgttcggttccgccgcgccttcgggccccactgtccatcgctccccatgctcgacaatctcactcaacggatggcgcgcgtcgtcaagacgctgcgcggcgaggcccggcttaccgaggcgaacacgcaggagatgctccgcgaggtgcgtctcgcgctgctggaggccgacgtttcgctgccggtcgtccgcgaattcatcgccaaggtcaaggaaaaggcgctcggcgaagaagtgatcagcagcctgtcgccgggtcaggcgctcgtcggcgtggtccagaaggaactgaccgccgtgatcggcggcgactacgaaggcaaggccgccgagctgaacctcgcggtcacgccgcccgcggtgatcctgatggccggcctgcagggcgcgggcaagaccacgaccgccggcaagctcgcaaagctgttgcgcgagaagtacaagaagaaggtgctgaccgtgtcgtgcgacgtgtatcgcccggccgcaatcatgcagctgaaaacggtgagcgaacaggtcggtgccgacttcttcccgtccacgccggaccagaagcccgtcgacatcgcggtcgcggccgtcgactgggcgaagcgccactaccatgacgtgctgatcgtcgatacggccggccgcctcggtatcgacgaggcgatgatgcaggaaatcgccgcgctgcacggcacgctgaagccggccgaaacgctgttcgtggtcgacgcgatgctcggccaggacgcggtcaacaccgcgaaggcattcaacgacacgctgccgctcaccggcgtcgtgctgaccaagctcgacggcgattcgcgcggcggcgccgcgctgtcggtacgtcacgtcacgggcaagccgatcaagttcgtcggcgtggccgagaagctcgacggtctcgaggtgttccaccccgaccggatggcaaaccggatcctcggcatgggcgacatcctcgccctcgtcgaggaggcgcagcgcggcgtcgacgtgcaggccgcgcagaagctcgccgacaaggtcaagaaaggcggcgacttcgacctgaacgatttccgcgcgcagatctcgcagatgaagaacatgggcggcctgtcgtcgctgatggataaacttccggcgcagttccagcaggcggcggccggcgccgacatgggtcaggccgagaagtcgatccgccggatggaaggcatcatcagctcgatgacgcccgccgagcgcgcgaaacccgagatcatcaaggcgacgcgcaagcgccgcattgcagccggcgcgggtgtgccggtgcaggaagtcaaccggatgctgaaccagtacgaccagatgcgtacgatgatgaagaagctgaagggcggcaacatgcagaagatgatgcgcggcctgaagggcatgatgcccggcatgcgctgattccgcccatcggccggcgcgcgggtttttgctgtagcgcgcgccgtccgttctgcttcattcttatttgtataccgactgcccgccagaacacatgaaccgcgaagaagccctccacattttcaaccactccgaagagatcgtctcggccgacgccgtcaacgcgtcgatctcccggatggccgacgcgatccgcgccgagatcggcgacgcgttcccgctcgttctctcggtgatgggcggcgccgcggtgtttaccgggatgctgctgccgcatctcgatttcccgctcgaattcgactacatccacctgacccgctaccgcaacacgacgcagggcagcccggaaatgcactggcgcgtcgcgccgcgcgaatcggtgaaggaccggatcgtgctcgtgctcgacgacatcctcgacgaaggcgagacgatggccgcgatccgcgaccgcatcctcgacatgggcgcgaagcgcttcatgtcggccgtgctgtgcgaagacgctcgcgaaagcgaagccgctgcaccccgacttctgcggcttcgcggtgccggatcgctacgtgttcggctgcgggatggatgcgaagggctactggcgcaacctgccgacgatccgcgcgctgaccacgaacgtctgagcgccccgctccgcactatataaatagaaagcggcgctccggtttcccggagcgccgctttttgtgagcacgcgccgcccgcctacagctggtgcacgaatgcgcggatgccgcccagcatcatctcgaccgaaatcgcgacgagcacgaggcccatcaaccgctcgaacgccgcgacggtccgttcgccgatccattgctggatccgctcggccagcaccagcgtcaccgcgcagacgatcatcgtgaccgtcagcgcgccgacccactcgagcatcttgccgggcccctgcgacgtcagcagcatcaccgtcgcgagcgccgacggcccggcgagcgccggaatcgcgagcggcacgatgaacggctcgccgcccgcgcgcggatcgttgccgagtgcgccgtccggatgcgggaagatcatccgcagcgcgatcaggaacagcacgatcccgccgccgagccgcaacgacaggtcggtgaggctcatcatccgcaggaagcggtcgccgaccagcatgaagaacagcaggatcacgaacgcgatccccacttcacgcaagatcagcttcacgcgccgctcgcgcggcacatcccgcatggccgaaatgaacagcgggatgttgccgagcggatcggtgatcagcaccaggagcacggtggccgacaggaaggtgtattccaccgcgttcccggtcggtgcgcttagcgcgcgagcgcggcgcggatcttctccgcgaccgtcgccgcagccgcgtcggccggcagcagcgtcgcttcggcgtcgcggcggccctgatactcgatcttgccttccttcaggccgcgctcgccgatcacgagacgatgcggcacgccgatcagctcccagtcggcgaacatcacgcccgggcgctcgccgcgatcgtcgaggatcacgtcgatgccggctgcggagagttccgcgtacagcttgtcggcggtctcgcgcaccatgtcgctgcggtcatagcccatcgggcacagcacgacttcgaacggcgcgatcgattcgggccagatgatgccgcggtcgtcgaagttctgctcgatcgccgcgccgagaatacgcgtgacgccgacgccgtagcagcccatcagcatgggctgcggcttgcccgactcgtcgaggaacgtcgcgcccatcgcttccgaatacttggtgccgagctggaacacgtggccgacctcgatgccgcggcagatgtcgatcacgcccttgccgtccggcgacgggtcgcccttcttcacgttgcgcacgtcggcgacgtccggctcgggcaggtcgcggccccagttcacgccggcgatgtgatagtcgacctcgttcgcgccgacgacgaagtcgctcatgttcgcgaccgtgcgatcggcgatcaccttcaccggcttcttggtgccgaccgggccgagatagcccggcggcgtgccgaaccactcgacgatttcctgctcggtcgcgaagcggtggttcttcaggcccggcagcttcgacaccttgatctcgttcaggtcgtggtcgccgcgcagcatcacgagccagatggtcggctcggcgccttcgttgtcggtcgcgagcacgatcgacttgatcgtgcgctcgagcgggatggccagcagttcggcaacggcttcgcatttcgccttgcccggcgtcgcgaccttcgccatcgcctcggccggcgccgcgcgttcggcgctcagcggcagcgcttcggccgcttcgacgttcgccgcgaactcggacgtcgggcagtacgcgatcgcgtcctcaccggtgtcggcgatcacgtggaattcgtgcgagaagttgccgccgatcgagccgctgtcggccgcgaccgcacggaactcgaggccgaggcgcgtgaagatgcgcacgtacgcgtcgtacatcttgcgatacgactcgttcaggccggccgcatccttatcgaacgagtacgcgtccttcatgatgaattcgcggccgcgcatcacgccgaagcgcggacggatctcgtcgcggaacttcgtctggatctggtagaagttcaccggcatctgccggtaactcttgatctggttgcgcgcgatgtcggtgatgacttcctcgtgcgtcggcccgatcacgaagtcgttgtccttgcggtccttgaagcgcagcagctcggggccgtactgttcccagcggcccgactcctgccacagttcggctggttgcacggccggcatcagcagctcgatggcgcccgcccggttcatttcctcgcgcacgatcgcctcgaccttgcgaatcgaacgcaggccaactggcaggtagttatagataccgccggcgacgcgacggatcatgccggcgcgcaccatcagcttgtggctgacgatctctgcgtcggcgggtgcttctttcagggtgccgataaagaaacgggaagctttcatgcggacggttccaaaacggcgccccaggcggggcgcccgaaaaagtttcaaggtgaaaaagctgcgcgcggcgaacagcaatggacgacgatggcgcagacgacgtagcagactaatcagggacaattcagccggtgtaccccgcgcggattcgctccgctacggtgcgcagcgcccgttatctgtttataatcaaagcaattttaaaggattcgaaggtggttgtatgctggatcgtgaaggctttcgcccgaacgtcggcatcatcctcttgaacgcgcgcaacgaggtgttttggggcaagcggctccgcgagcattcctggcagtttcctcaaggtgggatcaagtatggcgagacccccatgcaggcgatgtaccgggaactgcacgaggaaacgggcctgcatccggaacacgtcaagataatcggccgcactcgcgactggttgcgttatgaggtgcctgacaagttcatcaaacgcgaagtacgcggtcattaccgcggccagaagcagatctggttcctgctgcggatggttggacgcgattgcgacatttgcttgcgcgcgaccgaccacccggagttcgatgcgtggcgctggaacgagtactgggtgccgctcgatgcggtgatcgagttcaagcgggatgtctatcagttggcgctgacggaactgtcgcgcttcctgcgccgcccggcgcagcgagccgagaagccgcgtgggccgcgtctgtcgcgctatccgcgcgtcatcggcgcacaggcccagcagacgctgacgattgtcgacgcatcggtagtctgttcggagatcgaagtggaagcgagcacgctcgacgagatgccgccccgcgtgatcgtcggcaaatgacgaatcgaactgcatgaccgggcgcgaccttggtgtcgcgccctttttacgaggaatgcatattgaaagcgattgctctcgcgctcgcatcgattgccgcggtggccacgctggcaggttgcgcgaattcgaagacgccgaccaacaaggatgacagcgagttcgtgtatctgctggaccgccagggaacctggaaggaaaacacggtcgactcgctgccgccgctgccgcaggcaagcgacctgctgccgttcaacgtctcgcagaacacgccgctcaagttcttcgtcgatgcgaagtcgctcgcggtcggcaccgacggcgtcgtgcgctacgcggtcgtcgtcacgagcccggccggcgcgcgcaacgtgaactacgagggcatccgctgcgacacctacgaatggcgccagtatgccggcctgaattcggaccacgacggctgggatcgcacggtcgagaacgattggcagcgcatcgagaacggcgagctgaatgcctaccactcggcgctgtatcaggattacttctgcgcgaacaagatgccacaaggctcgacccggcagatcctggagaacatccggtttcaccgtaccgcgatgagccagttgcgctgatggcgcgcggcgcccgccgccgctctttctgcccgctgcatgaaaaagcccgcatcacgcgggctttttcatttgacggcctgaaccggcaaggcgaatgatcacaccagcaccagattgtcgcgatggatcagttcgggctccagcatgtagccgagcacggattcgatctcgccgctcggcttgcggtgaatcagtttcgtctccgcgctgctgtagttcgtgagccctcgcgccacttcgcgcccgtcggggccgacacacgcgatgacttcgccgcgcgcgaacgcaccctgtacgtcgatcacgccgatcggcagcaggctcttgccgccggccgtcagtttctcgaccgcgcccgcatcgatcacgacatggccgcgcacctgcaggtgatcggccatccactgcttgcgcgccgccatccgcgcggtacgtgcgatcagttgcgtgccgatcgcctcgccggccgccagacgcacgagcacgtcggactcccggccgctcgcgatcaccgtatttgcaccgctgtgcgccgcgcgcttcgccgcgaggatcttcgtcagcatcccgccgcggccaaggctcgagcccgcaccgccagccatcgcctcgagttccggcgcgccggcattcgcttccgcgacgagcgtcgcgttcggatccttgcgcggatcggccgtaaacagccccgactggtcggtcaggatgatcagggcatcgccttcgatcaggtttgcaacgagtgcaccgagcgtgtcgttgtcgccgaacttgatttcatcggtgacgaccgtgtcgttctcgttgatgatcggcacgacgccgagcctcaacagcgtcagcagcgtcgatcgcgcattcaggtagcgctcgcggtccgccaggtcggcatgcgtcagcaggatctgcgcggtgcggatgtcgtgctcggtgaagcggctctcgtagacctgcgcaaggcccatctggccgaccgcggcggccgcctgcaactcgtcgatttcccgcggccgcttgctccagccgagccgctgcatcccttcggcaatcgcgcccgagctgacgagcacgacttccttgccctgggcgcgcagcgcggcgatctgggccgcccagcggccgattgcagcatgatcgagccccttgccgtcgttggtcacgaggctggagcccaccttcaccaccaatcgcttcgaatccgcgatgatcgaacgcatcctgcactgtctcctgtatctgatgcctgcccggccgggcgcgattgagcgccgacgccgggcggcacgcccggcgcgctccggaaccactcaggcgtcgtcgcccggcacggcctcgcccttcgcaggcggtgcgtcgcggaaacgcacgtccgccgcgagatcttccgcctccgccgcgcgatgcgcgtccgaatgttcggagaggtagtcgtagatcgcgtagcacagtgcttcacagccctggcccgtcagtgccgaaatctcgaacaccgggccgtcccactcgaagcgctcgaggaaatccgcgacgcgcgccttgcgctcgtcttccggcaccatgtcgagcttgttgagcacgagccagcgcggcttctcgtagagcgcctcgtcgtatttgcgcagctcgccgacgatcgccgtcgcttcggcaaccggatcgacgctttcgtcgaacggcgcgagatcgaccagatgcagcagcacgccggtgcgctgcaggtggcgtaggaactgatggccgaggcccgcgccttcggcggcaccctcgatcagccccggaatgtcggcgatcacgaagctcttgctcgggccgacccgcaccacgccgagattcggcgcaagcgtcgtgaacgggtagtcggcgatcttcggccgcgcattcgacaccgacgagatgaacgtcgacttgcctgcgttcggcatgccgagcaggccgacatcggcgagcaccttcagctcgagcttcagcatgcgacgctcgccgggcttgccgtccgtcttctggcgcggcgcgcggttcgtgctcgacttgaaatgcaggttgccgagcccgccggcaccgccctgcgcaagcatcacctgctggtcgtgctcggtcaggtcggcgatcagctcgccggtatccatgtcgctgatgatcgtgccgaccggcatgcgcagcgtgacgtcgtcgccacccttgccgtagcaatccgagcctcgcccgttttcgccgttgcgcgccagatgcttcttcgcgtaacggtagtcgatcagcgtgttgatgttgcggtcggcgatcgcgtacacgctaccgccccgaccgccgtcgccgccatccggcccgccgaacgggacgaatttctcgcggcgcatcgacgcactgccatcgcctccgtcgccggcgatgacttcgattcgtgcttcgtcaatgaacttcattcgtcactccgcccagtatttccgctattgtgccgcgcgccggcacgcttgaacaatctgccgttcggccgatcgtacgccggttgcgcaacggtcgccggaacgcgcatgcgcccggcggccaaataaaaaggccccgcgaagactgcggggcctttcggctacgaagcccgtgggtgcctgaattaggcagccgccgggacgacgatgaccagatgcttcttgtccgcgcctttcgtcgcgaacttgacgtgaccgtcgaccagcgcgaacagggtgtgatccttgcccatgccgacgttctcgcctgcgtgcatgcgcgtaccgcgctgacgcacgatgatgccgccggcattgattgcctggccgccgtacactttcacgccgagacgtttcgactcggagtcgcggccgttccgggaagagccgcctgcctttttgtgtgccatctgattgctcctttaccgaggcgcttacgcgttgatcgcgtcgatgcgcagctcagtgtagttctggcggtggccgccgtgcttttggtagtgcttccggcgacgcatcttgaagatggtgaccttggcatgacgaccgtgcgacacaacggtggccttgacggaagccccactgaccagcggcgtaccgaacttaatcgattcgccttcgcccactgcgagaacctggtcgagcgtgatttcagcgtcaatgtcagccggtatctgttctactttgagtttttcgccaacggcaaccttgtactgcttgccgccggtttttatgaccgcgtacattgagaacctcactctggatccaatttttccgcacaccacgcgcggaaaacacgtgattatacatggagttagcaccgaagtcaaaaccgatcgacgattgccgcgcgcgggcctcggccgaacggccaaattcgcggctgcggcacgtgtgacagaccgggatatctcggattcgacttataatccgcggcatcacccaattccatcatcatgtcgtcgtccaccgcctccccaccctcagcgccgcccacctgctcgctccgatcaccagcgacatggagcaggtgaatcgcgttatccggcaaagcctcgcgtccgacgtactgttgatcaaccagatcgccgagtacatcatcggcgcgggcggcaagcggctgcgcccggcgttgctgctgctcgtcgccggcgcactcggcgagacgtcgcaccagcggcacgtgctggccgccgtcgtcgagttcatccacacggccacgctgctgcacgacgacgtcgtcgacgaatccgagctgcgccgcggccgccagaccgccaatgcactgttcggcaacgcggcgagcgtgctggtaggcgactacctctattcgcgctcgttcgaaatgatggtcggcgtcggcaagatgcgcgtgatggagatcctgtccgaagcgacgacgatcatttccgaaggcgaggtgctgcagctcctcaacatgcacgacgcggacgtcgacgaaacgcgctacatgcaggtgatccgctacaagacggccaagctgttcgaggcatcggcgcgcctgggcgcggtgctcgcgggcgccgatgcgccgaccgaggccgccgccgccgaatacggccgccgcatcggcaccgcattccagatcatggacgactggctcgactacgcgggcaccgtcgaggcaatgggcaagaatgccggcgacgacctccgcgaaggcaagccgacgctgccgctcatctatctgatcgagcgcggcacgcccgagcaggcagcgctggcacgcgaggcgatcgaacagggcggcactgatcgcttcgacacgattttcgaagcgatcacgcgctcgggcgcactggatcacacgctcgaatgcgcgcgccaggaagcgcaggcggcagcggcagcgatcgcagcattcccgattcgatctacaaggagagcctgctcgcgctgtgctcttactcgacgtcgcggcagtcctgattgcatgtcgtgtgtcgccgccacggctgcgacacacgttcgacacgggaaaatcacccgtctcgaaaaatttttctccaagggcttcccttcttgaagaaacgtcgttatagttatgttcttgcttgacgacgcagcggtcttgaagaagacggcgaaatcggaaaagtacaaatcggggtgtagcttagcctggtagagcgctacgttcgggacgtagaggccggaggttcgaatcctctcaccccgaccagattttgaaaaaccgtgcaccacgtgcacggtttttcgtccggccgccgcgggcctcgtgtcgcgcacgacacatcacggtcgccggcctctgctatattccctccatccctgtccttcactgctccttccaacgcgtggaccaaattcccttatgggcgcaaatcggcgccgtcttcctgcttctcctctgttccagcttcttttccatttccgagaccgcgatgatggcgctcaaccgccatcggctgaagcatctcgccggccagggcgcgctcggcgcgaaaaccacgcaggggctgctgacgcgcactgacctgctactcagcgtgatcctgatcggcaacaacctgttcaacacgatcatcccggtcctgacgacgtcgctcgcgctccatacgttcggccgcaacaatctcgcgctgtcgatcgcgaccggcatcgtcgcgttcctgatcatcgtgttcgcagaaatcgcgccgaagatcgtcggcgcgacgttcccgaacgcatcgcactgcccgcgagcctcgtgatcgcgccgctgatgcgcgtgttcaagccggtcgtctggttcgtcaacgcgctcgcgaacggcgtgctgtgggtgctgcgcatcaacacgaagaagggccgcgaccagcggatgtcggccgacgagctgcgggccatcgtgctcgagtcgagcagtttcatgccgaccaagcaccgcagcatcctgctcaacctgttcgacctcgagaacatcacggtcgacgacgtgatggtgccgcgccgccagatcgagtcgctcaacttctacgcgccgctcgacgacgtcctgcaccagctcgaaacctgctatcacaaccggcttgtcgtctacgaaggcgacatcgacaaggtgctcggcgtgctgcacgtccgcaagacgctgaccgcgctgcacaaccaggagttcgaccgcgagacgctgcgcacgctgctcgccgagccgtactacgtgccgtcgggcacgccggtggtccagcagctccagtttttccaggaaacgcggcagcggaccgcgctcgtcgtcaacgagtacggcgaactcgaagggctcgtcacgcccgaagacatcatcgaggagctgatcggcgaattcacgacatcgatgccgcgcagcgaacgcgcgggcggctgggacgagaacggcgaatgcatcgtctcggcgagcatgccgctgcgcgaactgaatcgctggctgcacctgaagctgccgaccgacgggccgaagacgctgaacggactggtcctcgaaatcctcgaggaaattccggaagacgacgtgtgcctgaaaatcggcgacgtgatgctcgaggtgatgcgcagcgacgatcaggccgtgcgcaccgtcaagctcttcaagccgcgcggctcgcgcaccgcacgcgccgccgcgcgttagccgaacggccgactgccggcgccgcccgcgacgcgcgaccatctgctggtcacggtcaactggcggccagcgtgccggctcacatgcatttcactcctcccgggcgccgctgcgcacgcagccgccgcccgctcattccgatgcgtcgcccgtcaccgcaccgcgcgcgctcgacgcggcccagctcgacgacgcgccggctgtgcggctgctgacggacacgcttcacgcagcacgcgtgcgcgacgcatccgacatccacgtcgaaccgttcgaagccggctggcgcatccgcctgcgcatcgacggcgtgctgcacgaacatgcgcggccgcctcttcatctgcgcgacgcgctcgtcacgcggatcaaggtgctcgcacgcatggacatcgccgagcgacggctcccgcaggacggcaggctgcgtatcgcgatcgacggcggtacgcgcggcgactaccgggtcagttcgctgccgacgttgttcggtgaaaaactcgtgctgcggcgcctcgaaaccctgccgaccgacctcacgctcgcccgtctcggcttcgacgcgcaacaggcggccgcgatggaagccgcgatacgcgcaccgcatggcctcgtgctcgtcacgggcccgaccggcagcggcaagacgctgtcgctctactgcgcgctgcagatgctcgatcgcgacgcgcacaacgtctgcacggtggaggatcccgccgagatccagctcgacggcatcagccaggtcggcgtcgccgaaaaggcggggctcacgttcgcgacggcactgcgcgcgctgctgcggcaggatccggacatcatcatggtcggcgagattcgcgatgcggagacggccgacgtcgcgatcaaggccgcgcagaccggccatcttgtgctgtcgacgctgcacacgaacgacgcgccggccgccgtcgcgcggctgctcgatatcggggtcgctccatacaacctcgcggccgcgctgcacctcgtcaccgcgcagcgcctcgtccggcggctgtgcaccgcctgccgcatgcactcggacgcaccggtgcccgtattgcgcgaagccggctgcgacccggttgcgctcgccgcaggatggcggccgttcgtcgcgcgaggctgttcggcctgtcacggcatcggctatcgcggccgtatcggcctgcatcagacgatgccggtatcgccccggctggcggaacgcatcgtcgcccgggcgagcgtcggcgaactcgcgcaatgtgcggcggccgaaggcgtgcgcagtctgcgcgacgcggcgttcgcgcgtgtccgggacggcacgacgagcatcgcggaagccatcgccgcaacacctgctgcatgagcatgcgcacaacgccgcgcgaaagccgcttcggatggcgcggccgccatcgcgacggcacgccacgccgcgggatcatcatcgcgttcgacgccgcgagtgcacgcgccgcactcgcgcgcgacggcatcgcagtcttgtcgctcgacatccgcgggccggcccggccgccaatggccggcacgcgggacgtcacgcgcttcacgcgtcagctcgcgagcctgctgcaggccgggttgccgctcgcgccgtcgctcgagatgctcgcgcgcacgcggccgcgcgacggcctgccgcgaatcgccgccggtctcgcccgcgagatcgtcggcggccatcgcttcgccgatgcactcgcacgctatccggcgcagttcggcacactgtatcgccagctgatcgaggtcggcgaagcgtcaggctcgctcggcatcgtgctgacacgggtcgcggagcaccgcgagcgcgccgacgcgcaatggcgcaagctgcgggccgcgcttgcctatccggcggccgtcatcctgttcgggctcgcaatttcggccgcgttgatggtgtgggtcgtaccgacgttccgccagatcttcgacggcttcggcgccgcactgccggcaccgacccgtgcgctgctcgcgttgtcctcggcactgtcggcgtggggcggtgtgctggttgccggtacggcgacagccgcgctggccgcccatcgcgcgctacggctatcggcaccgctgcgccacgctgtcgcgcggcgcctgctgcacgtcccgctcgcggggagcgcgatgagccggttcgcggccgcgcgctggtgccgatcgctggcgacgctgctcggcgccggcgtgcctctcgcagacgccttcgccacgctcgaacgcacggccggccatcccgtgttcgagcgcgccaccgcccacatcgccgcccacgtgctgcgcggcgcgcgtctcgcggacgcgatgcagtcggccggctgctttccggacgacgtcgtgcaaccgatcgccgtcgccgaggagaccggtgcgctcgacacgatgctcgccgacatcgccacgctgtgcgagcgccagctcgacgcgcatctcgatacgctcgccgcgctcggcgaaccgctgatcgtgatcgtactgggcgcactcgtcggcggcctcgtgatcgcgatgtacctgcccatccttcagctcggcaacgtggtgtagcatcgcaaccgattctgtcgccttttagtccgaaccttgagcctcatgacacccgcgcccttgtccgccgtttccgattcgcccgagagcacgctgctcgcgctggcgatgctgccggccgcactgcagtacgcgttcgcggtcatcatcggcctgtgcgtcggcagcttcctgaacgtggtcgtgcaccggctgcccgtgatgatgcagcgcgcatggcaggccgagatcgacgaagcgaccggcaacacgagtgccactcccgaagacggctacccgccgcgctacgacctgtggcacccgcgcagcgcctgcccgcattgcggccacgtgctgcgcgcatgggaaaacatcccgctcgtcagctacctgatcctgcgtgggcgctgccgacgctgcggccacgcgatcggcatccgttatccgctcgtcgagcttgcgtgcgcgctgctcgccgccggctcgctcgcggcattcggcccgaccgtcgccgcgctcgccgcgttcgcgctgtgcgccgcgctgctcgcgatgagcgcgatcgatatccggaccggctacctgcccgactcgatgacgctgccgctcctctgggccgggctcgtgctgaacctcggcggcacgttcacatcgctgcgttcggccgtgatcggggccatggccggctacctgttcctgtggtcggtctactggctgttcaaatggctgcgcggcatcgagggcatcggtttcggcgacctgaagctgctcgccgcgctcggcgcatggatgggctgggccgcactgccgcaggtcgtgctgttcgccgctgtgacgggcgcggtcgtcgggctcgtcgcgacctggcgcggtcgcatgcgcttcgaggagccgattccgttcggcccgttcctcgcggcaggcggtgtcgcgacgctgtttttcggcacccctttctattcggcgctcggaggctgacatgttcgcaattggactcaccggcggcatcggcagcggcaagacgaccgtcgccgacctgttcgccgcccgaggcgcatcgctggtcgacaccgatctgatcgcccatcgcatcaccgcgccgggcggcctcgcgatgcccgcgatcgaacaggcattcggccgcgacttcgttgccgccgacggctcgctcgaccgcgcgcagatgcgcgcactgatcttcagcgacgacgacgcgcgtcggcgcctcgaagcgatcacgcacccgctgatccgggcggagaccgatcgtgaggcgcgcgaagcgcagggcccatacgtgatgttcgtcgtgccgctgctcgtcgaatccggcaactggaaggcgcgctgcgatcgcgtgctcgtcgtcgactgtccggtcgaaacgcagatcgcacgcgtgatgcggcgcaacggcttcacgcgcgagcaggtcgaggcgatcatcgcgcggcaggcgtcgcgcgaggcccgcctcgcggcggccgacgacgtcatcgtcaacgacgcgacgacgcccgatgcgctcgccgcgcaggtcgatgcactgcaccaacgctatctcggattcgcggccaccgcgcactgagcctcgcgctcgatcgtgatggtgtacgaaattggcgcgttgctagggtagagcgtgggcattagaatgtcctgcattgtttcaatccctacccaagaggcgagcgcgcttgattctttacgagtatccgttcaacgagcgaattcgcacgctgttgcgcctcgaagatctcttcgagcgcttcgcgttcttttggctcaggaggacccgcgtgaacaccacgtcgcgctgacgacgctgttcgaaatcgccgaggtaacgggccgcgcggacctgaaatcggatctgatgaaggagctcgaacgtcaacgccagacgctcgcccctttcgcggcaatccgggcatcgagcagaacgcgctcgaagccgtgctcggcgaaatcgagcagacgctcgcgaatctcgcgcagatgcagggcaagaccgggcagcacctcgtcgacaacgagtggctcgccagcatccgcagccgtgcggtgattccgggcggcacgtgcaagttcgacctgccgtcgtactacgcatggcagcaatggcccgccgagcagcggcgccaggacatcgcgaaatggatcctgccgatgctgccgctgcgcgatgccgctgcgatcgtgctgcggctcgcgcgcgaatcgggccaggcgtcgaaggtcatggcgatgcagggcagctaccagcaaatgctgtccggccgcacctaccagttgatgcaggtgcgcgtggcgccggaattgcgcgtcattcccgaggcaagcgccaacaaatacatgctgtgggtacggttcaccacgcaggacggcgatgtgcggcctcgcgcggtggacatcgacgtgccgttccatctgacactgtgcaatctgtaacggccgcgtgccggatcgctttcgtatgactaccgttgtgaaatgcccgtcgtgtggcgccgaagtgcgctggacgcccgaaaatcagttccgtccgttctgctcggcccgctgcaagcagctcgacctcggcgcctgggccgcggaaaagtaccggatcggggatcctccgacgagggccctcatcggaagaagacggcacggacggccgccgcgacagctgagcggcgctcggcaccgtcagccggtgatgtggcccgcctttccggcaggccatcgtggcgtcagatcgacgcggcttccttctcgagcagttcaagcaccggcagcgcggccggcagcaacggcgcgacctcgaccggcagttgctgccatacgaacgcctgcccttccttgctgtgcggctcgcccgtccagcccgtcaccttgcagaaataaagccgcacataggcatgcggataatcgtgctcgagcgtgtgccagcgatggctggccgtgacctggatgccgagttcctcgtgcagttcgcgcgcaagcgcgtcctcgacgctttcgccggcctccagcttgccgcccggaaattcccagtagccttcgtacggtttgccttgcagccgctgcgcgagcagatagcggccaccaggctgcaccatcacgccgaccgccacttccgtcaccttgcggccatcgggcgcgcgcacggcgccttgtgcgagatccgcgctcatgcttgctccttgcgacccgaccagtcgcgcgcaaactgccacgcgacgcgccccgaccgcgagccgcgctcgagcgcccacacgagcgcatcgccgcgtgcggactcgatctccgcatccgggcaaccgaaatgacgcagccagtgcccgacgatgtcgagatagtcgtcctgcttgaacggatagaagctgacccacagaccgaagcgctccgacagcgagatcttctcctcgacgacttcgccggggtgaatctcgccatccgggagatgcttgtacgtctcgttgtcgctcatgtactcgggcagcagatggcggcggttcgacgtcgcgtagatcagcacgttgtccgactgcgcggcgatcgagccgtcgagcgccaccttcagcgccttgtagcccgactcgccttcctcgaacgacaggtcgtcgcagaacacgatgaagcgctcgggacgttgcgagatcaggtcgacgatgtcgccgagatcgtgcaggtcgtccttgtcgacttcgatcagacgcagcccgtccttcgcatacgcgttcaggcacgccttgatcagcgacgacttgccggtaccgcgcgcgccggtcagcagcacgttgttcgccggcttctgctgcacgaactgccgcgtgttctggtcgatcagccctttctggcgatcgatgttgtggaggtcgtcgagcgtgatcgacgacacggccggcaccggctgcagataaccgcgcccctggcgcttgcgccagcggaacgcgtgtgcggcattccagtcgaccgctgcctgcgcgggcggcaacatccctcgagacgaccgagcagcgcttccgcgcgcgtcagaaactgttcaagcttgtccatgtcgttcaggcactcccgatcaggagcggtaatccgcgttgatgctcacgtagtcgtgcgacaggtcgcacgtccagatggtggccagtgcgtcgccgcggccaagcagcacgcggatcgtgatttcgctctgcttcatcacgcgctggccgtcctcttcctggtaagccgggttgcggccacccgcctttgcgacgagcacatcgtcgagatagaggtcgatcttgccgacgtcgagatccgcgacgcccgcataaccgatcgccgcgagaatccggccgaggttggggtcggatgcatagaaggcggtcttcacaagcggcgaatggccgatcgcgtaagcgatctggcggcattccgcgacgctcttgccgccttcgacctgcaccgtcatgaatttcgtcgcaccttcgccatcgcgcacgatcagctgcgacagcacctgcgcgacttccgtcaccgcatcgcgcagcgccgcataggccggcgaatccgtcgacgtaatcgccggcagcgtgctcttgcccgacgcgatcaggatgaacgagtcgttcgtcgatgtgtcgccgtcgatcgtgatgcagttgaacgagcggtcggccacttccttcacgagcgtgtcgagcaccggctgcgcgacgttcgcgtcgaacgcgagaaagccgagcatcgtcgccatgttcggcttgatcatgccggcgcccttgctgatgcccgtcagcgtgaccgtgtgaccgtcgatcgtcacctggcgcgacgtggccttcggcagcgtatcggtcgtcatgatcgcctgcgcggcgtcgaaccagttcgcggccttgcggttcgcgagcgcggccggcagcccggccttcaggcggtcgatcggcagcggttcgaggatcacgccggtcgagaacggcagcacctgcgccggctcgatacccgcaaggcgggcaagttccgtgcaggtttcgcgcgcgttcgcaaggcccggctcgccggtaccggcgttggcattgcccgtattcacgacgagcgcgcgaatgcccgcaccgcccgcgcgcaccttcgccagatgctcgcggcagacgatgaccggcgcggcacagaagcggttttcggtgaacacgcccgcgaccgtcgcgccttcgtcgacggagatgaccagcacgtccttgcgattcggcttgcggatgttcgcttccgcccagccgagcgtgacgccggcgacgggatgcagttgggcgggatcgatcgacggaaaattgacagccatggggcacacctgccagatggaaaatgccggcgtgcgccggcatcgattggaagaaccggcggccgcatgcgcgggccgccgcaactcagatcacgcgctcgaagctgcgaaccgagcggcgcgcgtcacgcgcgccgccgtcgatcatgacagcttcccgtgacattgcttgtacttcttgccgctgccgcacgggcacgggtcgttgcggccgaccttcggcatttcaccgccggggccgctgtgcgtcatcgcgctgccgaccatgtcggccgtcgccgtggccgccgcggcagccgtgacgttcgccaccggcgcaccggcttccgcgtagtcggcgtgctggtactcgacgttctcgagatgacctgcgcgctcctcgatctgctcggccgcttcctcgagctgttccggcgactggatctgcacgttcatcacgacacgcgtgacttcctgcttgatcgcctcgagcatcgcggcgaacaactcgaacgcttcgcgcttgtattcctgcttcgggttcttctgcgcatagccgcgcaggtggatgccctggcgcagatggtcaagcgccgcgaggtgctcgcgccacaggcggtcgaccgtctgcagcatcaccgagcgctcgaatgcgctgaacgattcgcggccgaccatcgcgaccttcgcctcgtactgctcgtcggcggccgtcatcacggcgtcgagaatctcctcggccgtaatcgacgacgactcgttcaccatttcctggatcgcgaggtcgagctgccagtcgttgcgcagcgcttcctcgagctcgggcacgtcccactgctcctcgatgctgccttccggcacgaactggcggacgacttcggcaatcacgccgtgacgcatcgcggagatcgtctcggtgatgtcgtgcgcttcgagcagctcgttgcgctgctggtagatgaccttgcgctggtcgttcgacacgtcgtcgtattcgagcagctgcttgcggatgtcgaagttgcgcgcttcgaccttgcgctgcgcggactcgatcgagcgcgtgacgatgccggcctcgatcgcctcgccttccggcatcttcaggcgatccatgatcgagcgcacgcggtcgcccgcgaagatgcgcagcagcggatcgtcgagcgacaggtagaagcgcgacgagcccggatcgccctgacggcctgcacggccgcgcagctggttgtcgatccggcgcgattcgtggcgctcggtgccgatgatgtgcaggccgccagcagccttcacctgctcgtgcagcgtttcccactcgtcgtgcaactgctggatgcggcgcgccttttcgtcggccgggatcgcgtcgtcggcctcgatgaacgcggcctgcttctcggcattgccgccgagcacgatgtcggtaccgcggccggccatgttggtcgcgatcgtgacgcgcttcggacggccggcttccgcgacgatcgccgcttcgcgctcgtgctgcttcgcgttcagcacctcatgcggcagcccggcctgcttcagcaggtgcgacagcagttccgagttctcgatcgacgtcgtgccgaccagcaccggctggccgcgctcgtagcattcgcggatgtcgcggatcaccgcgtcgtagcgctccttggccgtcttgtagatctggtcctgcttgtcgatccgcttcggcgggcgattggtcgggatcacgaccgtctcgaggccgtagatctcgttgaattcgtacgcttcggtgtccgcggtaccggtcatgcccgcgagtttcgcgtacatccggaagtagttctggaacgtgatcgacgcgagcgtctggttctcgctctggatcttcacgtgttccttcgcctcgaccgcctggtgcaggccgtcggaccagcggcggccggccatcaggcggcccgtgaattcgtcgacgatgaccacttcgccgttctgcacgacgtagtgctgatccttgtggaacagcgtgtgtgcgcgcagcgccgcatacacgtggtgcatcagcgtgatgttctgcggcgcgtacaggctctcgccctcgccgatcaggccccattcggcgagcaggcgctcggccttctcgtggcccgattccgtcaggaacacctggcgggccttctcgtcgagcgtgtagtcgcccggcttctcgacacccgtgccgtctgccttctcttcgccgatctggcgctcgagcagcggcggcagtgcgttcatccgcacgtacagctcggtgtgatcctcggcctggcccgaaatgatcagcggcgtgcgcgcttcgtcgatcaggatcgagtccacttcgtcgacgaccgcgaagttcagtgcccgctgcacacgcgcgtcggtctcgtagaccatgttgtcgcgcaggtagtcgaagccgaactcgttgttcgtgccgtacgtgatgtccgccgcgtaagcctgctgcttctggtcgtgctccatgccggacaggttgatgccgaccgacagaccgaggaagttgtagaggcgcgccatccattcggcgtcgcgctgcgcgaggtaatcgttgacggtcacgacgtgcacgccgcggccggccagcgcgttcaggtacacgggcagcgtcgcgacgagcgtcttgccctcgccggtgcgcatttccgcgatcttgccgtagtggagcaccatgccgccgatcatctgcacgtcgaagtgccgcatcttcagcacgcgccggctggcctcgcgacagaccgcgaacgcctcgggcagcagcttgtcgagcgactcgccggccgcgacccgctggcggaattcgtccgtcttgccgcgcaactggtcgtccgtcagcttctcgatctgcgtttcgagcgcattgatcgtcgcgacggtctttggtattgcttgacgagccgctggttgcggctgccaaaaattttctggagaaaaccggttgtcatcggatcggatcctgcgtcgcagcaccggcgcccggcgcgtgttgcgcgccccgacgcccgagcctcggcggcttagcgaattagtggactcaaacgtcgaattttagcacgcgggaaagcgtgcgcccgagtctcggccggacgggcactgcgcgcctacggccgggcccacgggcgaaagccgcccgtgcacgggcccgcgcgggtacaatcggcgtcaacgtccgcgcgcgtgcgcgcccgaagaatgtctcgatgaaccgattttccaagcgtttcggcccgctcgccgcctatcgcccgcaacccgtgtccgaagtgctcggccgcaccgacgcgttcgcggcactgcgcgccggcgtcgagcaaatcgcgtcgctgcagcgcgatcttgccgcgcttctgcccgactacctggcgaaccacgtcgaacccggcttcgtgaaggacggcaccctgaccctctttgccgcgcacaacgcgctggccgcgcggctgcggcaggtcgagccgcggctgctcggcgatctgcaaaagcgcggctggccggtctcgacgctgcgcgtgcgcgtgcgcccgaaggatgcgccggagccgccgcacgtgaagcaggcgcggatgacgtcggtcggcgcggccgcgttgcgcgatctggcagaccatctcgaaccgtcgccgctgcaggccgcgcttgcgcggatggcggcccggcacggcgcaaagtcgcgctgacggcctacgccgccggcatcgtccggccaacaaaaagcagcccgaaggctgctttttgttgcttgcgccgaacacagttcaggcgaaggccgtctgcgcgtcgaacgcgaaacccttcggcgcggcctgcggatcgtcgaacgtgacgatctcgtacgcatcttcgttcgcaagcagctcgcgcagcacgcgttattcagcccgtggccagacttgtacgccgtgtacgacgccagcagcggatggccgatcacgtacaggtcgccgatcgcgtcgagcatcttgtgcttcacgaactcgtcgtcgtagcgcagcccgtcgttgttcaggatgcggtactcgtcgagcacgatcgcattttccatgctgccgccgcgggcgaggcccatctcgcgcagcatctcggcctcgtgcgcgaaaccgaacgtgcgtgcgcgcgcgatctcgcgcacatacgacgtattcgcgaaatcgacctcgagctcctggccggtcttgtcgacggccgggtgacggaagtcgatcgagaatttcagcttgaagccgaagtacggatcgagacgcgcgaacttgtcgccgtcacggatttcgaccgtcttcttcaccttgacgaaacgcttcggcgcgttctgctcctcgatcccggctgactggatcaggaacacgaaggtcgccgcgctgccgtccatgatcgggatttcctcggccgtcacgtcgacatagaggttgtcgatgccgaggccggcacatgccgacatcaggtgctcgacggtcgacacgcgcacgccatccttctgcagcaccgacgcgagccgcgtatcgccgatcgacgttgccgccgcgggaatgtcgacgggcgtgggaaggtcgacgcgggagaacacgatgcccgtgcccggtgcggcgggacggagcgtcagctcgatcttgcggcccgagtggacaccgatacccacggtcttcacgatggatttgatggtgcgctgcttcagcatgatgttcttcgtcgtgattgaagatatcaatcaggagttatattcaataggagggattatagcgtaattcctattcaacgcagtttgaaactgcgtatcaatctgtttcggctgtttaccctgccgatacgggacgggccgatgcccggaacggaggcgtttccggtcatcagcccgtgttacaactgccctgaggccggtgagcagcgttgccggcaggcaacggcgcaccgcacgatcaggacgtcaacgtcgcgagaacactcgccgcatcgctcacttcgaatttgcccggcgcctcgacggccagcgtcttgaccacaccgccgtcaatcaccatcgcgtagcgcagggaacgaatccccatgccacgcgcggacaaatcctgcgtcagccccagcgcatgagtgaaagccgcgctgccgtccgccatcatgcgcaccttgcccgcggtgtgcagatcacgtccccatgcgcccatcacgaatgcgtcgttgacggacacgcaccagatctcgtcgatacccgccgcgcgcagttgctcggcgtgttcgacgtagcccggcacatgctgcgccgaacaggtcggcgtgaaagcgcccggcaatccgaagatcaccacccgctttcccgcaacctgatcgcgcacgctgcaggcgttcggccccagcgtgcacccttcgcgcgcgtcgtcgatgtactcgaacagttgcgcgtcgggcagcgcgtcgcccacttgaatcatggctggtccctcatagcgatacggtttttcagcgtgtcgcggacagcacggcccatcccgccccgcttgtgcggagagggcacgtttcccggcccggcgtcgcagccgacgcggcctgtcgtggtccgtagcatccgtcacgccggcgataccgcggcagtttcgccgcggcttcgcctgtgtttgcgtcagtcagcctgcttgcgcaggaaagccgggatgtcgtacgtgtcgacacccttctcctgcagcgcctgcacgtgcgatgccgcggtttcacgcgaattgcgccacaccgccggcgtatcgagtgcgccgtagtcggccgtgctgacgtgatgcgccggtgcatagccgtgcgacaccgcgctgaccggctgattgtccgtacccgtgcgcagcagcgtcatcggtgccgactgctgcttcttcgccgcacggcccagacccgttgccacgaccgtcacgcgcaacgcatcgcccatcgcgtcgtcgtacaccgcaccgaagatcaccgtcgcatcttccgccgcgtagctcttgatcgtgttcatcacttcgcgcgtttccgacaggcgcagcgaacggctcgacgtgatgttgaccagcacgccgcgcgcgcccgacaggtcgacgccttcgagcagcgggctcgccacggcctgttccgccgcgaggcgcgcgcgatcgacgccggcgaccgtcgccgtgcccatcatcgccttgccctgctcgcccatcaccgtcttcacgtcttcgaagtcgacgttcacgaggccatcgacgttgatgatttcagcgatgcctgccaccgcgttgttcaacacgtcgtccgcgcactggaagcacttgtccatctcggcgtcgtcgcccatcacgtcgaacagcttgtcgttcagcacgacgatcagcgagtcgacgtgatcctccagttgctgcgaacctgcttcagcgacgcgcatgcgcttgccgccttcgaactcgaacggcttgctgacgacaccgaccgtcaggatgcccatctccttcgcgatctgcgcgaccaccggtgccgcgcccgtgcccgtcccgccgcccatgccggccgtgatgaacaccatgtgcgcgccgcgcagtgcgtcggcgatgcgctcacgcgcttcttccgctgccgcacgacccatttccggcttcgcaccggcgccgaggcccgtattgccgagctggatcaccgacgatgcgcgcgaacgcgacagcgcctgcgcatccgtgttcatcacgatgaaatcgacgccctgcacgccgcggttgatcatgtgctggacggcattgccgccagcgccgccaacgccgaccaccttgatgatggtgccgttggtctcggtttccagcatttcgaattccatgttgcctccgtcaagagaaaaactgctaatcggccgttattcggcaggagatcgggcaacccctgtcgcgcgccagccgccggcaccagcgcgaatttcgagattcggtttgtcagaagttgctcaggaaccattccttcatccgcgagaacacctgccccgcgttgccggactgcacggcgaccttgcggccgcgcatgcgctgggcactgccttcgacgagcagccccatcgccgtcgagtagcgcggattgcgcacgacgtcggagaggccgcctgcatactccggcgcgccgatgcgcaccggtttcaggaaaatgtcttcgccgagctcgaccatgccgggcatcatcgacgcaccgccggtaatgaccacgccggagctcaggagttcttcgtaacccgattcgcgcacgacctgctgcacgagcgagaacagttcctcgacgcgcggctcgatcacggccgcgagcgcctggcgcgacagcgtgcgcggaccgcgttcgccgaggcccggcacttccaccatttcgtccggatcggcgagcgcctgctttgcgatcccgtagccgaccttgatgtcttccgcatccggcgtcggcgtgcgcagcgccatcgcgatgtcgctcgtgatctggtcgccggcgatcggaatcaccgcggtgtggcggatcgcgccttcggcgaagatcgcgatgtccgtcgtgccgccgccgatgtcgaccagcaccacgccgagatccttctcgtcttccgtcagcaccgccagcgacgacgcgagcggctgcaggatcaggtcgttcacttccagcccgcagcggcgcgcgcacttgacgatgttctgcgcggcgctcaccgcgcccgtcacgatgtgcaccttcacttccagccggatgccgctcatcccgatcggctcgcgcacgtcttcctggccgtcgatgatgaattcctgcgtgaggatgtgcagcacctgctggtcggtcgggatgttgatcgccttcgcggtctcgatcacgcgcgcgacgtcggtctgcgtgacttccttgtccttgatcgcgaccatcccgctcgagttgaagctgcggatgtggctgccggcgatccccgtgaacacgttggtgatcttgcagtcggccatcagctcggcttcctcgagcgcgcgctggatcgactgcacggtggcctcgatgttgaccaccacacctttcttcagacccttcgactcgctctggccgagaccgatcacctcgtagtgaccttcgcctttcagctcggcgacgatggccaccaccttcgacgtgccgatgtcgagggaaaccagcagatccttgtagtctttgctcataaagtgctcttgcgtgtgatctctcgttacttcttgcgcttgtcggtatcggtcaggaaccgcatgcctgccgcgcgaatcgcgaatccgttcggataacgcaggtccgcgtactcgatgtcgttgccccaacgctccgtgaccgccggccaggcggcgaccaggcgctggctccggtcatgcagcgactcgctgttgcgttccttgcccagctcgacctgcatgccgttcgacagcttcaccgtccacgcgtaccgcgccgacagcgtcacttcttccggcgccgccttcagcggcgcaaaccatttcccgaagtcgcgataccgcgtgacgacttccttcgcactgccctccgggccgtcgaacgccggcagttcctgatccagctcgccctggttcgcggtgaacagctcgccgtcgacgctcacgagctggtcgctgccccaggtcccgagcggtttgtactcctcgagcgtgacagccagcgcattcggccacacccggcgcacgctcgcatggcgcacccagggcatctgctcgaacgcggcgcgcgcggcgtcgagatcgaccgtgaagaaattgcccttcagccggccgaccacgcccgcacgtaccgtcggcgaattgatgtgctcggtgtcgccgtcgatccggatttcccgcaacgcgaacgtcgggcgctggatcagccagtagcaaccggccgccgccaacacgagcagcagcagcgcgtacagcgcgctggcggcaaggttgagttggcgaacgttgttccacatacgtcgttccgttcctgcgtcagtcgttgagcgtgagcgacagcaccttcacgaccagctccgaatagctgatgccgaccgcgcgcgcggccttcggcggcagcgagtggtcggtcatgcccggcgcggtgttcacttccaggaagtacgcattgccatcggcgtcgagcatgaagtccgcgcggccccagtcggtgcagccgagcacgtcgaacgcacggcgcgcgacgcgcttgagctccgcttccttgtcggcgggcagcccgcacgggatcaggtattgcgtgtcgttggcgatgtacttcgcgtgatagtcgtagaactcgccggccggcacgatcttgatcaccggcaggtcgagatcgccggcgatgcatgcggtgtattcgccgccgccttcgatactcttctcgacgatcacgatcgggtcgtgcttcgcggcttcctcgagcgcagccggtagcgcatcggccgtcttcaccttcagcaccgcgacgctcgagccctcgctcgccggcttcacgaacagcggcaggccgagcttcgcgacgatgtccgtcgcgcgcgccgcgagatcgtcgccgcgcagcaccgtctcgaacggcggcgtcggcacgcccgtctgctgccagacgagcttcgtgcggaacttgtcgaggccgagcgccgacccgagcacaccgctgcccgtgtaacggatcccgtagaaatcgagcgcgccctggatctggccgttctcgccgtaaccgccgtgcagcgcattgaacgcacgcacgaacccttcgtccttcagcgccgccagcgggcgctcggccgggtcgaacaggtgcgcgtcgatgcctgcgtcgcgcaggccctgcagcacgagctggccggacgtgagcgagacctcgcgctccgaggactcgccgccgaacaacaccgccaccttgccgaaacgtttcggatcaatcccgctcatgtcatgccttctgttgagtgtgctgcgcgaccttcgccggcacgccgccgatcgaacccgcgcccatcgtgatcaccacgtcgccgttctgcgcgaccttcgccaatgcgtccggcacgtcgtcgaccgtcgcgacgaacaccgggtcaacctttcctgccccgcgcagcgcgcgcgacagcgcgtcgccgttggcggtcgagatcgcggcctcgccggccgcgtagacttccgtcagcaccagcgcatcgaccgtcgacagcacgttgacgaaatcgtcgaagcaatcgcgcgtgcgcgtgtagcggtgcggctggaacgccagcacgaggcgacgccccgggaacgcgccgcgcgcggccgcgatcgtcgcggccatctcgaccgggtgatggccgtagtcgtcgatcagcgtgtactggccgccgtccgcggtcggcacctcgccgtagcgctggaaacgccggccgacgccgttgaattcggccagcgcctgctggatcgcgtcatccgtcacgccgaggtcggtcgcgatcgcgatcgccgcgagcgcgttctgcacgttgtgcaggcccggcatgttcagcaccaccgcgagcggtgcacgcccttcgcggatcaccgtgaaatgcatccggccgtcgcgcgcgtcgatgtcttccgcgcgcacctgcgcgtccggcgacagtccgtagcgcacgaccggcttcgagatgaacgggatgatctgccgcacattcggatcgtcgacgcacacgaccgcgctgccgtagaacggcaggcgctgcgtgaattcgatgaacgcctgcttgagccgcgcgaaatcgtggccgtaggtgtccatgtggtcggcatcgatgttcgtgatgacttcgatcaccggatacaggttcaggaacgacgcgtccgactcgtcggcctcggcgacgatgaaatcgcccgtgccgagccgcgcgttcgcgccggcgctgatcagccgcccgccgatcacgaaagtcgggtcgaggccgcccgcggcgagcacgctcgcgacgaggctggtggtcgtggtcttgccgtgcgtgccggcgatcgcgatgccctgcttcaggcgcatcagctcggcgagcatcaccgcgcgctgcacgatcggcacgcgcttcgcgcgcgcggccagcacttccgggttgtccgagcgcacggccgtcgatacgacgaccgcatttgcgccctcgatgttcgccgcgtcgtggccgatcgcgatccgtgcgccgagcgcctggagacgatcggtcaccgcgttgcgcgagagatccgagccgctgacctcgtagccgaggttgacgagcacttcggcgatgccgctcatgcccgcgccgccgatcccgacgaaatgaatgtgtttgacgatatgtttcattgcaatatttccaggttcgcgccggccgccttcgcgcatacgcgcgcgacttcgtcggtggcctcgggcttcgccagcgagcgcgaacgttccgccatgtccgcgagcgatgcccgcgactggccgcgcagccagtcggcgagcagttccgccgacaggtcgcgttgttgcaccagcacggccgcgcccgcatcggcgaggaacgcggcgttgctcgtctggtgatcgtcgaccgcgtacgggaacggcacgaacagcgccgccacgcccaccgccgcgatctccgacaccgtcatcgcgcccgaccggcagatcacgagatccgccgccgcatacgcggccgccatgtcgtcgatgaacggcacgagccgcacgtcttcgccggccgcgaaaccggccgcttcgtaattcgccttcagcgcgtcgatgtgcttcgcgccggcctgatgcacgatgcgcggacgttcacccggcgtcagcatcgccagcgcgcgcggcacgacttcgttcagcgcggccgcaccgaggctgccgccgacgaccagcacgttcagcgggccgctgcgcgacgcgtagcgtgctttgggcgcttcggtgccggcaagttccgcgcgaatcgggttaccggtccattccgcgtgcggcagcgcgccgggaatgcgacgagcacgcgtttcgcgaatttcgcgagcaccttgttcgtcaggcccgcgatcgaattctgttcatgcagcacgagcggacgccccgacagcgccgtcatcacacccgccgggaacgtgatgtagccgcccatcccgagcacgacgtcgggccgcacgcggcgcagcgcggcgaggctctgcccgcatgcgcgcagcaggttgaacggcagcgtcagcttggtcttcaggcccttgccgcgcagcccgccgaaccgcacgtactccatcggaatgccgtgtttcggcacgagcgtcgcttccatcccggccggattgccgagccacacgacgcgccagcccgccgcctccatccggtgcgcgaccgcgagccccgggaacacatggccccggtgccgcctgccatcaccatcagcgtgcgttgcgacgcggtcataccttcccccgcgcatcagcacccggttttcatagtcgacccgcagcagcaccgcgagcgccacgcagttcagcagaatgccggagccgccgtagctcacgagcggcagcgtcaggcccttggtcggcagcagcccgaggttcacgcccatgttgatgaaggtctgcgcgccgaaccagatgccgatgcccttcgccatcaggcccgcgaacgtgcgatcgagtgcgagtgcctggcggccgatctcgaacgcgcggcgcacgatccagtagaacagcaggatcacgaccagcacgccgacgaaaccgagttcctcgccgatcaccgcgaggatgaagtcggtatgcgcttccggcaggtagttcagcttctcgacgctgccgccgaggccgacaccgaaccactcgccgcgtccgaacgcgatcagcgagtgcgtgagctggtatgccttgccctgcgcgtagcgctcgtcccacggatcgaggtacgcgaagatccgctcgcgacgccacggcgacagccacacgagcatcgtgaaggtgccgaccgccgtcgcgacgaggccgccgaacagcttgccgttcacgccgccgaggaacagcacgcccatcgcgatcgccgcgacgaccatgaatgcgcccatgtccggctcgagcagcagcagcgcaccgaccaggccgaccgcgaacgccatcggcaggaagcccttcgcgaagctctgcatgtattcctgcttgcgcaccgtgtagttcgccgcgtagatcgtcaccgcgagcttcatgatttccgacggctgcatgttcgtgatgccgagcggaatccagcggcgcgcgccgttcacgcccttgccgacgtgcgggatcagcacgatcacgaggccgaccagcgcgatcaggaagagatgcggcgcgtatttgtcccacgtcgacaccggcacccggaacgcgatcaccgccgcgatgaacgcgacgacgagcgatacgcagtggcgcatcaggaacgcgtaatcgtgatacgccgcgtatttcggcgaatcgggcatcgcgatcgacgccgagtacaccatcacgacgccgagcccgagcagcgcgatcgcgacccacagcagcgagtagtcgaagtcgagcatccgcgaacggctcgggcgcacgccgttgacgacgctcgcgaggccgccggtcgcggcgcgcgtggccgacgcgacgcggccgcccgcggcattgccgccggtgtcgcgccgatcgttgaaacgggagacgaggcgatcggaccagctcatggcgtcgctcctttgtcgatggcgatttcgtcgaccgccgcgcggaacacatccgcgcgatgggcgtagttcctgaacatgtcgaggctcgcgcatgccggcgacagcaacaccgcatcgcccggctcggcgaggtcggccgccgcgtgcaccgcgccttcgagcgtcgtgtggtcggcaagcggtacgcccgtttcggcgagcgtgtcgcggatcgccggcgcgtcacggccgatcagcatcaccgcgcggcaccagcgcgcgaccggcgcgaccagcggcgcgaaatcctggcccttgccgtccccgcccgcgatcagcacgatcttctgggcgagcccgtcgagcgcggcaaccgtcgcgccgacgttcgtgcccttgctgtcgtcgacgtagtccacgtcgtcgatcgtcgcgatcacttcgacgcgatgcgcttcgccgcggtactcgcgcagcgcgtgcagcagcggcgcggccggcaggtcgatcgcgcgtgcgagcgcgaatgcggccagcgcgttcgccgcgttgtgcagcccgcggatacgcagtgcgtcggccggcatcaggcgcttctgagcgatgtcgggcgtgtgcgcggcatcgcgcttgcgccggcggctcgtcgtcgccgcttcgtccggtgcatcgcgatcgacggcttccaccagccacgcgatgccgttgtcgcgcgacagcccgtagtcgccgtcctgcaccggttcgttcaggccgaacgtgaccgtacgcggcgcgtcggccgcgccggctgccggcgcgaacttcatcacggccgcatcgtcgcggttcagcacgcgcgtcgtcgtcgcgccgaagatccggccctttgcttgcgcgtacgcttcgaagctgccgtgccagtcgaggtgatcctgcgtgatgttcaggatcgcggccgcatcgggcgcgaacgtgcgcgcggtctcgagctggaagctcgacagttcgagcacccatacgtccggcagcgcggtttcgtcgatcgcgccggcgagccggtcgagcatcgccgggctgatgttgcccgcgaccgcgaccttcttgcccgagcgctggcacagcaggcccgtgaggctcgtcgtcgtggtcttgccgttggtacccgtgatcgcgagcaccttcggctggtagccgctcgtgccgagcgcacgcagcgcctgcgcgaagaattccagctcgccccacaccgcgatgccgcgctcgttcgcggccgcgaccagcgccgcgagcgccggttcgagcggcgacagcccgggctcagcccgacgagctcgatgccgccgtcgagcagcgcaggcgtgaacgccccgccgacgaactccgcatcgatgccttcggcctgcagcgcggcaaggttcggcggcgcctcgcgggtatcggcaatgcgcagccggcacccgtgcctcgcgcaccatcgcgcgatcgcgagacccgattcccgagccccagtacgagcaccatcggccgttgccgatctccaaacatctcgccagacatccttgttacctttcctttaccgcagcttgagggtggtcagaccgaacaggcacagcatcagcgtgatgatccagaaacgcacgaccacctgcgtttccttccagccggacaattcgaaatggtgatgcagcggcgccatcttcagcaggcgccgcccttcgccgtagcgctttttcgtgtacttgaaccacgacacctgcagcatcaccgacagcgtttccgcgacgaagatgccgcccatgatgaacagcacgatttcctggcgcacgatcaccgcgaccgtgccgagcgcgccgccgagcgccagcgcgccgacgtcgcccatgaacacctgcgcggggtgcgtgttgtaccagaggaacgcgagccctgccccgcccatcgcggaacagaagatcagcagttcgcccgcgcccgggatatgcgggaacaacaggtattttgaatagaccgcactgcccatcacgtacgcgaacacacccagcgacgcgccgaccagcacgaccggcatgatcacgaggccgtcgaggccgtcggtcaggttcacggcgttgctcgcgccgacgatcacgaagtacgtcagcacgatgaaaccccacacgccgagcggatagctgatcgacttcaggaacggcagcatcaggtcggcgcgtgccggcagccccatcgacaggccgctcctcacccacgccatgaacaggtcgaacacgcgcacgttgttcgcctcggacacgctgaaggcgaggtagacagcggcgaacagcccgatcaccgattgccagaaatacttctcgcgcgacgacatcccgcgcgggtccttgtggacgaccttgcggtaatcatcgacccagccgatcacgccgaaaccgaacgtgacgagcatcacgatccagatgaaacggttcgtcaggtcgccccacagcagcgtcgcgaccgcgatgccgatcaggatcagcacgccacccatcgtcggcgtgccggacttgacgaggtgcgtctgcgggccgtccttgcgcacggcctgaccgaccttcatttgcgtcagcttgcggatcacccacggtccgcacacgagcccgatcccgagcgcggtgatggtggccatcaccgcccggaacgtgaggtacgtgaacaagcgcaaaaagcttgcgtctccttgcagccattgcgccagcgccagcagcatgcttccttccttctactcagtgtgcagcgggcgccgtgcccgccgcgggttggttcgtcagcgcgtcgaccacgcgctccatcttcatgtaccgcgagcccttcacgagcagcgtcgcctgtgcgccgtaaccggccgcgagcagcgccgccacaagcgcgccgacgtcgtcgaagtggcgtgccgtgtcgccgtacgccgtgcacgcatctcgcgatgcgtcgccgagcgcgaacagcgcgtcgatcccgcgctcgcgcgcgtatgcaccgacctcgcgatggaaagccggcccttcgtcgccgacctcgcccatgtcgccgatcaccagcacgcgcggcgccggttgcgtggcgagcacgtcgatcgcggcacgcatcgaatcgggattcgcgttgtacgtatcgtcaacgaccgtcgcacccgcgaggctgcccgcgatcgcctgcttcacctgcagccggcccttgacaggctcgaacgattcgagaccctgcttgatcgccgacagcgcgacgccggcacccagcgccgcggccgtggcggccagcgcgttgcgcgcgttgtgctcgccgagcgcgcgcagccgcaccgtgacggcgcccgcgggcgtatcgatcgcgagttcgccgccgtgaagacggcccgtgacctgcgcgtcgttctgccgttcggcatcgtgcagcgcgaaatcgaggatccggttgccggtcgccgcgacgcgccagatgcccgcatacgcgtcgtcggccgggaacaccgcaacgccgtccggcgggagcgcgtgaatcacggccgcatgttcgagcgcgaccgcttcgaccgtcgccatgaattcctggtgctcgcgctgcgcattgttgacgagtgcgaccgtcggcgccgtgagacgcgcgaggacttcggtctcgcccggatggttcatcccgatctcgatcaccgcgagacgatgtgcggccgacaggcgcagcagcgtcaacggcaggccgacgtcgttgttcaggttgccggccgtcgcgagccgcgcgtcggcgccgaccgccgccgcgaagatcgacgcgatcatttccttgacggtcgtcttgccgttgctgcccgtcaccgcgacgagcggcagcgcgaatcgtttgcgccagccatgtgccagtgcgccgagcgcggcacgtgtttcgccgccttcgatcgccggcatcgtgacgcccgccggcacgtgcgcgacgagcgccgccgccgcaccgcgcgcagcgacatcgccaaggaagtcgtgcgcgtcgaagcgctcgcctttcagtgcgacgaacaggtcgccggggccgacggtgcggctgtccgtcgacacgcggtcgaacgtgacgcccgcatcgccgtggacggttgcgccgggaatcaggcgagcggcttcgccgagactgagcatcgtcattcggcgcctcccttgccgtgcgtcgcgcgcgctgccagcgcgagccgcgcgtgatcctggtcggagaacgtacgcttcttgcccatgatttcctgcgtgccctcatggcccttgccggccagcacgacgacatcctcgcgtgcggcgccgcgcacggcctgcaggatcgcgctcgcgcgatcctcgatacgacgtgcgtgatcggccgcggtcatgcccgcgacgatctggtcgatgatgcgctgcggatcctcgctgcgcggattgtcgctcgtgacgacggtctcatcggcgagtcgctccgcgatcgcgcccatcagcgggcgcttcgtcgcatcgcgatcgccgccgcagccgaacatgcagacgagccggccgccgcgcgccgtggcgatcggacgcagcgcgtcgagcgtcttttcgagcgcgtcgggggtgtgtgcgtagtcgatcacgacgagcggttcgtcgttctgcagccggccgccgagccgctgcatccgtccgttgacggactcgagccgcgcgatctcggcgagcgccgcgtcgaacggcaggtcggccgcgagcagcgagccgagcaccgcgagcaggttgctgacgttgaacgtgccgagcgtgccgacctcgacgtccgcttcaccccacgacgaacgcaggtggaacgccgtgccggtcgcggtggcacgcacgtcgagtgcgaccagttcgcgatcggcgtcaggcgccggtgcgtcgccgatcccgtacgcgatcgtacgcacgcggccggcgagcttctcgagcaggcgccgaccggctgcatcgtcgcggttgacgactgccgcgcgcaggccgcgccacgcgaacagcttcgccttcgcggcctcgtacgcatcgaacgtgccgtgatagtcgaggtgatcctgcgtgaggttcgtaaacaccgcgatgtcgaaacccgtaccgttcacgcgcccctggtgcagcgcgtgcgacgacacttccatcgccacggccttcgcgcccgcgtcgcgcaactgcgcgagactgcgctggttgcggcgcgtcgggcgtcgtgaaccccgtcggcacgagctggccgggcatcccggtgccgagcgtgccgatcaccgcgcacggctggtggagcgccgtcagcgcggcggcgatccattgcgtgcacgaagttttgccgttcgtgccggtcacgcccaccgcaagcaggctgtcgctcggattgccgtaccagccgctggcgatctcgccggcgagctggtcgagcgccggcacggccagtgcaacgggcaccgccggcgccgcggccagcccttccggctgatacagtacggcggccgcaccgcgcgcgacggcatcgacaatgaaagcgcggttgtcggccccgtcgaccgcataggcaaaaacacgtcgccggccttgaggctgcgcgtgtcggcatgcagttgcgctgcgggggcacatgctgatgcagccacgcaagcgcggctgcgatctgctgatgcgccggatgggaactgcgagcggcgctcatcgaacaactcctggtgaattacgcgtcgtgctggacacgatcatatgcttcgcaccgccacctgcggccagcttttgcggccccgctgcggaaggtgctgccggcgaatcgtcagacacgacgagttgcttgatcggcatgttcggcggcacgttcagcgcacgcatcgtgtcgccggcgatcgccgagaatactgggccggacacctggccgccgaagtggctgccggcggtcggctcgtcgaccgacaccgcgacgacgatgcgcggattcggcatcggcgccatcccgacgaacgacgcgcggtacttgcgcgtgtagccgtgcccctcatgcttgtacgcggtaccgctcttgccgccgacgcgatagcccggcacggccgcatcgggcgacgtgccgcccggcgccaccaccgtttcgagcatcgcgcgcacttcgcgcgcggtggtcgggttgaacacctgcgtgcccacgaccggctgattggggtcggtcttgaaaatggtcacgggcatcagctcgccgtcatgcgcgatcgccgtgtacgcgcgcgcaagctggaacagcgacaccgacaggccgtagccgtacgacatcgtcgcctgctcgatgcgacgccagctcttccacggacgcaggcggccggccaccgcgcccgggaacccgaccttcggcgcctggccgaggccgatgctcgtatacatattccacatttcctcgggccgcatcgtcatcgcgatcttcgtcgcgccgatgttgctcgacttctggatcacgccgccgaccgtcagcgtgccgaaacccgcgtcgtcggtgatcggtgcgccgtcgagcacgaaatgcccgttgcccgtctcgacgagcgtgttcggcgtcacgcggtgcaggtcgagcgcgagcgacaccgtaaacggcttcatgatcgagcccggctcgaacacgtcggtcatgatccggttgcgcaactgctcgcccgtcatgcgcgagcggtcgttcgggttgtacgtcgggtaattgacgagcgcaagcacctcgccggtacgcacgtcgacgaccatcgccgcgccggccttcgccttgaacttctcgacggcggccttcaggttcgcgtacgcgatgtactggatcttgctgtcgatcgacaggtcgacgtcggtgccgttgtgcggcgggatctgctcggcgacatcctcgacgatgtgccccagccggtccttgatcacgcgacgcacgcccgacgtgccggacagcatcttctggtcgccgagttcgacgccctcctgcccttcgtcctcgacgttcgtgaagccgatcaggtgagcggtgatctcgccttccggatagaagcgcttgtactcgttgcgctgatagataccgggaatgtcgagggcggcaaccttgtccgcgacgtcgatcggcacctggcgcttcacgtagacgaaacctttgtcttccgacagcttcacgcgcagttccttcgacgtcatgccgaggagcttgccgagctggttgactttgtcggcatcgagatcgtccggcactgcgtcgggaatcgcccagatcgcacgcacgggcaggctcgtcgcgagcacgagcccgttacggtcgaggatcttgccgcgcgtcgccggcagctcgagcgtgcgctggtagcggctttcgccctgcttctggtagaacgcgttgccgggcccctggatccagaacgcgcgcgcggccagcgcgacgaacgccatgaacagcaggaacacgacgagcttcgagcgccacatcggcagatgcacgcccagcaccgggctcgacgagaacttcacgttctggcgcttctgggacggcttcatcgcgcgcctcccttgcccttgccggccgtgtccgccgatgccgggatcggcgcatcgatcgccttcgccgcgcccggcggcagcgtcaggtattgcgtgcggccggtcgagatcggctgcatcttcagcgaatcgttcgcaagctgctcgatgcgcgacgtcttcgacagcgcgctctgctgatattgaagctgcgcgtagtcctgctggagctgacgctcctgcgactgcgcgcgctggatgaagatctggcgctgctggttcgtcgaattgacgaccgacagcgcgcagcccatcacgatgattagcaggaagatattgaagcggctcatggcgtgacgcgctccgcaatgcgcatcacggccgagcgggcgcgcgggttcgcggcgacttccgcttcactcggaaactggcggctgatgatcttgagcggcgggctcgggaggtcgacggcgcggatcggcaggcgacgatcgaccgcaggcgcactcgcgtgcgcctgcatgaatcgcttgacgatccggtcctcgagtgaatgaaagctgatgaccaccagccgcccccttgctccagcaacgacagtgccgcgtctagtacgacttgcaggtccgcaagctcttgattgacgtgaatccgtatagcctgaaaggtgcgggttgccggatccttgcccttctcacgggttttgacgacgtgacccacgatttgggcaagctcgcccgtggtgtcgagaggcccaagacggtcggactctgcccggcgagcaacaagcgcctttgcaatctgaaaagcaaaccgttcttccccataatcccgtatcacctccgtcaattcctgcaccgaagcccgtgcgagccattccgccgccgactcgccgcgcgtcggatccatccgcatgtccagcgggccatcggcgcggaagctgaagccgcgcgccggatcgtccacctgcggcgaggacacgcccaggtccagcaacacacccgacaccttctcgacgccgcgcgccgcaagcgcgtcgcgcatcgatgcaaagctgtcatgcacgatcgagaagcgcgcatcctcgatgccctgcgccgtctcgatcgctcgcgggtccttgtcgaacgcaatcagccgcccggccggccccagccgcgcgagcaccgcgcggctatgaccgccgcgcccgaacgtgccgtcgacataaacgccgtccggccgcgtcacgagcgactcgaccgcttcatccaacagcaccgtctgatgccgcaattcgtttcccatcgcgggcgtctccgtcaccgcaatcagaacgtgaaattcttcagcgcgtcgggcatgccctgcgccatcgccgcctgctccttcgcgttgtaggtctgcgaatcccacagctcgaagtgactacccattcccaacaacatgacttccttttccagtccagctgccatgcgcagctcgggcgatacaagaatccggccggcgctgtcgagatcgacgtccatcgcattgccgagaaaaatgcgccgccaccagtgcgcgtccatcggcagcgcggcgatcttggcgcggaatacttcccattcggggcgcggaaacagcaacaggcagccgtccgggtgcttggtcacagtcacccgtccttctgcctgtccttgcagcgcttcgcgatagcgagccggcaccgacatccgccctttcgcatcgagcgtcagcgccgacgcccttggaacactttccgctctcccgttcagggcaccgaagcacccgctcaatgctgagaatttagccggaatagcccgccaaatcacacaaaaatacactttctcacactgtctcccactttagaggaagggtgtggcacggtcaaggagcggcccgctttttgacgaattttgttagttagaacaaggacttacgcgcacatgctcatgctgcccctcattccaaaaaccgttataaatgaatgagctagtgcaacttgtgaaggtgatacgtgagaaagacgggccagacgggtgtgcggacggggctttcggggcgggaaaacgaggaataaacgggcggtatcagcggcggggaaccggggcgacgtcacgcatcgccccggtgcgaatctcacagatagtacgcagtgctcgtcatgactttcgacgcggcgcgcatcagcattcgcgcgggcagcggcagttcgatcccgcctgcgtcggcggcggccttgccgtgcttcacctcgtcgatacgcatctggtcgacgatcgcgcgcgacgcggtatcggccgccggcaactcggacatatggccttcgagatggctctcgacctgccgttcggtctctgccatgaagccgagactgaccttgtcgccgagcgcgccagccgccacgccgatcgcgagcgaacccgcataccagagcgggttcaacaggctcgggcgcgagtcgagctctttcaggcggtgcgcggtccacgcgaggtgatcctcctcctcgcgcgcggcttcctcgaacatcgccttcgcggatgccgtgcgcgcggtgagcttctgcgcctggtacagcgcctgagcgcagacctcgccgacgtggttcacgcgcatcagcccggcggcatgcgtacgctccgcgggcgtcagttcgacggcgggcgcctcggccggcgcgggcaccggccggctcatccggctaatgcccgtcagcgaccgcaggccgcgatcgaattcgctgatcagttcatcaaacaccatcctgttctcctggctgcatgtgccgccgcgagcggcaatggcacgggtccgctgcgtaaccgacttgattattcagcggaaattgcggttaacccgtgattttaaccattgttgcataaaggaaacatggcggccttgagctgcggcatttcgctttgtggcaaaaaccggttttgctacattacgtgcgacttcttgcgaagttgatggggcccgtcaacagaacataactatccgccccgccagaaaaattcagtgatttttggagatccgttaatgaaaaagtcgcttctcgcgctcgtcgcgctgggcgcgttcgctggcgctgcccatgcgcaaagcagcgtgacgctttacggcatcatcgatgaaggcctgctcttcaacaacaatgcgggtggcaagcacctgtacagcatggccagcggcgtgatgcaaggcagccgcttcggcctgcgcggcaccgaagacctcggtggcggcctgaaggcgatcttcaccctcgaaaacggtttcgacgtgaacagcggcaagctcggtcagggcggcctgatgttcggtcgtcaggcctacgtcggcctgtcgagccagtacggtacggtcacgctgggtcgtcaatacgactccgtcgtcgacttcgtcggcccgctcgaggcaggcgaccagtggggcggctacatcgccgctcacccgggcgacctcgacaacttcaacaacgcctatcgcgtgaacaacgcggtcaagttcacgagccagacctatggcggcttctcgttcggcggcctgtacagcttcggcggtcaggcaggccagttctcgaagaaccaggtctggtcgctcggcgcaggctacaacaacggcccgctggtcttgggcgtcggttacttgaacgcacgtacgccgaaccagttcggcggcatgttcaacaacggttccgcgtcctcgtcggtctcgtcgccgatctatggtgcgtacgcgaacaacgcgaacacgtaccaggtcatcggtgcaggcggcgcatacacgttcggtgcagcaacgatcggcgcgacgtactcgaacacgaagttcaagggcttctcggcaggcccgttcgtgaaccagaccgcgacgttcaacaacggcgaaatcaacttcaagtatcagctgaccccggcgctgattctcggcgcggcgtacgactacacgcaaggcagcaagatcgacggcaactcggcagccaagtaccaccaaggctcgctgggcgtcgactacttcctgtcgaagcgcaccgacgtctacgcgatcggcgtctaccagcacgcatcgggcaacgtgctcgacgcgaacggcgacgtgatcaaggcaaccgcgtcgatcaacggtctcgccggttcgagcaccagcaaccaggtcgcggcacgcgtcggcatccgtcacaagttctaatcagcttgcctgacaagccgcagcatattgaaggcgcctccgggcgcctttttctttgcggggcagaagcaaagccggagcgcggcgaatcgcgccgggcgttgcgcgctcgtcgtggagggccatgccgcttgcctctgcaaccatcgaaacgcacggccgccgccgcaagcccattccggaggcagtctcgttcggggacaaacctcctcggggccgcactgccaacaaaaaggcccggcatgtgccgggcctttcccttcgatcgaccgcgacgtcacgcgcgtccgtcgcgcaattcgcgccgcaggatcttgccgacgttcgttttcggcagctccgtacggaactcgaccagcttcggccgcttgtagccagtgaggcgctccttgcagtaggcgaggatgtccttgtcggtgagcgccgggtccttcttcacgatgaacagcttcacggcttcgccggaatgctcgtcgggcacgccgaccgccgccacctcgaacacgcccggatgcgacgccaccacgtcctcgacttcgttcgggtacacgttgaagcccgatacgagaatcatgtccttcttccggtcgacgatcttcacgtaaccccgtgcatccatcacgccgacgtcgcccgtcttgaagaagccgtccgcgaacatgaccttcgcggtctcgtccggccggttccagtagccggccatcacctgcggcccgcggatgcaaatctcgccgggttcgccgagcgcgacgtcgttgccggcatcgtcgcgaatcgccacttcggtcgacggcagcggcaggccgatcgtcccgctgtattcggtcgccgtcaccgggttgcaggtcgcgaccggcgatgtttcggacagcccgtatccttcgatgatcgccgtatgggtcttttcataccagcgtttcgcgacgccttcctggatcgccatgccgccgccgttggcgatcacgagcttcgacaggtcgagctgattgaattcggggtggttcagcagtgcgttatacagcgtgttgaccgccgggatcgtcgagatctggtagcccttcagctccttgatcatgccggcgatgtcgcgcgggttcgggatcaggatgcccatgcccccggtacgcatcgtcaggaaaccgcagacggtcagcgcgaacacgtgatacagcggcagcgcgacaacggtcacgaactgtttcacctccggaaacttctcgtgagccggatgatgccaggcgccggcctgcagcacgttcgacacgatgttccggtgcagcagcgtcgcccctttgccacgcctgtcgtcccgcccgtgtattgcaggaacgcgacgtcatcagggccgatcttctgggccttgaatgcctgccgcgcgccttccgacagcgcggccttgaagcgcgtgaacgacggcagttgccaggccggcaccatcttcttcacgttgcgcacgacgtagttgacgagccatcccttgatgcccagcagatcgcccatcgacgcgacgacgacgtgcttgacgctcgtattcgcgatgacagcctgcagcgtcgatgcgaaattctcgagaatgacgatcgcctccgcgccgctgtccttcagctgatgttcgagttcgcgtggcgtgtagagcggattgacgttgacgacggcgtagcctgcgcgcagtaccgccgcgatcgccaccgggtactgcagcacgttcggcatcatgatcgcaacgcgcgccccgcgcgcaagaccgcgcgattgcagccaggcgccgaactggcgcgacagcttgtcgagttcgccgtacgtgatgcccttgcccatgcagacgaacgccgtgcggtcgcggtactggcggaagctttcgtcgagcaggtctggaacggagggatacggagacgcgtcaatttcggctggaacgccgggtgggtacgatttcagccaaattttgttcatactgcgcgtctcctcacggattttcgaatgatcgtgctaaaacgcatcgtaacggctcgcccgtcccgatacaacagggttagatgtccacttcgaacttccgtggagattcgtcggatgatacggtgatattcggtcaaatgcgttcaacttccacaaggcaatcgtaaaacgtcgccgaattgccgagatcggtgagcgcctggctcgtcacctcgttcgcgttcctgccgtccggcgacagcttcttccaccagatcgacaacccgacgacgagccctgcacgtgcgcgatcggtaattctcgcgagcgcctgcatcgaaccgcggtcgttgaagatgcggacgagatcgccctccgcgatgccccgtgcatcggcatccgacgggtgaatgtcgagatgtggttcgccttcggtatgacgcaggctgtcgacgttcacgaacgtgctgttcaggaagtgacgggccggcggcgaaatcatcgcgagcggatagcgcgcggcgagttcgggtgccgcctcggccgattcgaacggcggcaggtagtcgggcacagggtccacgcccatctgctcgagccgcgggctgtagaactcgcacttgccggacggtgtacggaaaccgccgttcgcgaacggcgcctccggcagcttgagtttcaaccagccgtcgcgcttcagcgtgtcccagtcactgtcgagtgccggatcgtcccagcggagggccacgcgcgcgacctcttcgtcgctgtgatagagcgcgggctcgtccagccccatgctgcgcgcgatcccgcggaagatctccgtgttcggccgcgcgtttcccaccggaggaatcgacggcaggttcgccatcacgtaggtgtggccgtacgatttgtgaatgtccagatgctcgagctgcgtggttgccggcagcacaatgtcggcgaaatcggcggtatctgtcttgaaatgctcgagaaccaccgtgaacagatcgtcacgcgcgaaccccgccgcgactttcgaggaatccggcgcgaccgccaccggattcgagttgtacacgatcaccgcttcgaccttcggtccgaaggtggcatcgcccgggtgcaacagcgcgtcgccgatcgcgttcatgttgatgatgcgcggcagtttgtgcggccagcccggcatcaagtccgggcgcagcaacgcagcctggttgaccggcgcggattccgacgacgagagcaacagtccgccggcccgatcgcgccatgcacccgtcagcgccggcagacttgcgatcgcccgtaccgcgttgccaccgccgcggacgcgctgcatgccgtagttcaggcggatcgatgccttccgggtagcgccgtaacgacgcgcaagatcggtcaactccgacgcgtcgatgccgcaaatctgcgcgacacgatccggcggataggacatcgcccgttccttgagtgcgtcgaaaccgagcgtatggttggcgatgtagtcgtgatcgagcaggtcttcggtaatcagcacgtgcatcatgccgagtgcgaacgcgccatcggtacccggtttcaacgcaatatgctgatgacacttctccgctgtcagcgaacggtacggatcgatggcgacaagacgggcgcctcggcgcttcgcttcctgcgcacgcgtccagaaatgcagactcgacgcgatcgggttcgctccccatatcagaatcagttcgctttcctcgaaatgctcgagatgcataccgagactgccgccatatgtgtaccgtaaccccgcagcaccggccgccgcgcagatcgtgcgctcgagccgcgaggcgcccagtttgtggaagaaccgctgggcgatgccctcccttgcacgagccccatcgtccccgcatagctgtacggcacgatcgcttccggtgcgcgcgccgcgatttcaccgagacgacggccgatctcgtcgaacgcctcgtcccagctgatcggtacgaaatgcccttccctttggcgccgatgcgcttgagcggaacggtgaggcgatcgggatgatgaacgcgatcggcgtatcggctgactttcgtgcacaacacgccttgcgtcggcggatggtcaggatcgcccgtgaccttgatcgccttgccgttttcgacggtcacgcgcattgcgcacgtgtccggacaatcgtgcgggcaaacggcccgggctacctgaatcgcggcgttcatcgttttgagtgcttagatgggggttcgcaaattttacgtggacacgccgaataaagcgttcatttcgttcggattctgggttatctgaccaaaaatcgattcgaggaagccggggtagtttcggttacaccacgcgtcatctgcgagggaggcttgtatcgcccgtccgatatgcgttgtcgacgatggagggcagatcgtgcacgacggcgctaatcggtacacggagaggagggagttgcggttttgatcggagatacgaccaatagatcaggggatcgcgaatgatatcggtcacttcggaaaaccaggcgttgcgattgggtgcacctgggagtcgtggagaatcggcaccccgaccccagctcgagtagcagccaggccaccaatcccgatcactcgcgcatttccgccgcgccaatgcaaaaaccccggcctttcgggcgggggttcttgacttaggagcctgacgattacctactttcacacgggaatccgcactatcatcggcgtagagtcgtttcacggtcctgttcgggatgggaaggggtgggaccgactcgctatggtcatcaggcaaagagggttgttgcgctggcttcgcagcacaaccaatcttggaagaagcagtaattttgagttgtgtgtatcacacacgagaatccaacttgtcgcttggatcctgcggccggtgctgtcgcacggcgccgatctacaaggcagacttgttataggatcaagccttacgggcaattagtatcagttagctgaacgcattactgcgcttacacacctgacctatcaacgtcctggtctcgaacgacccttcaaggggatctagtccccagggatatctcatcttaaggcgagtttcccgcttagatgctttcagcggttatctcttccgaacatagctacccggcgatgccactggcgtgacaaccggtacaccagaggttcgtccactccggtcctctcgtactaggagcagccccttcaaatatccaacgcccacggcagatagggaccaaactgtctcacgacgttttaaacccagctcacgtacctctttaaatggcgaacagccatacccttgggaccggctacagccccaggatgagatgagccgacatcgaggtgccaaacaccgccgtcgatatgaactcttgggcggtatcagcctgttatccccagagtaccttttatccgttgagcgatggcccttccatacagaaccaccggatcactatgacctgctttcgcacctgctcgacttgtcggtctcgcagttaagcacgcttatgccattgcactatcagcacgatttccgaccgtacctagcgtaccttcgtactcctccgttacgctttgggaggagaccgccccagtcaaactgcctaccatgcactgtccccgacccggatcacgggccaaggttagaacctcaaacaaaccagggtggtatttcaaggacggctccaccgaaactagcgttccggtttcatagcctcccacctatcctacacagatcggttcaaagtccaatgcaaagctacagtaaaggttcatggggtctttccgtctagccgcgggtagattgcatcatcacaaacacttcaacttcgctgagtctcgggaggagacagtgtggccatcgttacgccattcgtgcaggtcggaacttacccgacaaggaatttcgctaccttaggaccgttatagttacggccgccgtttaccgggacttcaatcaagagcttgcaccccatcatttaatcttccggcaccgggcaggcgtcacaccctatacgtccactttcgtgtttgcagagtgctgtgtttttattaaacagtcgcagccaccagtttattgcaacccttcaccctcctggcgcaggccagtcaagctacaagggcgtaccttatcccgaagttacggtaccaatttgccgagttccttctcccgagttctctcaagcgccttagaatactcatctcgcccacctgtgtcggtttgcggtacggtcatcattagactgaagcttagaggcttttcttggaaccacttccaattgcttcgcttccgaagaagctcgcgccacacccttgaattgcgcacccggatttgcctaagtgccttctccaatgcagcgaccgggacttccaacacccggacaaccttccgcgatccgtcccccatcgcatctaacaatggtgcaggaatattgacctgcttcccatcagctacgcatttctgcctcgccttaggggccgactcaccctacgccgatgaacgttgcgtaggaaaccttgggcttacggcgagggggcctttcacccctttatcgctactcatgtcagcattcgcacttccgatacctccagcaccctttacaaggcaccttcgcaggcttacggaacgctctcctaccatgcgtgcaagcacgcatccgcagcttcggtatatagcttagccccgttacatcttccgcgcaggacgactcgatcagtgagctattacgctttctttaaagggtggctgcttctaagccaacctcctgactgttttagccttcccacttcgtttcccacttagctatatttggggaccttagctggcggtctgggttgtttcctcttgacaccggacgttagcacccgatgtctgtctcccgtgattgcactcttcggtattcggagtttgctatggcggggtaatctgcaatagacccccaaccatgacagtgctctaccccgaaggtgagacacgaggcactacctaaatagttttcggagagaaccagctatttccaggtttgtttagcctttcacccctatccacagctcatcccctaacttttcaacgttagtgggttcggacctccagtacgtgttaccgcaccttcatcctggccatggatagatcacctggtttcgggtctacgcccagcaactgaacgccctattcggactcgctttcgctacgcctgccctatacggttaagcttgctactgaacgtaagtcgctgacccattatacaaaggtacgccgtcaccccttacgaggctccgactgtttgtatgcatgcggtttcaggatctatttcactcccctcccggggttcttttcgcctttccctcacggtactggttcactatcggtcgatcacgagtatttagccttggaggatggtcccccatcttcagacaggatttcacgtgtcccgccctacttgtcgcacacctagttctttcatactgttttcgcctacagggctatcacctgctatggccgcactttccagagcgttcggctaacaatacaaataaagagtgcaaggctcatcccatttcgctcgccactactttgggaatctcggttgatttcttttcctgcggttacttagatgtttcagttcaccgcgttcgcttcacatggcctatgtattcagccatggatactccaaaaggagtgggtttccccattcggacatctacggatcaaagctcgtttgccagctccccgtagcttttcgcaggctaccgcgtccttcatcgcctgtgatcgccaaggcatccaccacatgcacttgttcgcttgaccctataacgagtctgtctcatcgacagtcgctacaggttgagttctcgcgttgtgccgtattccaattgagtcaaacttagagttcgaatcatcttgagatacatcgatacaatcacaacccggatagttttcacgtccatctcaagacgcttccgctatccaaattacttacttcttccagattgttaaagaacgacagccgatactttcgtaccgctctgactggctcaatcgccaatgcaaaattctcggttcatcgtatgaaccaagcacttagcgttggtgattggtggaggcagacgggatcgaaccgacgacccctgcttgcaaagcaggtgctctcccagctgagctatgcccccattgagtacagataccctcaggtgttaccgccagacaatggtgggtctggttggattcgaaccaacgacccccgccttatcaagacggtgctctaaccgactgagctacagacccctgagtctgtctttaatttacagccgataagcgtgagcgctcaattttgcgagaagctctggaaaggaggtgatccagccgcaccttccgatacggctaccttgttacgacttcaccccagtcatgaatcctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctcccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccacctctcagcaggattccgaccatgtcaagggtaggtaaggttttcgcgttgcatcgaattaatccacatcatccaccgcttgtgcgggtccccgtcaattcctttgagttttaatcttgcgaccgtactccccaggcggtcaacttcacgcgttagctacgttactaaggaaatgaatccccaacaactagttgacatcgtttagggcgtggactaccagggtatctaatcctgtttgctccccacgctttcgtgcatgagcgtcagtattggcccaggggctgccttcgccatcggtattcctccacatctctacgcatttcactgctacacgtggaattctaccccctctgccatactctagcctgccagtcaccaatgcagttcccaggttgagcccggggatttcacatcggtcttagcaaaccgcctgcgcacgctttacgcccagtaattccgattaacgcttgcaccctacgtattaccgcggctgctggcacgtagttagccggtgcttattcttccggtaccgtcatccccgactgtattagagccaaggatttctttccggacaaaagtgctttacaacccgaaggccttcttcacacacgcggcattgctggatcaggctttcgcccattgtccaaaattcccactgctgcctcccgtaggagtctgggccgtgtctcagtcccagtgtggctggtcgtcctctcagaccagctactgatcgtcgccttggtaggcctttaccccaccaactagctaatcagccatcggccaaccctatagcgcgaggcccgaaggtccccgctttcatccgtagatcgtatgcggtattaatccggctttcgccgggctatccccactacaggacatgttccgatgtattactcacccgttcgccactcgccaccaggtgcaagcacccgtgctgccgttcgacttgcatgtgtaaggcatgccgccagcgttcaatctgagccaggatcaaactcttcagtttaaacctgttactgttttcggttcagttaagaaccggtcgctcactcaaagctgacaggaatatgaattgcttcataaacctgacttactttagtgtgagactcttgatacttttgctatctgatccgaggatcagctcgcttccatcaagcgcccacacttatcggctgttaatttttaaagagcaatctgcgaggaacttcgtgtttcccggcagcgctgcgttttcagcagcagagaagcgagattatgaaccgtgtttcgcagctcgtcaacaactttttacactacatcgttgcgactgcggggttcaacttccaggccagccgcgcgcccgacactgcagcacaccaccagctttgcttccctctcccgcgctgcgtttccgttagcgcgaaagaggcgtgattctaagcacccgcccccatctgcgcaagccctttgtgaaaatattttgaaagccccgtgcgctggcgcgcacggggctggggctcggcaggccgaggattattacatcgacaaccgataccaaccaggcaccggccacctacttcgggcagcgcaatcagcggtgcttgaacaccggcttccgcttttcaacgaatgccgccatcccctccttctgatcttcggtcgcgaacagcgaatggaacagccggcgctcgaagtgaacgccctcggccagcgtcgtctcgtacgcacggttcaccgactccttgaccatcatgaccgccggcagcgaaaactcggcgatcgtcgccgcagcggcaatcgcctcgtcaagaagcgtcgcggccggcagcacgcgcgacacgagccccgcacgctccgcttcggctgcatccatgaagcgggccgtcaggcacatatccatcgccttcgccttcgacaccgcgcgcggcagacgctgcgtaccgcccgcacccggcatgacgcccagcttgatttccggctggccgaacttggccgtgtccgccgcgaagatgatgtcgcacatcatggccagctcgcagccaccacccagcgcaaagcccgacaccgccgcgatgatcggcttgcggatttcgcgtaccgtctcccagttacgtgtgatgtagtcgccccggtagacatccatataggaataggtcgccatcatgccgatgtccgcgccagccgcgaacgccttctcgctcccggtcacgacgatcgcgccgatgccatcgtccgcatcgaacgccttcagcgcatcacccagttcatccatcagcgcatcgttcagcgcgttcagcgccttcggacggttcagcgtaaccagcccgacacgccccgggtctccaccaggatgttctcgtaagccatctatttctcctcgatcaatgaaatgagaaacgcctcgcacatgcgaatagtttgatgctaccattctccgaccaaccggtcggttaattaatcgatccaacccctctcatcgtccatcaggctgccgccatgacccatgcactgttcacgaagcacgaagacacgctgaagcacgcactcgccgccatcgagagccgcgggtactggagcccgttcgccgaaatgccgagccccaaagtgtacggggaaagcgcgaacgcagatggcgaggccgcgttcaagtcatacctcgacaagacgttcgtgctcgaccagccggcgtccgaagaaacggtcggcgcggaacggtcgccgtacggcatcgcgctgggcatccggtatccgaagtcgacgcccgacgaactgatcgccgccgctgccgccgcgcagcgttcatggcgtgaagccggcccgagcgcctggatcggcgtcagcctcgaaatcctcgcgcgcctgaatcgtgcgagcttcgagatcgcctacagcgtgatgcacactacggggcaggcattcatgatggcgttccaggccggcggcccgcacgcgcaggatcgcgcgctcgaggcagttgcctatgcgtgggacgaactgcgccgcattccggccgatgcgcactgggagaagccgcaaggcaagaacccgccgctcgcgatgcacaagcgctacacgatcgtcccgcgcggcaccggcctcgtactcggctgctgcacgttcccgacctggaacggctacccgggattgttcgccgatctggccaccggcaacaccgtgatcgtcaaaccgcatccgggcgcgatcctgcctctcgcaatcacggtccggatcgctcgcgacgtgctgcgcgaagccggcttcgatccgaacgtcgtcacgctcctcgcgaccgaacccaacgacggcgcactcgttcaggatctcgcgctgcgccccgagatcaagctgatcgacttcaccggcagcacgcaaaacggcacgtggctcgagcgccatgcccaccaggcacaggtctatacggagaaggcaggcgtcaaccagatcgtgatcgactcgaccgacgacctgaaggccaccgccaagaacatcgcgttctcgctggcgctgtactccggccagatgtgcacggcgccgcagaacatctacgtgccgcgcgacggcatccggacggcggacggccatgccagcttcgacgaagtcgcacaggcaatcgccgttgcagtgcagaaactcaccggcgatccggcccgctcggtcgaactgatcggcgcgatccagaacgaaggcgtgaccgcacgcatcgacgacgcccgccagctcggccgcgtgctcgccgacagccttaccctccagcaccccgcgttccccgatgcccgcgtgcgcacaccgctcgtgctgcaactcgacgtggccgatcgcgagaaattcacgcaggagtggttcggcccgatctcgttcgtgatcgcaaccgactcgaccgcgcagtcgctcgatctcgccggtgagatcgcggcagaacatggcgcgctgacgctctccgtctacagtaccgacgaagccatcgtcgatgctgcacacgatgcggcggtgcgcggcggcgtcgcgctgtcgatcaacctgaccggcggcgtgttcgtgaaccagtcggcagcattctcggatttccacggcacaggcgcgaacccggcagccaacgcggcactggcggacccggcattcgtcgccaatcggttccgcgtcgtgcaaagccgcgtccatgttgcgccgaaagcggcacccgcggaagccggtcaacctgcataacccgaatggtcgacgtgcaaacgccgccacgttctctaccatgaacgaatccgccacccggcgggttcgttgctcatcgatacgcccatgacagacgcctatatctgcgacgcgattcgcaccccatcggccgctacggcggcgccctgaaagatgtccgcgccgacgacctcggtgcggtaccgctcaaggcgctcgtggagcgcaaccgcgacgtcgactggtcagcgatcgacgacgtgatctacggctgcgcgaaccaggccggcgaggacaaccgcaacgtcgcgcgcatgtccgcgctgctagcggggctgccgaccgacgtgcccggcacgacgctgaaccgcctgtgcggctccgggatggacgcggtcggcactgctgcgcgcgcgatcaaggccggggaggcgcgcctgatgatcgcgggcggcgtcgagagcatgacacgcgcgccgttcgtgatgggcaaggccgcgagcgcattcgcgcgccaggccgatatctacgatacgacgatcggctggcgcttcgtcaatccgttgatgaaacagctgtatggcgtcgattcgatgcctgagacggccgagaacgtcgcggtcgactacaacgtcagccgcgccgaccaggatctgttcgcgctgcgcagccagcagaaggccgcgcgtgcacagcaggacggcacgctcgccgaggaaatcgtcgcggtcacgattccgcagaagaaacgcgatccgctggtcgtctcgcgcgacgagcatccgcgcgaaacgtcgctcgaagcgctcgcgaagctgaaaggcgtcgcgcgcccggacggttcggtgacggccggcaacgcatcgggcgtcaacgacggtgcgtgcgcgctgctgctcgccaatgcacaggcagcggaccagtacggcctgcgccgccgcgcacgggtcgtcggaatggcgacggccggcgtcgcgccgcgcgtgatgggcatcgggcccgcaccggccacgcagaaactgctgcgccagctcggcatgaccatcgaccagttcgacgtgatcgagctgaacgaggcgtttgcgtcgcaaggtctggcggtgctgcgcatgctcggcgtcgccgacgacgatccgcgcgtgaacccgaacggcggcgcaatcgcactgggccatccgctcggcgcatcgggcgcgcggctcgtgaccacggcgctccaccaactcgagcgtacgggcggccgctttgcgctctgtacgatgtgcatcggcgtcggccagggtatcgcgctcgcgatcgaacgcgtgtaacccatgcaccgcgcgcctataacgaagtcatgaaggagacactgcatgtcctatcaggcgattcagctggatatcgatcgcgcctcgaacgtggccacgattaccctcaaccgccccgacaagctgaacagctttacgcgggcgatgcatcgcgaactgcagtcggcactcgatgatgtcgaggcggccggcgcgcgcgcgctgatcctgactggcgcggggcgcggcttctgcgcgggccaggacctcgccgatctcgacttcacgccgggcgcgtccaccgacctcggcgcgctgatcgacgagcacttcaatccgctgatccgccgcctgcagcgtctgccgattccggtcatcgccgccgtcaacggcaccgcggccggcgccggcgcgaacctcgcgctcgcgtgcgatctcgtgttcgccgcccgctcgagcagtttcatccaggccttcgtcaagatcgggctcgtacccgattcgggcggcacatggttcctgccgcaacgcgtcggcatggcacgcgcgctggggctcgcgctgaccggcgacaagctcggcgccgaacaggccgagcaatggggcttgatctggcgcgcggtcgacgacgacaccctcgctacgtcagtccgccagctcgccacccagcttgcgcagcagccgacgctcgcgatcgcatcgatcaagcaatcgatgcgcgacagcgtcacgaacacgctcgaccagcaactcgaccaggaacgcgacctgcagcgcaagctcggtcagtcgtacgactatgcggaaggcgtgaaggcgttcatcgagaagcgcgcgccgcgcttcgagggcgttgacatgacggacgccactgccacgctcgaccccgactccctcgcccgtgccgccgcgcgagccatgtacgacgccgacgcatgcagccgcgcgttcgggatggaaatcgccgaagtgcgcgccggctacgcgcgcctgcaaatgcgcgtgcggcccgaattcctgaacgggcatcagacctgccatggcgggatcatcttcacgctggccgattcgacgttcgcgttcgcatgcaactcgtacaacgtgaacgcagtcgcggccggctgctcgatcgaattcctgcgccccgtgcacggcgacgacgtgctgacggccgaggcgatcgagcaggcacgcgccggccgccaagggatctacgacatccgcgtcacgaaccaggccggagaaaccgtcgcgatgtttcgcggcaaatcggcccagatcaagggtacggtcatcccggaagaccgctgacgtcgacggctcgcacataacaaacactggagacatgcatgactaccccgctaccgctcgagccgatcgagaccgcctcacgcgacgagctgaccgcgctgcagctcgaacgcctcaagtggtcgctccggcatgcgtatgaccactctcccgtctatcgtcgcaagttcgacgacgcgggcgtccatccggacgacctgaagacgctcgccgacctgtcgcgcttcccgttcacgacgaagagcgacctgcgcgacagttacccgttcgggatgttcgcggtgccgcaggaccagatctcgcgcattcatgcgtcgtcgggcacgaccggcaagccgacggtcgtcggctatacggccggcgacatcgacacatgggcgaatctcgtcgcgcgctcgatccgcgccgccggtgcgcgccgcggcgacaaggtgcacgtgagctacggctacggcctgttcacaggcgggctcggtgcgcactacggcgccgaacgcgctgggctgaccgtgatcccgttcggcggcggccagaccgaaaagcaggtgcagctgatccaggatttccggcccgacatcatcatggtgacgccgagctacatgctgtcgatcgccgatgaaatcgagcgccagggtctcgatcccgtgcagagttcgctgcgcatcggcatcttcggcgcggaaccgtggaccaacgacatgcgcgtcgcgatcgagcagcggatgggcatcgacgcggtcgacatctacgggctttccgaagtgatgggccccggcgtcgcgtccgaatgcgtcgagaccaaggacggcccgaccatctgggaagaccacttctatccggaaatcatcgaccctgaaacgggcgaagtgcttccggacggcgaactcggcgagctcgtgttcacgtcgctgacgaaggaggcactgccgatcgtccgctaccgcacccgcgacctcacgcggctgctgcctggcactgcccgcacgatgcgccggatggagaagatcacggggcgttcggacgacatgatgatcgtgcgcggtgtcaacgtgttcccgacgcaaatcgaggagcagttgctcaagcagcgcgcactcgcaccgcactatcagatcgtactgacgaaggaaggcccgctcgacgtgctgacgctcaatgtcgagccctgtccggagactgcgcccgatacggcggcgattcatgcggccaaacaggcgctcgcacacgacatcaagtcgctgatcggcgtgacggccgtaatcaacgtgctgcccgtgaacgggatcgagcgttcggtcggcaaggcgcgacgcgtcgtcgacaagcgcaagggctgacggcaatcgctgcgcgtgcacgacgtgcggtgaatccgcggctgcaaatgaaacagcccgatcggccaacgccgatcgggctgtttcattccgggccgcctcaagtcacgagttcgggaacagcagccacatccggccgacctgcttcatccgcccggcctgatcgcctgcgtcgtcgccgagcccccagaaatagtcggcccgcacgccgcccttgatcgcggagcccgtatcctgcgcgaacacgagccggttcatcggcgtattcgtcagcgggcgcgtggtctgcaggaacaccggcgtgccgagcgggatcgacgacgggtcgaccgcgatcgagcgttccggcgtcagcggtacgccgagcgcgccgatcgggccgtccgcaccaccgtgcggcgcatcctccttggtcggcatgtcgcggaagaacacgaaccgcgggttcgtgtcgagcaacgcgtcgacgcgattcgggttcgccttcgcccacgccttgataccctgcatcgtcgcctgggcgggcgtcagttcgccgcgatcgagcagccacttgccgatcgaacggtacggctggttgttggtgccgccgaagccgacccgcatcaccgaaccgtcgtcgagcagcacgcgccccgagccctgcacctgcaggaagaacgcctcgatcgggtcgtcgacccacacgagttcgttgccgttcaggatgccggcgcgttcgagctgcgcgcgtgccggcagcgcggcgcccgcgcgataaccggccggccagcggtacagcgcgtactgatacgggccacgacgcacgcgcgaaccatgcagcagcggctcgtaatagccggtcaccagcccgtcgagcgtaccgtcggtgttcgcgaactggaacggcgtgaaatacgtttcgaagaatgcccgcgcactgctgacgtcaagctcgtcgagccggtcggcagccgcacacgcacgctgccaggccggctggcgcgcgagccgcgcgcagttctgccgcaacgcggccgtcgcgccgatcagcgaatcgtcctgccaacccggcacctgctgccacgcgaccggcgtgagtcgcttcgcggcgacctgccccggcacgatcgccgcgcccgtcggcggcttcagcgacgaagtccgcgtcggcgcgctgccgcacgccgcaagcagcgccgccgccgcgaccgctgccgcccacccggccaaccggggcccaaaccacatacaatgtccgttcttgatggaaaccgccatgtcagattttctcgaccaatatccgatgctcatctttgcgctcgaagccttcgtagcgcttgccctgctgatcttcatcgtcgtgtggacgtcgtcgggcagaaagaagcacgcccgcggcaacaacgaccgccagccgcgctgacgcgcttcgcacgctcaatgcagcgtgcgcggcatgtggagtgcgaactcgtcgaccggcgcctcgaaacgctcgccgtcttccgccacgcagaagtacgcgccccgcatcgtaccgaccggcgtcgcgatcacggcccagctcgtgtattcgaagtgctcgcccggctgcagcagcggctggtgcccgacgacgccgagccccttcacctcctgcacgtggttctcgctgtccgtgatgatccagtgacgcgcgatcagctgcgccgcgacttgtcccgtgttgcggatcgtcagcgtgtacgcgaatgcgtattgacggcgatcggggtcggattgttccggcaagtagctggttttcaccgaaacggtgaactgatactgactcatgatgtttccggtggaaggtgactgtccgtgccggcatgggcaacgggccgcgggcgcgccgcattggttcggcattctatgcgcaatcgggcctcggccgcacgacccgccgccgcgcacgggtcgccggacggtagaatgtcggttttgcgccgcaacgtccccgctcccctgccatgacccaattccgtatcgctcccagcatcctgtcggccgatttcgcacggctcggcgaagaagtccgcaacgtcgtcgccgccggcgccgactggatccacttcgacgtgatggacaaccattatgtgccgaacctgacgatcggcccgctcgtgtgcgaagcgatccgcccgcacgtgcaggtgccgatcgacgtgcatctgatggtgcgcccggtcgaccggatcgtgcccgattttgcgaaggccggtgcaaacctgatcagcttccacccggaaggctccgatcacatcgaccgcacgctgtcgctgatccgtgaccacggctgcaaggccggtctcgtattcaatccggcgacaccgctgaactacctcgatcacgtgatggatcgcctcgacttcgtgctgctgatgtcggtcaacccgggcttcggcggccagtcgttcatcccggaaacgctgaacaagctgcgcgaggcacgcgcacgcatcgacgcgtacaccgagcgcaccggccgcgagatcctgctcgaagtcgacggcggcgtgaaaaccgacaacatcgcggaaatcgcggcggccggtgccgacaccttcgtcgcgggttcggcgatcttcggcaagcccgactaccgcaaggtgatcgacgagatgcgcgccgcgctcgctaccgtcgagcggagctgacgtcgtggccgattcgtcgctcgccggccatgcgccggccggggccgcaaccgaagccgccccgatccgcttcgccgcgccgcgcatcgacgcggcgctgatcgatctcgacggcacgatggtcgacacggccgacgatttcacggccggcctcaacgggatgctcgcgcagctcggcgcgccggccacgtcgcgtgacgaggtgatcggctacgtcggcaagggctccgaacacctgatccagagcgtgctgaaaccgcgcttcccggccgacgaagcgcacgcgcgcttcgacgacgcactggcgatctaccagaccgaatacgcgaagatcaacggccgccacacgcgcctctatccggacgtagccgccggcctcgacgcattgcgtgcggccggcatccggctcgcgtgcgtgacgaacaagccgcatcgcttcgccgtcgaactgctcgagcaatacgggctggccgattgcttcggcgtcgtgctcggcggcgacagcgtcgcgcgcaagaagcccgatccgctgccgatgctgacggcctgcagcgcgctcggcgtcgctccggatgcggcagtcgcgatcggcgactcggaaaacgatgcgctggccggccgcgcggccgggatggcgacgctgactgtgccgtacggctacaaccacggcaaagctatacaaacgataaattcggatggtatagtcgattcgttgctggtcgcagctcgcgcaattaccgcgcacaacaccggccggccaaccatctgattatttcttccatctgcatgtttctgaataaaaacggagtctgagcagcatcgaccggggagcctggccctggcgtcgctggtcgcgctaacctcttcgatgaggtacgctgaagcacgtcttcagcgccgttttttatctcgctgcgcatccgcgcgccgaccgtcgcaccacctcgagttccaccgcgtccgaacgcttgcgttcaggatcggccgcaggctcgcgacgttcacgcccggagtgccggccggcaacaggcacttctcgatcgaccgccctttcgccgacggcaacccgcgcagcgtcaaatgatccctggcgcacgcgccgctcgtcccgaacaggaccggaacatgaccgaactcgaattccaatcgctcgcgaacgaaggctacaaccgcatcccgctgatcgcggaagccctcgccgatctcgaaacgccgctgtccctctacctgaagctggcccagcccgaacgcgcgggcgccaactcgttcctgctggaatcggtggtcggcggcgaacgcttcggccgctactcgttcatcggcctgccggcccgcacgctcgtccgcacccgtaacggcgtgtcggaagtcgtgcgcgacggccaggtcgtcgagacgcatgaaggtgacccgttccagttcatcgaatcgttccaggcgcgcttcaaggtggcgcagcgcccgggcctgccgcgcttctgcggcggtctcgccggctacttcggctacgacgcggtgcgctacatcgagaagaaactcgcgaacaccgcgccgcgcgacgatctcggcctgcccgacatccagttgctgctgaccgaggaagtcgcggtcatcgacaacctcgccggcaagctgtacctgatcatctacgcggacccgagccaggccgaagcctacacgaaggcgaaacagcgcctgcgcgaactgaaacagcgcctgcgcacgaccgtgcagccgcccgtcacgtcggcgagcgtgcgcaccgaaaccttccgcgagttcaagaaagacgactatctggccgccgtgcgccaggcgaaggaatacatcgcggccggcgagctgatgcagatccaggtcggccagcggctgacgaagccgtaccgcgacaatccgctgtcgctgtatcgtgcgctgcgttcgctgaacccgtcgccgtacatgtactactacaacttcggcgatttccacgtggtcggcgcgtcgccggaaatcctcgtgcgccaggagaagcgcggcgaagaccagatcgtcacgatccgtccgctcgccggcacgcgcccgcgcggcaacacgcccgagcgcgatgccgaactcgcgaccgaactgctcaacgatccgaaggagatcgccgagcacgtgatgctgatcgacctcgcgcgcaacgacgtcggccgcatcgcggaaatcggctcggtgcaggtgaccgacaagatggtcatcgagaaatactcgcacgtgcagcacatcgtcagctcggtcgaaggcaagctgaaacccgggatgacgaactacgacgtgctgcgcgcgacgttcccggcgggcacgttgtccggcgcgccgaaggtgcgcgcgatggaactgatcgacgagctcgagccggtcaagcgcgggttgtacggcggcgccgtcggctacctgtcgttctcgggcgagatggatctcgcgatcgcgatccggacgggcctgatccacaacggcaacctgtatgtgcaagcggcggccggcgtcgtcgcggattcggtgcccgaatccgaatggcaagagaccgagaacaaggcgcgcgcggtgctgcgtgcggccgaacaggtccaggacggcctcgatagcgacttctgaccggagactgaccatgctgctcatgatcgacaactacgactcgtttacctacaacctggtccagtacttcggcgaactcggcgaggacgtacgcacctaccgcaacgacgaaatcacgctcgacgagatcgcgcgcctgaatcccgacgcgatctgcctgtcgcccggcccgagcaacccgcaacacgcgggcatcacgctcgacgtgctgcgtgaattttcgggcaagaagccgatcctcggcgtctgcctcggccatcaggcgatcggcgaggcattcggcggccgcgtcgtgcgcgcgaagaccatcatgcacggcaaggtaagcaagatcgaaaccgactgccgcggcgtgttcgccgacctgccgaagcatttcgacgtcacgcgctaccactcgctcgcgatcgagcgcgaatcgctgcccgactgcctcgaggtgtccgcgtggaccgacgacggcgagatcatgggcgtgcgccacaagacgctgccgatcgaaggcgtacagttccacccggaatcgatcctgtccgagcatggccatgcactgctcgagaatttcctgaaacaggcacgcgccgcagccgcgcaagccgcctgacgggagcctcacgatgacgattaccccgcaggaagcgctgcagcgcacgatcgaacaccgcgagatcttccacgacgagatgctgcacctgatgcggctcatcatgcgcggcgacatgtcgcccgtgatggcggccgcgatcatcaccgggctgcgcgtgaagaaggagacgatcggcgagatcgccgcggccgcgaccgtaatgcgcgaattcgcgaaccacgtcgaggtgcaggacaactcgaacttcgtcgacatcgtcggcaccggcggcgacggctcgcatacgttcaacatctcgaccgcgtcgatgttcgtcacggccgcggccggcgcgaaggtcgcgaagcacggcaaccgcggcgtatcgagcaagtccggcagcgccgacgtgctcgaggcgctcggcgtgaacatcgacctgcagtcggagcaggttgccgcgtcgatcgccgaaaccggcatgggcttcatgttcgcgccgaaccatcacccggcgatgaagaacatcgcggccgtgcgccgcgaactcggcgtgcgcacgatcttcaacatcctcggcccgctgaccaatccggccggcgcgccgaaccagctgatgggcgtgttccaccccgacctcgtcggcatccaggtgcgcgtgatgcagcgtctcggcgcacagcacgtgctcgtggtgtacggcaaggacgggatggacgaggtttcgctcggcgccgcgacgctcgtcggtgaattgcgcgacggcaaggtgcacgaatacgagatccatccggaagatttcggcctgcagatggtgtcgaaccgcacgctgaaggtggaaaatgccgacgaatcgcgcacgatgctgctcggcgcgctggacaaccagccgggcgtcgcgcgcgagatcgtcacgctgaacgcgggcaccgcactctatgcggcgaacgtcgccgaatcgatcgcggacggcatccagctcgcccgcgaagcgatcgcgagcggcaaggcccgcgcgaaggtcgacgaactcgtgcgcttcacgcagcagttcaagcgctgactccttacgaatcaagcaggaacccacatgagcgacattctcgaccgaatcatcgccgtcaagcgcgaagaagtcgcggcggccatgcgcagcgcgccgctcgaggcactgaaactggaagcctccgcgcgcgacctgcgcgacttcgtcggcgcactgcgcgcgaaacacgcagccggccacgcggccgtgatttccgaaatcaagaaggccagcccgtcgaagggcgtgctgcgcgagcatttcgtgccggccgacatcgcccgttcgtatgcggagcacggcgccgcgtgcctgtcggtgctgaccgacgagcagttcttccagggcagcgtccgctatctcgaggaagcgcgcgcggcctgcacgctgccggtgctgcgcaaggacttcatcgtcgacgcgtaccagatcgtggaagcgcgcgcgatgggggcggacgcgatcctgctgatcgccgccgcgctcgacacgccgctgatgcaggatctcgaagcgtatgctcactcgctcggcctcgcggtgctggtcgaagtgcacgaccgcaacgagatggaacaggcgctgacgctcaagacgccgctgctcggcatcaacaaccgcaacctgcgcacgttcgagacgtcgatccagaccacgctcgacatgctcgacatgattccggcggaccgcatcgtcgtgaccgagtcggggatcctgtcgcgcaccgatgtcgacacgatgcgcgcggcgaacgtgaacacgttcctcgtcggagaagcgctcatgcgtgccgaccagccgggcgaggagctcgcacggatgttcttctgatggcgattgaaaaggaaatcaagctcgcgctgccggccggccaggccgaggccgcgcgacgcttcttcgagacgctgaccggcgaacccggccacgacatcacgctcgcgaacgtctactacgacacgcccgatctcgcgctggcccgctcgaagagcgcggtgcgcgtgcgccgcgcgccgcagggctggctgcagacgttcaagacggtcggcagcgcggaaggcggcctgcaccgccgccacgaatgggagctgccggtcgccggcgacgcgctcgagatcgatgcgctcgtcgcggcctgcgacgtgccggaggccgccgccgcgctgaatgacgcggccggcgcgctgcgtgcgctgttccgcacggatttttcgcgtacgctgtggcgcatcgcaatcggcggcgcaaccgtcgaagccgcggtggacatcggcgagatcgtcgtccaggcggaacacgaaacgcgccgcgaaccgatcagcgaaatcgaactcgaactgatcgacggcccggaagcggcgctcgcaacgctcgccgccgaactgcagcaggcgctgccgggcctcgctcccgaaaacatcagcaaggcgcagcgcggctaccggctgcgcgcgcaataacacgcatcacgcatggcaacccgcaagacttcccgcgcgccgcaacaggcgtcgctgttcgacgatcccgtgccggaaacggcaccggccgatcatccgtccccgccttccgagccgcccgcggccgggcgcaagcccgccaagaaagccgccgcatcggctgcggcaccagcggcaccggcggccccgcagcctgccgccgccaacgttccgcacctcgccgcgcaattcgacgcgctgcctgccgtctggcgcgacgtgctgaaacccttaccgacagcgacgcatatgcgccgctgtgccgcttcgtcgacgacgagcgtgcggccggcaagacggtctacccgaccgacgtgttccgcgcgctgcgcctgacgagcccggacgacgtgaaagtcgtgatcctcggccaggatccgtatcacggcgacgatcgcggcacgccgcaggcgcacgggctcgcattctcggtgccgcccgccgtgcgcacgccgccgtcgcttcgcaacatcttcaaggaaatcgccgcgaacttcggtcatgacacgccacgccacggctgcctcgacacctgggcacgccagggcgtgctgctgctcaacacggtgctgacggtcgagcgcggcgcggccgcgagccatgcgaagcgcggctgggagcagtgcacggacacgctgatccgcgaactcgccggccgccatcgcgggctcgtgttcatgctggggcgcacacgcgcaggcgaagcgcgcgctgttcgacgcaagcgcgcattgcgtgctcgaggcgccgcatccgtcgccgctgtccgcgcaccgcggtttcctcggttgccgccatttcgcgctcgcgaacgactatctggtcgatgccggccgcgagccgatcgactggcgcctgccggaagtcgccgaaacgctcgcgtaacgcgctgccggttccttcgtgccggcaagcataaaaacgccgcgtccctttcgggaacgcggcgtttttatcggcaatgcagcaggtgcgtcgcacccgcgtcggccttccttacgcggcggcgatcgcttcgcgtgcgctggcgagcgcggcgctctgcgcgtccggcccgaggttcaggccttcagcgtgaatgaagttcacgtcggtcaggccgatgaagccgaggaacgagcgcaggtacggcgtctggctgtcgttcggcgtacccaggtacttgccgccgcgggccgtcaccacgtgaaccttcttgcccttgatcaggccttccgggccgttctcggtgtagcggaacgtgacgcctgcacgggcgatccagtcgaaatacgccttcagttgcgacgacacgccgaagttgtacatcggtgcgccgatcacgatgatgtcggcggcttgcagttcggcgatcagtgcatcgctcttcgcgacgatcgcattctgttccgcggtgcgcttgtcggccggcgtgaagaacgcgccgagcaccgattcgtcgaggtgcggcagcgcatcggccagcaggtcacgaaccacgaccttcgcgccggggttcgattgttgcagctttgccgtcagttcgttggccagcagcgtggattgcgcaccttgcgaacgcgccgcggaattgatttgcagaatggtcgtcatgtcaggctccagtagggttgcgcttcggtagcgcgagtgacgtcattgtgcgtggccgcatgaccgcgaaaaagcgggttcagggcgacggattgttgcaacaacagaacaatcctcgatcgcgccccgatacccgccttcgtacgatcagcccttcagccaggcttcccgggccttcgataccgccgccggcttcgcggccgccgtcagccggtagcgcgtgacttcggggccgtcgagcttcagtttcgcggtgcgcagctcgtcgcgccggaatgcgtgaacctcgaccttgtcgcccggccggtagcgcgcgagcagcgcgtcgaggttggtgcccgtgacgcgcagcccgtcgaccgcgatcagcgtgtcgccggccgacagccccgcgcgatgcgcggcgccgccttcgtagaccgccgcgaacgtgcagtccgccccgccgcgcaggcgtgcgccgatcgtcggcttcgcggccgcgccgttcgcgacatccggcgtgagcgtcacgccgaacggtgcgagcagctcggcgagcggcaggtcgcgcgtgccgtgcacggcatcggtgaacaggcggccgagcgcgacgcccgtcgcttcctcgatcagcgtctcgacttcgttctcctcgacgcccgcctgcttgccgcggtagaaatcgcggccgtagcgctgccacagcaggcgcatcacgtcgtcgagcgacttccggttgcgcgtctgcgcgcggatcgcgagatcgaacgcgagcgcgaccagcgaacccttcgtgtaatagctgacgatcgcgttggtcgcgttctcgtcctggcggtagtacttgatccacgcgtcgaacgagctttccgcgacgctttgcttgagccggcccgtgccgcgcagcacgccgccgaccgtgcggccgagcgccgcgaaatattcgtcctgcgacatcagcccgctgcgcaccagcatcaggtcgtcgtaatacgacgtgaagccttcgaacagccacagcagcgacgtgtaattctcgcgcgtcaggtcgtacggcacgaacgccgccggcttgatgcgcttcacgttccaggtatggaagtactcgtgactgcagagaccgaggtacgtgcgatagccttccgtcgtttcgggtcgccccttcgccggcaggtcggtgcggttgcagatcagcgcggtcgacgcgcgatgctcgaggccgccgtaaccgtcgcagaccgcaagcgtcatgaacacgtaacggtccatcggcgccttcttcgatttcggctcgaacagcgcgatctgtgcttcgcacacgcgcttcaggtcggtgcgcaggcgctccatgtcgagctgcgtcacacgccccgcgatcacgatgtcgtgcggcacgccgtgcgcgtcgaacgtcgccagcgcgaattcgccgatcgtcaccggatggtcggaaagctcgtcgtagttcgctgcgcggtacgcgccgaacccgtagcgcttcgtgccgcgcgcctcgggcaacgcagtgccgacgcgccacgtgcggaacgccgcgccggccggcttcccgatgtcgacttcacacggcgcgtcctcgcggccggcgacgctcaggaacacagccgtcgcgttgaagaagccgcccgattcgtcgagatacgcggagcgcaccgacaggtcccacgcgtacacgtcgtagcgcagcgtcagcgtgccgttcacgggtgcggcctgccacgtgtgcttgtcggtctttgcgatccgcaccttgcggcccgcgtcgttgaatgcgccgagcgtcacgatgttgcgcgcgaactcgcgcacgaggtagctgcccggaatccacaccggcagcgaaaagcgctggccttcggggtcgggatcggtgaccgtcaccgacacttcgaacaggtgcgcggcaagatctttcgggacaatcgaatagcggatcggctgggtcatcgtggcaatcggacggtcgaatacggcggcggaaacgaagagaggcgccggcaggtcacgcgggcgcccctcgctggccgggccatgcggcccggcgtctggtcggttacttgctcgacgcgagcgcctggttgagctggtcggccgatacggcgcccggcaggcggcggccgtccggcaggaagatcgtcggcgtgcccgtgacgttcatcccgcggccgagcgcgaggttcttgtcgagtgcggcggtatcgcaggtaccggcgccggtcggtgcgcgatggtcgagcatccagctctcccacgttttcgcgcgatcggtcgcacaccagatcgccttcgacttcgcggtcgaatccggcgacagcaccgggtacaggaacgtgtagacggtcacgttgtcgaccgactgcagcgtcgtctcgagcttcttgcagtacgggcagttcggatcggagaacaccgcgatcttgcgggcgccgttgcccttgacgaccttgatcgcattcgcgaacggcaggctcgcgaagtcgatcttgttgatttcggacaggcgggcgtcggtcaggttcttgtgcgtcttggtgtcgacgagatcgccgagcagcacgtagtcgcccgccgcatcgctatagatgatctgcgagccgaggttcacttcgtacaggcccgcgaccggcgatttcgacacgctcttgatcggcgcatcgttgccgaggcgggcctgcagcgtggctttcagcttgtcggtggtctggtcggcctgcgcggtgcagccaagcgtcgccatcgtgacggccagcgccagcgacgcgatgcggatcgttttttcatcgaaatcttccttcagctcaatcggtgttcacggcacagtgtacgccgtaacggaaccgtgtccgaccggcgaagcggccgaaggttcgatcagccgagtgcggccgacacgagccagcgcttcacgagcggctgcgcaccgacgaaggccatgcccgcattgcgcacggccttcgcgagcgagcccggcaccgcgaacaaccgctgcaggccgtcggttgcgaccatcagcgcgcggatgtcctcgcggcgcgaacgctcgtagcggcgcagcagcaccgtatcgccgaggttgcggaaactttccttgccggcgatcgcgtcggcaagcgccgccacatcgcgcaggccgaggttcatcccctgtcccgcgagcgggtggatcaggtgcgcggcatcgccgacgagcgcgacgcgcggcgcgatcagcttgtcgaccgtctgcagcgccagcggaagccggcggccggcgtcacgcagtcgagcgtgccgacctggccatgagacacgcgctcgacctcggccgcgagctgcgccggatcgagtgcgagcaattcgtccgcatgcgcggtgtgcgcggaccagacgagcgacacatggccgtccggcagcggcagcagcgcgacgatctcgccttcgtgaaaccactggtaggccgtctcgcgatgcggcagcgacgccttgaagttcgcgacgacaccggtttgccggtagtcgcgccgctcgactttggcccccatttgcgagcgcacccacgaatgcgcgccgtccgcgccgacgacgagatccgcttccagcacctgccccgacgacagcgtgagcacggctgcgtcgtcgtgtacgtcgaagccctgcgcgcgcgcctcgaaccacgtgaggttcggctggaaccgcagcgcggcgtcgagcgacgcctcgaccagcgacgattcggcgatccacgcgagctgcggcacggatgcctggtacgcggaaaaatgcagttccgcgtgcgcatcgccgtacacgcgcatgtcgtagaccggtgcgaggcggccatggtcgagcgcctgccagacccgcagccgctcgagcaacgcctgcgaactggaagacagcgcgtagacgcgcgtgtcgaatacgagatcggcggggcgcggcgcggccggctgggcgagcaaggcagtcttgtagccggactgggtcagcgcgagcgcggcagtcttgccgacgagcccgccgccgaccacggcgacgtcgaaggagtggtgggcagtcatggcgggcattatagccgcggggccaaacccttacgcggccggactttgcgggaaatcagcagaatcgcaggcggccgatgccgcgcggcggcccgccgcatcggccgttcggcgccggcccgcaatccgggggcgtcggcacggtacaatagcgtctttgaccgtcggcccgccgcgccccaagcgccggccgccctttttcccgcgccgccgtgccctgtccggccgcgccgccttacccgtccgaaggattccatgagtctcaaatgcggcatcgtcggcttgcccaacgtcggcaagtccaccctgttcaatgcgctgaccaaggccggcatcgccgccgagaactacccgttctgcacgatcgagccgaacgtcggcatcgtcgaagtgcccgatacgcgcctgaaggcgctctccgagatcgtcaagccggagcgtgtcgtgccggccgtcgtcgagttcgtcgacatcgcgggcctcgtcgcgggcgcgagcaagggtgaaggcctcggcaaccagttcctcgccaacattcgcgaaaccgatgcaatcacgcacgtcgtgcgttgcttcgaggacgagaacgtcattcacgtcgccggcaaggtcagcccgatcgacgacatcgaagtgatcaataccgaactcgcgctcgccgacctcggcaccgtcgagaaggcgctcacgcgctattcgaaggccgcgaagtcgggcaacgacaaggaagcggcgaagctcgtcgcggtgctcgagaaggtgcgcgcgcagctcgaccagggcaaggccgtgcgcggtctcgcgctgtcggacgacgaagaggcgctgctcgccgttctgcctgatcaccgcgaagccggccatgtacgtggccaacgtgaaggacgacggtttcgagaacaacccgcacctggatgccgtgcgcaagtacgcggaaagcgaaaatgcgccggtggtcgccgtgtgcgcggcaatcgaggcggaaatcgcggatctcgacgatgccgacaaggaagcattcctcgccgacatgggcatggaggagccgggcctcgaccgcgtgatccgcgcgggcttcaagctgctcggcctgcagacctacttcaccgcgggcgtgaaggaagtgcgcgcgtggacgatccatatcggcgacacggcaccgcaggcggccggcgtgatccacaccgacttcgagcgcggcttcatccgcgcgcagacgatcgcgttcgacgacttcatcacgtacaagggcgagcaaggcgcgaaggaagccggcaagatgcgcgccgaagggaaggaatatgtcgtgcacgacggcgacgtgatgaacttcctgttcaacgtctgaccttgatcggccgatgccgtgtgaatcacacggcatcgcgcaacgcgtgcccggcacgaaaacgaatggcccgacggcaagcgccgtcgggccatttttcattgcaggacgttctgccagccggcggcgaacaccgtgcgtccgccgccgcttcgtcacggcatcacgtcgccgacacccgccgccccgcgctcgcctgcgcatcgcggccgcgcttgttcagccacgatgccagcagcacgatcagcgccagcacggccgtcgcgcccacttccatacggtgatcctcgctgacgagcatcacggtcagcgtgccgcagatgaacaggatcaccagccacgtgagccagggaacagccacatccgcagcgtcaggtccgcgccggtcgcttcgagcgtcttgcgcatccgcagctgcgagatcgcgatcacgagatacacgagcagcgcgatcgcgcccgacgtcgcgagcaggaatccgaagacctgttccggcatcaggtagttcgcaatcacggtcaggaacccgaatgcggtcgatgcgagcacggccgcgcgcggcgtgccggtcgaatccgtgcggtgcagaaacgcgggcgcgtccttgcgcttcgacagcgagaacagcatccgcgacgcggtgtacagcgcagaattcaggcagctcgcgaccgacacgagcacgatcacgtcgatgatcgccttcgcgttcgggatgccgatcagctccatcgcgcgctgatacgaaccgtgcttcggcagcagcggatcgttccacggcacgatggccgcgacgatcaggatcgagccgagatagaacagcgtgatgcgccagatcaccgagttggttgcgcgcacgatctggcgttgcgggttgtccgattcggcggccgcgatcgtcacgatctccgtgccgaggaacgagaacatcgtcgtcagcatcgccgcgagcaccgcaccggcaccgtgcggcatgaagccgccatgcgcgaacaggttcgatacgcccgacaccgcaggggcgggaatgatgccgacgatcgccgcgccgccgatgcacaggaacacgacgatcgcgacgaccttgatcagcgcgaaccagaattcgaattcgccgtagttcttgaccgagaagaggttggtcaccgtcagcaccagcgtgatgccgagcgcgaagacccaggttgcaacgccggggaaccatgcattgaggatggtcgcggcggcggtcgcctcgatcgggatcacgagcacccagaaccaccagtacagccagccgatcgagaaaccggcccagtggccgatcgcgcgatcggcataggtggagaacgaaccgctgtccggatgcgcgacggccatctcgccgagcatgcgcatcaccagcaccaccagcacgcccgcgatcgcatacgcgaggatcgacgccgggccggcttccgcgatcgcgtggccggagccgacgaacaggcccgcgccgatcacgccggcaatcgacatcatcgtcacgtgccgctgcttcaggcctgtaccgaggcctgtgttgcttccactcatctgtctctctccaaaaacggttccggtatggccgggtgtcgcgtgaaggcagcagggagttgtcgttcttgaatccggctgcgagcgcgcgtgcatcgcacgcggccatgcggccggatgggaccgttcggatcggcgcgccgcgcagtctgcgaagctgcgggtgcgatgcggcgcgcggtgcgccgacgcatcgcgtgcgccgtttccgtcggctttcgtcagctgccttcgaagcgaaggagtgtaagcaccaaacggttcttcactaagaaccaattgaagaatttcgatggaaccactcgttgcatcgacgtcgatcgatgcaacgctcgtacccgttcgggccggcgcgcgagccgcgccgaaagcgcccggcgacgccgggcagcgggccgcaaccggcgtgtcagttcgcgccgtgcaccctctcgtcgcgccatttggcggggacgacggcctgccattctcgcagaagcagtttttcacggcgtccggacgggccgccgacagccgcaccagcacgatcggccagccgacgtagtgatccgtcacgtaatacacgtccggttccgattcgatcagccacgcgcgctcgtcggggccgacaccttcacgacgagcgtgtcgccgtcctcgcgcagccgcgcgagcatcttgccctcaccttgagcgcaggcgtgccgtacgacgtaccttcctcgacgccgcgccatgccagcgcgatctggcggacttcgtcgaatgtcatgaggcctcccggctgcacttcttcggttcacgatccggccaccctaccggaattcgcgaaggcacgccgcgggacgtgcgcctatccgcgcgccgcacgtgcgaccaccggcgcacgccccgtcgtcgcgacgatcgcgaaggcgatcgcattcgcggcggcgctggccaggatcggcacgagatagccgccgcccgcgtcgtagatgaaaccggccgcggccggcccgatcagcgtgccgaatgcgacgctcgtataaagcacgccgatgatcccgctcacgttgcgcccgccgaagtagtccatcacgaccgccggcagcacggcgacccagccgccgtagaacacgccgaacacgagcgcgaacgcggcaagcgtcgcaacggtgccggcaccggcccacgcgacgagcgcgacggccatgcccgcgaacatcgcgagcagcgacgcacggcggccgaagcggtcggcgaggccgccgaggaagaagcggccggccgtgctgccgacgccgatcgcgccgagcagcagcacggccgtcgacggcgcgacgccatgatcgagcgcgtacggcacgaggtgaacgaacgggacgaacacgccgaacgagcaggcgaggcatgcggcgtacaggctcgcgaacggccgcgacatgacggcttcgcgcaccgtcgcgccggcaggcgccgaagcggcgaccggctgacgccccgcgcggcaccggacaccgaggccccgcaccgcgcccggcgacttgcgccccgccgccgggctcatgcgcggcctcccgtccggcagcagccccgcccgcgcgggtcgttctcgatcagcagcgacatccccgcgccgatcacgaccgcgatcacggccagcgtgaaatacgcgccgcgccagccgacctgcgcgatcagcgtggacgcgagcggcggcatcaccagcgtgccgacaccgatccccgcgaccgcgagccccgatgcgaagccgcgccggcgcacgaaccagcgctgcacggcgccgaccgccggtacgtatgcgcagccgacgccgaaaccgacaccaagcccgtacgcgacatagacctgcagcgtgtgcgcggcgccggcagccgcgagcccggcgcccgtcagcagcatcccggcgacggcgagccgccgcgagccgaagcggtcggccagcggcccgctgacgatgccgaaaccgaaatacaggaagccggcgagcgagaacacgagcgagatctggccgcgcgacgcggcgaagtcccgctgcagcgactcgacgaacgcactgaacgtataggcgctgccgaatccgacgaacgtgacggcgaacgcagccgcgaccacgtaccagccgtagaaatggcgcgatgcgcccgggcggttcatgacgatgctcctctcaggtcccgccggacacgtcacggcgtccggtttgcctcgtggatatagttgaactatgttgatcgcattggtcgttgcaatgcagcccccaagcacgcaatcggatgcgacaacggtactcgtgcacgcgcgccgcctcaaacgatatttcatcggccattcgctttagaaaaactcaatgaatcgttcccgcctgccgccgctcaacgcgctgcgtgcattcgaagcagccgcccgccacctgtcggtgaaatcggcggccgaggagctgtcggtcacgcccggcgcggtgagccagatgatccgcacgctcgagacgcacctcggcgtgcagctgttcgagcgcgtcaaccgcggcatcctgctgacggccgccggtcgcgactacctgccgccggtgcgcaatgcgttccggcagatcgccgacgcgtcgcagcgcgtgtcgggcgccgccgacagcggcgtgctgacggtgagcgtcaccccgttcttcgcatccgcgtggctcgtcccgcgcctcgcgcaattccggcacgcgtgccctgacgtcgacctgcaggtcgtcacgagccacgcactcgcggatttttcgcgcgacggcgtcgacgttgcaatccgtcatggcctcgggcgctacatcggcctgtgcagcgagcgcctgctgacggtggagatcgtcgcgctcgcgtcgcccgaccttgtcgcgcggctcggcatgccggcgacgcccgccgatctggtcggctggccgcagctgcatgacgccgagcgcaagggctggcacatctggttcggcgcgcagcggatcgacgatatcggcccgccgcgcggccccgcgttcgacgactcgggcctgttgctgcaggcgattgtcgccggccagggcgccgggctgctgccggccgcgatggtgcgcggcgagctggcaagcggccggctcgtgcagctcgccgacgccgcctggctcgacgatttcgcgtactacctcgtctatccgccgcatcacgccgagcggccgaaggtcaccgcttttcgccggtggatcctcgaggccgcgcaggccgacggcgcggcctcgatgtcgggcgcggcgtagcgtcacgccgccgcgccggtaccggccgggcgccgatccgctaacatgcggcgcgggccatccgcccgacatcgataacaacaagccgaccgggagagaccatgcctgccctgttctgccgcacgacacgcatcgcggcactgtccgccgtcttcttcgtcgcctgcgccgcgttgccccaacccgcacacgcgtaccgcgcaccgcccggctacggcaacgaagccgatctcgaccgtcacgacacgtatcgcaaccgcgacggcgaaaccgtgcacgcacccgcgcattcgaaatcgggccgcgtgcccgaaggcgcgagcgcgcgctgccgcgacggcacctacagcttcagccgccatcggcgcggcacgtgctcggggcacggcggcgtcgccgcgtggctgtgagcgcagccccggccaaaggccaggtgtcgcgccagcggcggccggcggcgaagtacaatagccgctcgcgccgccgacacgcggcgacgccgccgcgccgtgcgcggcacgctccgtaccgaatcacccgacgccgccacgcccgcgcgctgcgcggcagtctcaaccatttctgactttcacacccaaatggcccaatacgttttcacgatgaaccgggtcggcaagatcgtgccgcccaagcgccagatcctgaaggacatctcgctgtcgttctttcccggcgcgaagatcggcgtgctcggcctgaacggctcgggcaagtcgacgctgatccgcatcatggcgggcgtcgacaaggacatcgaaggcgaagcgacgccgatgccgaacctgaacatcggctatctgccgcaggagccgcagctcgacccgacgaagacggtgcgcgaagccgtcgaggaaggcctcggcgacctgttccaggccaacaagaagctcgaggaaatctacgcggcgtacgcggagccggacgccgacttcgacgcgctcgcggccgagcaggcgaagtacgaagcgatcctcgcgtcgagcgacggcggcagccccgagcagcagctcgaagtggccgccgacgcactgcgcctgccgtcatgggatgcaaagatcgagcatctttcgggcggtgagaagcgccgcgtcgcgctgtgcaagctgctgctcgaaaaacccgacatgctgctgctcgacgaaccgaccaaccacctcgacgcggaatcggtcgactggctcgagcagttcctggtgcgcttccgggcaccgtcgtcgcggtcacccacgatcgctacttcctcgacaacgcggccgagtggattctcgaactcgaccgcggccacggcattccgtggaagggcaactacagcagttggctcgaccagaaggaagagcgcctgaagcaggaagaagcgtcggaatcggcgcgccagaaggcgatcaagaaggaactggagtgggtgcgccagaacccgaagggccggcaggcgaagtcgaaggcacgtatcgcgcgcttcgaggagctgaacagccaggaataccagaagcgcaacgagacgcaggaaatcttcatcccggtcggcgatcgcctcggcaatgaagtgatcgagttcaagaacgtcagcaaggcgttcggcgaccgtctgctgatcgacaacctgaacctgaagatcccggccggcgcgatcgtcggcatcatcggcccgaacggcgccggcaagtcgacgctgttccggatgctgacgggcaaggagcagccggattcgggcgaagtcgtgatggggccgaccgtgaagctcgcgtacgtcgaccagagccgcgacgcgctcgacggcacgaagacggtgttcgaggaaatctcgggcggcgccgacgtgctgacggtgggcaagtacgaaacgccgtcgcgcgcgtatatcggccgcttcaacttcaagggcggcgaccagcagaagatcgtcggcaacctgtccggcggtgaacgcggccgcctgcacctcgcgaagacgctgatctcgggcggcaacgtgctgctgctggacgaaccgtcgaacgacctcgacgtcgaaacgctgcgcgcgctggaagacgcgctgctcgaattcgcgggctcggtgatggtgatctcgcacgatcgctggttcctcgaccggatcgcgacgcacatcctcgcattcgaaggcgattcgcaggtcacgttcttcgacggcaactatcaggaatacgaagccgacaagcgtgcgcgcctcggcgaggaagccgcgaagccgaagcgtctgcgctacaagccgatcagccgctaagcggcgcggcccgctcccggcactgcggtaacgcaggaacgggcaccgaggctggtcgctccggaagcggaacaacaaaaacgggccgctggcccgtttttttatccggtggctggctgacggcttgccgtttacgccagcgcgcccagttcacgcagccgtgcctcggtcgccgccgcactcgtgtgatgaatgccgtgccagccgagcgccgtcgcggccgcggcgttcttcgcgttgtcgtcgatgaacacgagttcgtgcggcgcgatgcccggcaagtgcggctcgatccgcgcatgcatctcgcggtagatcgccggatcgggtttcacgagcttcacacggcccgacacgacgatatccctgaaacgccgcagcaccgggaagttgtcccacgcatacggaaacgtctgcgcggaccagttcgtcagcccgaacagcggcatcccctgcgcgtcgagccggtcgacgagcgcggcgccttcgtcgagcacgccgccgatcatctcgtgccagcgcgcatagaacgcgcggatcagccctcgtgcgccggaaacttcgcgacgagctcggccgtccctcttcgatcgtctgcccgccgtcctggcggaccacccaatccatcgtgcacacatgcgtgaagaaccagcgacgctcggtgtcgtcgggaatcagttcccggtaaaggtactcggggctccagtcgatcagcacgccgccgaaatcgaacaccacggccttgatcgtcatgcgaactccgtcgcaaggacatccgcgagcgggcgcggcatcaccggcttgcccgacagcgaattgttttcccatacgaagtgatgatgcgcgacgatctgcgcggccgacaggtgcgtgcgctcgttcgtggtgtgcaggtcggacacgacggtcgtccggtagccgagcagcgctgcgcggcgcgcggccgaatcgacgcagaactcggtcgcataaccgcagatcagcaccgaacggatgccgtggcgctcgagttgcgccgcgagcggcgtatcgtgaaacgaatcgctcatctgcttgcgcacccgccagtcatcgttcccgacgaccagccccgcgtgcagttcccagcccggcgtgccgggcacgacgtcgtcgtccgcgtcgccgtcgtgctgcacgaagcacacgggcgcgttcgccgcacgcgccgccgccgtcaaccggttgatgcccgacaccacgtcatcgagccggtacgcgggccttgcccgctccaccagcccgcgttgcatgtcgaccacgatcactgccgtgtccgccatcgtcgccctcgctgttgttgttcggccggcacccggccgctttcctgcgttgcgtcagatcggctgcgtgcgcgcgtcgagccacgccttggcatcgccgctcagatggcggccgacgcgctcgcgcaccgttgcgtgatacgcgttcagccacgcgcgttcttcttcatgcagcatctcgatcagcacgcagcgcgtgtcgatcgggcacagcgtcagcgtctcgaacgcgaggaaatcgccgaactcggtctgcccggccgcgcggttcacgaccaggttctcgatccggatgccccactggccgggacggtacacgcccggctcgatcgacgtgatcatgccctcttccatcgccgtatacggctcggccggcgcgtaatgcgagatcacctgcgggccttcgtgcacgttcaggaagtagccgacgccgtgccccgtgccgtgcccatagtcgagcccggccgcccacatcggtgcgcgcgcgatcgcgtcgagcatcggcgagcggatgccgcgcgggaatcgggcacgcgacagcgccatcatcgatttcagcacgatcgtgaaatcgcgccgctgcaggtcgctgacggtgccgaccggcacgacgcgcgtgatgtcggtcgtacccgtcacgtactggccgcccgaatcgatcagcagcagcccgtcgccggcgatcgtcgcgtgcgactccggcgtcgcgcggtaatgcggcatcgcgccgttcgcgttgaagcccgcgatcgtcgcgaagctcggcgacacgtagccggggcgccgcgcgcgcgcggcagtgagcttctcgtcgatcgtcagttcggtgatcgtctcgcggttcacggcctgttcgaaccaggagaagaattccgcgagcgcggcgccgtcgtgctccatcgtcacgcgcacgtgctcgatctcggtggatgtcttgcgcgacttcgcgaacgtcgacggattcacggcctcgacgagcttcacgccggccggcacggcctcgagcgtgccgaacgtcacgcggcgcgggtcgatcagcagcgtcgcgccgtcgggcagtgccgcgagcgcggcgcgcgcggcgtcgtaggcgcggacgtcgacgccgtcctgcgcgagcgacgcggccagtgccggcgacaccttgccgtcggcgacgaacagcgtcgcgcgatcggcgccgatcattgcgtgcgcaacgaatacgggattgaagttgacgtcggcgccgcgcaggttgaacagccatgcgaggtcgtcgagcgtcgagacgaaatgccactgcgcgccctgcgcacgcatcgcgcggcgcacttcggccagcttgctcgcgcgcgtcgtgtcggcctgcggcgccgcgtgctcgaacaccgcgtcgccgggcagccccggccgctcgggccagatcgcgtcgagcaggtcgaggtcggtgcgcagcgcgatgccgcgcgcgttcagcgcggccgtcagcccgcgtgcggccgcgacgccgagcaccgcgccgtcgacgccgaccgtcgcccccgccgccacgttctgcgcgagccagtcgacgtgcggcgcgctctgctgcccgcccgtcatcttcatcagttgcacgcccgtgccggccagttcggcatcggcctgcacccagtagcggctgtcgacccacagccccgcgaaatccgcggtcacgaccagcgtgccgaccgagcccgtgaagccggacagccagcggcgggcctgccagcgctccggcagatattcggacaggtggggatcggcggacggcacgagataggcggccaggttctcgcgggccatcgcgccacgcagcagcgcgagacgggccggcaccggcgagacttcgggaagacgggcattcatgatttcacctgagagcattcagcgacgggccgacagcgcaaccgtcacggctactgcgaggaacgcgacgccggtgcagaccggccattcgagcgtctcgccatcgtaaaacagtccagagagattgccggccatgcgggccgcagccgcgccgacgataccggcgagcaccgcgatccaccacgccggccggcccgtgcgccgcatcggatgcagccatcggccgaacagcccgacggccgctcccaggacaaggattccaaaccagttcattcgacgccttccataaattcggattcgtcccataggcgtgaacgttgccagcggctagcatcgattcatccatcgaacccgagaccagccgggtgccgcgaacattcgagtgtaggggccgactcgacgttatggcaagcgcgcaccggctgccgtattgaagaaattctcatgcgaatcgctctgatcgatccggacgcgcgccatgccgcgctcctgaaccgcctgctctttgcgggcggtcatgtgtgccacgcgtttccgtccagtacggcgttcttcgagtggctcgccgccaatacctgcgacatgctgatcaccggccactgggccggcgaccagccggccgaggaagtcattccgcgtgcgcagacggtcctgcccggactgccggcgatcgccgtgatgcaaatgccgcgcgaaagccaaatcgtatcgtgcctgcacgcgggcgccgacgattgcctcgtgcgcccggtgagcgggcccgagctgctcgcgcgcgtcaacgcggtgagccggcgcgccggcgtgcgccggccgccggcccgctcgcgcgaaatgtatggcgaatacgccttcgacgccacgcactgcctcgttcgtttcgacaacgcaatcgtttcactcacgccgaaggagttccgttttgcgcagttgctgttcgcgaacctttcgcggcccgtgtcgcgcgcccatatcctcgaaacggtgtgggcacgccgccgcgacatgaagtcgcgcacgctcgatacccacgcgtcccggctgcgcagcaagctgcacctgcttccggagcgcggctaccggctgctgccgctctacggctatggctatcagctcgaccgcgtgccgatcgagcccccaaattcccggccccgccacgccgatgcccggtatgccgcgagtgaggaaatcgctgaaacgctataatatggggctaaacgatagccctcgatatgcaactcctcacgatcggaatcaatcaccacactgcgcctgtcgccttgcgcgaacgcgtggcgtttccgctcgagcagatcaagccggctctcgtcacgttcaagaacgtgtttctcggccctcaggcgcccaatacgcccgaagcggcgatcctctccacctgcaaccgcaccgaactgtattgcgcgaccgatgatcgcgccgcacgcgaaggcgcggtccgctggctgtcggagtatcaccggattccggtcgacgagctcgcaccgcacgtctatgcgctgccgcagtcggaagcagtccggcacgcgttccgcgtcgcatccggcctcgattcgatggtgctgggcgaaacccagattctgggccagatgaaggatgccgtccgcaccgcgacggaagccggcgcgctcggcacctacctgaaccagctgttccagcgcacgttcgcggtggcgaaagaagtgcgcggcacgaccgaaatcggcacgcagtcggtgtcgatggcggccgccgcggtgcgcctcgcgcagcggatcttcgaaaaagtgtccgatcagcgcgtgctgttcatcggcgccggcgagatgatcgagctgtgcgcgacgcacttcgccgcgcaaggcccgcgcgaactcgtcgtcgcgaaccgcacggccgaacgcggccagcgccttgccgaacgcttcagcggccgcgcgatgccgctctcggatctgccgacccgcatgcacgaattcgacatcatcgtgtcgtgcacggcgtcgacgctgccgatcatcggcctcggcgcagtcgagcgcgcggtgaaggcacgccgccaccggccgatcttcatggtcgacctcgcggtgccgcgcgacatcgagcccgaagtcggcaagctgaaggacgtgttcctctacaccgtcgacgatctcggcgcgatcgtgcgcgaaggcaacgcatcgcgccaggctgcggtcgcgcaggccgaagcgatcatcgaaacgcgcgtgcagaatttcatgcagtggctcgacacgcgcagcgtcgtgccggtgatccgtcacatgcatacgcaggccgacgccttgcgccgggccgaagtcgacaaggcgcagaagctgctcgcgcgcggcgacgatccggccgccgtgctcgaagcgctgtcgcaggcgctgaccaacaagctgatccacggcccgacgagcgcgctcaatcgcgtgaacggcgccgatcgcgattcgctgatcgacctgatgcgcggcttctaccagcacgcgccgcgctcgaacgaccagtccggccactagcgccggccgatcgccctgccgccggccgcgcgccggcctatcctttccgaataccccttgcccgggagcgccgctccacaccatgaagacgagcatgcaacgcaagctcgaccagctgtccacacggctggccgaactgaacgacctgctgagccgcgaaaacgtcacggccgacctcgaccagtaccgcaagctgacgcgtgaacatgcggaactcggcccggtggtcgaacagtacgcgctggcgccagtcgcgcagcgacgagacggccgcgcaggagctgctcggcgatctgtcgatgcgcgacttcgcggaagacgaaatccgcagcgcgcgcgagagcatgacccgcctcgagaccgagctgcagaagatgctgctgccgaaggatccgaacgacgaccgcaacatcttcctcgaaatccgtgcgggcacgggcggcgacgaatccgcgctgttcgccggcgacctgctgcgcatgtacctgcgcttcgcggaacgccagcgctggcaggtcgaaatgatgtcggagagcgcatcggatctcggcggctacaaggaagtgatcgtgcggatcgcgggccagggcgcgtattcgcgcctgaagttcgaatcgggcggccatcgcgtgcagcgcgtgccggcaaccgagacgcaagggcgcatccacacgtccgcgtgcacggtcgcggtgatgccggaagccgacgaaatcggcgaggtcgagatcaatccggccgacctgcggatcgacacgttccgtgcgtccggcgcgggcggccagcacatcaacaagaccgactcggcggtgcgcgtcacgcacatcccgaccgggatcgtcgtcgagtgccaggacgaccgttcgcagcacaagaacaaggatcgcgcgctgaaggtgctcgccgcgcgcatcaaggacaagcagtatcacgagcagcacgcgaaggaagccgcgacgcgcaagagcctgatcggctccggtgaccgctcggaacggatccgcacgtacaacttcccgcagggccggatgaccgaccaccggatcaacctgacgctgtaccggctcgaggcgatcatggacggcgacctcgacgaactgatcagcgcgctggtcagcgagcaccaggccgaactgctcgcgtcgctcggcgacgccgactgaggtcacgatgcccgacacgaccgccgacgaactgctgcgcgcgtccgcgctcgacgcggtcgatgcgcgcgtgctgctcgcgcacgcgcttggctggacccgcacacaactgatcacgcgcggtgacgcgccgctcgacgcggccgcggtcgaacgctaccgcacgctcgaggcgcgccgcatggccggcgagccggtcgcgcagctcgtcgggatgcgcgaattcttcggccggccgttcgacgtgacgcccgacgtgctgatcccgcgccctgaaaccgaactgctcgtcgaagccgcactcgatgcgatcgacgggctgccgcatccggccgtgctcgatctcggcacgggcagcggtgccattgccgtctccatcgccgccgagcggcccgatgcccgcgtgtgggcgctcgaccgttcgccggccgcactcgaggtcgcgcaacgcaacgcacgcaagttgctcgacgcgcaccgccccggcggcccgctgcactggttgcagagcgactggtacgcggcgctcgatcctgcgctcgccttcgacacgatcgtcagcaatccgccgtacatcgcgcagcacgatccgcacctcacgcagggcgacctgcgtttcgagccgcgcggcgcactcaccgacgatgccgacggcctcagcgcgatccgcacgatcgtcgcgggcgccggcacttacctgaaaccgggcggcacgctctggatcgagcacggttacgaccaggccgaggccgtgcgcgccgtactcgcatcgcacggcttcgtcgcggtcgaatcgctcgccgatctggccgcaatcgaacgcacgacaggcggccgcctgccgggctgatgcccggcccgtccggttgaaatccgctatcatttcgatctaacgccccgcaaacgcaaggtcagtcatggacacccaacaacgtatcaagcaaatcgtcgacgaaaaccaggtcgtgctcttcatgaagggcaacgcgcaattcccgatgtgcggcttttcgggccgcgccatccaggtgctgaaggcctgcggcgtcgatcaattcaagacggtcaacgtgctcgaagacgacgagatccgccagggcatcaaggaattctcgaactggccgaccatcccgcagctctacgtgaagggcgaattcatcggcggctccgacatcatgatggagatgtaccagtcgggcgaactgcagcaactgttcgccgccgcgtaatacgccccgcccccttttcgatggcatctcccagcgcgccgccacgccggctgatcgtcgcgatcaccggcgccaccggcgcgatctacggcgtacggctgctcgacctgctgcgcgccgccggcggcgtcgaaacgcacctgctgatttcgaacgccggctggctcaacatccagcacgaactgaagctgtcgaaggccgaggtcgaaagccgtgcggacgtcgtgcactcggtgcgcgacgtcggcgcgacgatcgcatcggggtcgttcgcgaccgacgggatggtgatcgcgccctgctcgatgaagacgctcgcgagcgtcgcgcacgggctatccgacaacctgatcacgcgcgcggccgacgtcacgttgaaggagcgccgccgcctcgtgctgatggtgcgcgaaacgccgttcaacctcgcgcatctgcgcaacatgaccgccgtgaccgaaatgggcggcatcgtcttcccgccgctacccgcgttctacgcgatgccgaagacgatcgaggaactcgtcgaccagaccgtcacccgcgtgctcgacctgttcgcgctcagtgcaccgatgacgacgccgtgggccggcatccggccggcgcagtaagccgctcgccgcttccgcgccgttcttcgcgcatcttcatcgattcatctgccttccggcctgattcggccacctcgaaccctcgtccgccctcgcactcgcagaatcggcccaattatcaaccaatacgactcaatcaaattccgcgcgacggatttatcaatgcccggtgcgcgcctatagtcacaggcaaatccctttgcaggccaccaccatgaaccgcttgccttcgctctacctgtcccacggcgccccgacgctgccgatcgacccgacgctgccgtccggcgcgttcacccaccttggcgccgaattgccgcgcccgcgcgcggtactgatgctgtccgcgcactggggcacgcagcgtcccgtcgccagcgtcgccgcgcatcctgaaacgatccacgacttctacggctttccgcaggcgctgtacgacatccgctacccggcgcccggcgcgcccgacgtcgccgagcgcgcggccggactgctgaatgcagccggcatcgccaccgcgacgaccgagcacggcctcgaccacggcgcgtgggtgccgatgctgctgatgttcccggaagccgacgtgccggtggcacagctgtcgatccagccgcgggcggatgctgcgcaccacttcgcgctcggccgcgcgctgcgaccgctgcgcgacgaaggcgtgatggtgatcggctccggccagatcacgcacaacctgcgcgccgccgatttcggtgcggcaccggaagatgcggacccgcgcgtcgcggaattcaccgactggttcgaggcgaaactggccgcgcgcgacgtcgacgcgctgctcgactaccgtcggcaggcgccgcatgccgcgctgatgcatccgaccgacgagcatctgctgccggtgttcacggcgctcggcgcggcggacgacgactaccagcttggcatccagtcgctcggcacgtaccagcgcgtgctcgcgatgacgaactacgtgttcgcgagcgcggccgcctgagcgtcgcgcggcaaccgccgagcgccaataaaagcccgcccgagcatcgctcgggcgggctttttccgctgctggctgccgccgccgaatccggcgacaggtcacgcgtcaggcaccgacccctcgaggatctcgtcgtgcgattcacgctcgtcgagatactgggtccggtagccggtattcacgccccagaagtagaacaccagcgagattgcggcgacgatcagcatgtcccagccgtacggcagcacgccgtagccgccgaactccttgctgccgatcagcgacagcacggccatcgtcggcaggtacgcgaccagccaccatgcggccttcaggtcggcaccccagccggtccagcccgacttcgcctggaagtagaagtacaccggcagcgcgacgatcatcagcaggatgatctcgcccgtcagcggccacttcgcccagtagaggatcagcgacgcgcagacgaacgcgaacggcgcgatcagcttcatcagcggaatcgacagcggacgctcgatgtcggtcgccgaacggcgcagcgccatcaggctgatcgggccggtcaggtacgagatcaccgtcgcaaccgagatcaccgccgcgagcgagctccagccgcggaagaagaacaggaagatgaacgagaccagcaggttgaaccacatcgcctggcgcggcacgccgtagagcgggtgcacgttgccgaacatcttcggcatcgtgttgttgcgctccatcgcgtagatcatgcgggtggtggtcgccatgtacgtcgtgccggtgccgctcgggctgacgaacgcgtcgacgtacagcaggatcgcgagccagttcaggttcagcgcgatcgccagttcggcgaacggcgacttgaagttgaagtgcgaccagccctgcgcgacgtcagccggattcaccgagccgatgtacgccatctgcagcagtacatagatcacgagcgcgatcaggatcgacgtgatcaccgcgaacggcacgctgcgcgacgggttgcgcgcttcgcccgcgaggttcaccgggctctggaagccgttgaacgcgaacacgatgccgctcgtcgcgaccgcggtcagcaccgccgaccagccgtacggcgcaaagcttgcattggatgcggtgccgaggttttccggatggtagctcgtcagcatcaggccgaggatcgtgaggccggggatcaggaacttgaagatcgtgatcgtggtgttcgcccgggcaaacgccttcacgccccagtaattcagcaagaagtagatgacgaccagcacggccgacagcagcagtccgggtgtcgtcagctcgccgtttacgaacagcgcatgcgcccacggatacggccacgtgctcatgtactggatcgacgcttcagcctcgatcgggatcacggatacgatcgcgatccagttcgcccacgcgctgatgaagccgaccagcgagccatgcgagtagcgcgcgtagcgcaccatgccgcccgactcggggaacatcgcgcccagttccgcgtacgtcagtgcaatcgcgagaatcacgactgcgccgatgatccatgcgcagatcgctgccggaccggcgatctttgcggccttccaggcgccgaacagccagcccgagccgataatcgaacccagccccgtcagcatcaatgcaaacgggccgatgttccgttgaatagaactcttcacatcctctcctgtgtctcaaaagcatggtcggcccgcggtccgggatcggctcggactgcaccgcgcacgcattcttgggggacgcgtcacccgatcagggcaacccgtccgcgcggcgcgtagtttaacggttgcacctcgagcgtggcgccaaaatcgttcggcccctacaaaaattcgcatcgtttgcaagctttgtaaacctgatatacgcaataaccctgagtccatggaaatacggttgaccacgcgggtgataagccgtataaaggacttcgcaggatttcaagtggcgagtgaattggttctttcgtagttcgcccatcaacggtactccggttggtcctattaccccttccttgattttccgcacaccatgggcttcggccccgttttatctttttaggaacaagtaacatggcaaccggtaccgtcaagtggttcaatgacgcaaagggcttcggcttcatcaccccggaaggcggcggcgacgatctgttcgcgcacttctcggaaatccgcgtcgaaggcttcaagacgctgcaagaaaaccagaaggttgaattcgaagtgaagacgggcccgaagggtctgcaagctgcgaacatccgtccggtctaagcttggcgcgattattcgtgtaaaaagccccgcttcggtggggctttttgtttttcggcgccggtcgcccggcatgacggcctttcagccgcccgcattcagccgaacaagcgctgcgcgtgaatgccgagacccgtcgcgacactcgcgaggcggtcgccgaacaccggctgcgcatccgggaacgcacccgcgagcgcacccgacaggaacgcgagccccgtcgagccgccggtgaaatacagtgcgccgacgtcgcgcggcgcgacacccgccagccgcaccgtctcgcgcgcggcgtcgacgatgcgggcggtgtcgtcgcggctcgcgtcgacgaggcgctcggcatcgaacgcgatctgcagatcctcttccacgtcgttcaggtcgatcatcgtctcgccgcccgccgcgacgccgatcttcgcttcctccgcgcgcgccatcaacgcatgcccgagccgctgctcgaccacgctcgtgagccggtcgtactgctgcacatcgcggtacaggtgcttcatcagcttcagctcgccgagccgcttcggcgtgtagaccgtgttgatcaggtgccaggtcgcgagatcgaagtagatcttgttcggcagctcgcgcccttcgggatcgagcgaacggtagccgaatgcgggcaggatcgcggccagctcgacacgccggtcgtagtcggtgcccgcgacgtgcacgccgtggtgggccagcacgtcgtccttgcgctcgagccgcgccatccgctcgggcccgacgcgcaccagcgagaagtcggacgtgccgccgccgatgtcggcgacgagcacgaggcgctccgcctgctggcgcgactcgtagtcgaacgcggccgcgatcggttcgtactggaattgaacgtccgtgaagccgaccgatcgcgcggcagcctcgagctggtcctgtgcaaggcggtcggcgcgcggatcgtcgtcgacgaagaacacgggccggccgagcaccgcacgaccgatcggcgcagccgcgcgggtttcggccttgcgcttcaggtgcgtcaggaagcgcgcgatgatgtcggtgtacgcgatcgcgctgccgtcgccgagatcggtcgtcgtttccgcgagcggcgagccgagaatgctcttcatcgagcgcatcagccggccgtcgaaaccgtcgatgtaggaagccagcgccgcacggccgtattcgaccgtctcttcgtcgttgttgaagaagatcgcggtgggcagcgtcaggtggtcgccctcgacgggcgcgaggcgcatgccatcgccgtcgggcagcgccacggcggaattggacgtgccgaaatcgatcgcgcagtaagtcatgggaaattgccgcagcagggccggcgcgaaaacggaaaggacgggctttttaacatgaagcccgcgggatcacaaccggggccggccaccggtgccgcgcagcgggccccggtggcgacggcgcgcagacgggcgcgccgggaagacaggcggacgggatgcgcgacgcagctccctccaggcaggtcaggccgccgcgtcgaagcccttcttccacgcgcccgcatagacgacctcgccgatcgcatgacgcgtgcgcggcgccttctcgcgatcgcgcagcacgggatcgagcttgtcgacgttgccgtagtggccgagcgagatgatcgccggaatcgcgacgtcggccgggatcgcaaacgcgtcgcggaacgccttcgcgtcgaagccgctcatctggtgggcggccaggcccagcgcgtgcgcctgcagcaccagcgacatcgcggcggcgcccgcgtcgtacagcgcggtcggtgccggctccccttcggcgtgagcgtatgcgcggtcacggcgatcagcacgggcgccggcgcattccagccctggttgaacggcaccagcgtcgcgaacgcgcgcttgaatgcgtcttcgtcctgcgtgcggtcgaatacgatgaagcgccacggctgcgcgttgtacgcagacggtgcccagcgggcagcttcgagcaccgcgtgcagatcgccggcgctgacgggttcatccgaatacgcgcgcgggctccagcggcccgcgatcagatcgtgaatcgaaacagtggtgggagcaggtttgacggacatgcggatcctcgctgacatcgatgaaggggcgcgaacgcctggcgaaccgcaagcatacccgcttgagccgatccgcgcccgatcctgccgagctatgcaaatctccgtgcgtgcattggccggccgcccgccccgcgggccggccggactgccggcttgccgcgatcaggccgcctgcgcagccgtgcgcgacgggccgcggttgatgcgcagcacgatcagcgcgccgaagatgcacagcccgcccgaaatcatcgatgcgatcgtgtaggtgccgaggctcgcgcgcagcagccctgcgccgagcgccgcgaacgcggcgccgagctggtggccggcgacgatccagccgaacacgaccggcgccgcggccttgccgaacacgtcggtcgcgagccgcacggtcggcggcacggtcgcgatccagtcgagcccgtagaacatcgcgaacagcggcagcccgaagaaatcgatcccgaacgcatgcggcaggtagatcagcgacagcccgcgcagcccgtagtaccagaacagcagcacgcgattgtcgtagcggtcggacagccagcccgacagcgtcgtgccgaacaggtcgaacacgcccatcgccgcgagcagcgatgcgccctgcacttccgtcatcccgtagtcgctgcacatcgcgatcaggtgcgtgccgacgtaaccgttggtgctcgcgccgcaaatgaagaagctgaagaacagcagccagaaatcgcgcgagcggctcgccgtcagcagcgtacggaacgcgaccgcgagcgggttctccttggtcgcatcgggcgcgggcggcgcatcggccggctcgccgtaagggcgcagctgcacgtcggccggccgctcgggcaacaggaacgcaacgagcggaatcacgatcgcggccgccaccgcgacgaccagcacgaccggccgccagccgtgacgctgcgcgatcgccgcgagcatcggcaggaacacgagctggccggtggccgtgctcgcggtcaggatccccatcacgagcccacgccgcgcatggaaccagcgcgtgacgaaggtcgcggacagcgtcagcgcgacgacacccgtcgagcagccgaccatcaggccccagatcaccaccatctgccagctctgcgtcatcatcgacgacagcgcgacgcccgcgctcatcgtcacgagcgcggtgaggatggtcgggcgcagcccgaagcgctgcatcgcggcggccgcgaacgggccggtcaggccatacagcgcgatgttcaccgagatcgccagcgaaatcgccgcgcggctccagccgagctcgcgttcgagcggcaccatcagtacgctcggcgtcgcgcgcgtgccggcggccgccagcaggatcaggaataccaccgccgccgcgagccatccgtagtggaagcgcccgccgattcgtgtcaccgcccagttcatcttcgcgttctccagttggcggcgccggcgcctccgcgcccgctccgccccacccagccaggccacctccgccgcacgctgcatcggctgacccgggccgacgcttggcatttgtctgtcgatccggtcggcattgttaccgaccggtcacaagtgtgttgcgatcgtagtgaccaatcggtaacatgtcaagcaatccaatatgcagtcgagggtcatcatgtcgggcatcgagatcgccaaaccgccggcgcgccgtacgcgccggccgatcgacggcgccaccgcgcaggagcacctgctgcgcgccgccgaggagctgttttacagggaaggcgttcggacggtgggcgtcgaggcggtcgtggaacgcgcgggcgtcaacaagatgagcctgtatcggcagttctcgtcgaaggacgatctgatcctcgcgtatctggagcggatggatgcgtgtttcttcgagcgtctcgacacaagcaccgcgaagcatccgggccagccgaaggcgcaactgatccagtatttcgtcgacctggccgagcgcgcgacgcagaaggactatcgcggctgcccgttcgtcaacgtcgcggcggagtttccggatgcatcgcacccggcgcgcgagcgcgtcgcgcagaacaaggaacagttgatgaagcggctcgtcgcgctatgcgaaggcgccggcgcgcggcaaccgcaggcgctcgccgatgcgctcgcgctggtggtcgagggtatctacgcggcgagccagacctatcggcacggcgaaacgccgatcggcaccgcgcccgcgctcgtcaagcaattgatcgaagccgcgtgcgcgtgacgggccgcgcgcgtccgcaccctgcgcgcccgctacaatgcggccctcgccgcccttccgcccgactggtttcacgatgaccgacacccgccccgaatcgcatgacgacatcctcgccgccacgcggcactggctcgcgcgcgcggtgatcgggctcaatctgtgcccgttcgcgaaaagcgtctatgtgaaggaacaggtgcgctacgcgatcagcgaagcgacgacgctcgaagacgcgctcgccgaactcgaaacggaactgcgcgcgctcgacgcggccgacccgcagcaggtcgacacgacgctattgatcttcccgcatgcgttcgccgatttcgtcgactacaacgatgcgctgttctttgccgaccgcctggtgcggcaactgcggctcgacggcgtactgcagatcgcgagcttccacccgcactaccggttcgaaggcagcgagcccgacgacatcgagaactacacgaaccgcgcgccgtatccgatcctgcacctgctgcgcgaggacagcatcgcgcgcgcggtcgacgcgttcccggacgcgtccgcgatctacgaaaggaatcaggaaacactgcgccgcctcggccacgacggctggcgcgaatggatgcgccggccgggcgacgacgtctgacgcggcgtgcaacgtgcggcgtgcgacgtgcgccgcgccgcgcgcccgctgcccgcgcgtcagccttcggccggctccgcgacctcgccgcccgccgccgcggcttccggcacgaagaaacgtgcgttcagctcggcaagcccgaacatccccaggatctcgttcagccgctcgccgggccgccgacgcggcaggttcttgtactgcgcgatgatcagctcgttcttcatcgaatgctcccagccgaccagctcggtcacgctgacctggtagccgtgcgcttcgagctgcaggcagcgcagcacgttggtgatctggctgccgaattcgcgcgtatgcagcggatgccgccacacttccgtcagcgcgttcgcgagcgatttgcccttgttcttgcgcagcacgcccgcgacttccgcctggcagcacggcacgagcacgatgtgctgcgcgcgcttcgcgagcgcgaagcggatcgcgtcgtcggtcgccgtgtcgcacgcatgcagcgcggtgacgacgtcgaccgtttcgggcagcttcggcgacgtgatcgaatcggcgaccgacaggttcaggaacgacatgccgccgaacccgagccgcgcggcgagctcggccgaacgcgtgaccagctcctcgcgggtctcgatcccgtacacgtgcgacgcaaatgccgccgtgccgtgccccggctgctgcttgaagaacaggtcgtacaggatgaagccgagatacgacttgccggcgccgtgatcgacgagcgtcacgctgccacggtcggcctgcacgccggcaagcagcggctcgatgaactggaacaggtgatagacctgtttcagcttgcggcggctgtcctggttcagcttcccgtcgcgggtgaggatgtgcagttccttcagcagctcgacggactgctccgggcggatttcgtgggtcttgttcgacatcgtgaagcggcgccgggtcacggtcggcagaccacggcccggcggcgggaattcgtgaggaatggcgatagtttaccgaaaatgcgcggtcaggctcgtgcgccgagccgccagagcgacgtgacctcggcgcggcgtgccgcgtgcagcgggtcgtcggcgtcggcggacttcgggtgcgcggggcggatgtcttcgcggccgagcacgacgaggtcggcttcgtcgatccactgcagcagggtgtcgcgtggccgcaggccgagatgctcggcgaaatcggacaggatcagccagccttcgccgcccggttcgagatggtcggcgagccccgcgaggaaaccgcgcagcatgcggctgtcgggatcgtagaccgcgtattcgatcggtgcgctcggacgggccggcacccacggcgggttgcagacgacgagcggcgcgcggccggccggaaacagatccgcctcgacgacctcgacgcgatccgcgtggcccagccgctcgacgttctcgcgcgcacaggcgagcgcccgcggatcctgatcggtcgcgacgatgcgctcgacgccgcgcgacgccagcacggccgcaagcacgccggtgcccgtgccgatgtcgaacgcgagcgacgtcgccggcagcggcgcgcgcgcgacgagttcgacgtattcgccgcgcaccggcgagaacacgccgtagtgcggatggatcggcgcgccgcccagcgccggaatcggcacacccttcttgcgccattcatgcgcgccgacgaggccgagcagctcgcgcagcgacacgaccgacggtgcgccgcccgggccgtacgcttcctcgcacgcggcgcgcacgtcggcgcgcggcgcagcgggatcgtgtagtcggcatcgagcgggatcagcagcatcccgagcgtgcgggcgcgctgcgactgcgcgagacgatgcaggttgaatgcgtcgacgcccaccgcggccttcgccttcttcggcttgcgttcgacgcggcgcgccatcgcctgcacgagctggcgcgcattctggaagtcgccctgccagacgagcgcggtgccctcgcaggccagacggtaggccgcgtcggcggtgagacggtcgtcggcgggcaccgcgcgcttcggcggctgcacgccggcttcggagcgccagcgcacggcatgttcggcgccgtcggcgtcggtccagtggaaaacggggaaatcggtcacgcgagctcggctacggttggcttcagacaggcggcgcgacagacgcgcgccgcgcggaccacaccataccgcgctttgcccgcgcggcaaagcgcgggcgaccgccccgaccgccacccgcgcgatgctcgcggcgtgctggcgctgacgggccggtcagctctggtcgtcgagcgcggcgtccggcgcgttctgcttcaccgacgcgatgccgttctcgcggctcgcttcggccttgtacagttcgctcgtgccgatgatctcgtgattgccggccttcaggttgaacatgaactggccgttgctcgcagtcttgcgctcgtagcgcgcgtcgtccggcgcgttcttgcgcaccgacgcgacgccgttttccgccgacgccttggtcttgtacagctcgctgcgcagaatgatctcgccgttggcggccttcaggtggaacaggaactgcccgtcgctcgctttcttgatgacgaatttcgctgccatggtgccctctcgaaaaagtcgcccggccctccggactgaggcagtctaaacgcgattgacgcgcaagacgtaaggcacgtgaagctcgatcgtcaggaatcgtcagacggcgccgcgatcgcgacgcttcgtccggccctgcatccggcatcgtctacccgccccaccccggcatcgccggcatgcgcaacgtgcccgcatcgctgaagcgcacggtgccgagcacgccgcccgcgagccggccgcgcagcgcatacggcaactcgccgctggcagccgcgccgggcaggttccacgcctgccgcgcggcggcgaacgccgacacggataccggcacgtcgagcacggcctcgccgaagcgcggcacgacgcccgagcggtcgctcacgccgctcgcgaacggcgtgccgttcaggtcgagcgccaccgagatgccgtcgtattcgatcggcgtgtcgttcgggttctgcacgcgcagcttcaggttgaaacgcatctcgaggccctgcccgacgagcgggtcgagcccggcgaccgacacgcgcacggaatcgcgcgtgagccccgcgcagccgccgagcaggagcacggcggcgaacagcagcagcacggcgcgcagcggcgcgattcggaacagggttcgtggcatgggggcctcctcgcggcaatcggtgagcggatcgtcgctgcattgtaccgagcgcgccccgcacaccgggtttcgtagttttcgcggccacgccggatcgttaatagattaaaactacgaaaataccagctaaacggaaagcgcattaatgctttccagcattcaatgaagcgcggtgaattcaatagatgcaatttctaaatttttcgtttcctttacctaaaaccatcaagtatatttacgcatccttcgagcaagccgacaaagcttgaagccgcatgacggcgattttacggaacggcgacacgccttcctgccatcctgcggcccggcccggccagccccgtaggtcgttggttcaatggaatcgcgcgcccgcgcagggcgcgcggctccgtgtcgtgcgcgcgaaatcaactcagtacaacacgcgcccggccattttgaaccggcaagttaaccgacatccggaaatccagaggggcagtaaaccatgattaccttcacgtagtcggccgccgtcttttcgaataatccgtcattggcattttcatcgctgttgattaacggcgaggggattgtttttgccggcgttttcgcagcactgaacgattctttcaacaatcgaggtttcagtcatgtcgatcgatattcgcaagatgcgttatctgccgctcgtcgccgcgctcgcactcgccgggtgcggcggtgacgacggcggtgcaggctccgcttccgcgctcagctccgccggcgcgccgcactcgggctcgtcgcccaccgtcaacgcgccgccgagcgcatccaacgtcgacaagagcgtgtcgcctgtcgagttgccagacaccgtggtgcccgtgaactaccggctgtggttccgcccgaacgacgcgctgaacgcgttcgacggccgcgccgacgtcgagatcaaggtgctgaagccggtcaacaacatcgtgatcgccggccaccggatcaagttcacgaacggccgcatcacgctgcagccgggcaacatccagctgatcgcgacgccgcaggacaagggcgacttctaccagctgcgccccgtgagcggcacgatctcgccgggcaactactcgctgcacatggagtggtcgggcatcatcaacttcaagtcgtatgacgatccgggcacgaagacgggcggcagctgcggcgacgatccgtatccgggctgctcggccgcggaaggcgtgttccgcgtcgacctgaagggcaccgacggcaagacgagcggcgcgatcctcacgcagggcgaaaccaacctgtctcgtcagtggttccccggctgggacgagccggcgttccgcccgacctatgaagtgacggccgaagtgccgtcgaactggcgcgtcgtgtcgaacgcggccgagaagccgtcgaccaacgtcggcggcggctacaagctcgtgcagttcgagaagaccccgccgatgccgtcgtacctgctgttcttcggcggcggcctgttcgacacctatgaagacgacttcacgagcccgctgccgggcggcaagggcggcctgcacctgcgcgtgttcacgccgccgggcatgagcgactgggcgaagccggcgatggaccgcaccaagcaggcgctcgacttctactaccgctacacgggcattgcgctgccgctcacgaagttcgacacggtggccgcgaacgacgcgttcaaggagcaaaaggacctgaacttcggcgggatggagaactggggtcgatcctcgagttcgccgacgacatcctgccgcagccgggccagccgatgtcgcactacggcaacgaggtgctgacgcacgaagtcgcgcaccagtggttcggcgatctcgtcacgaccgactggtgggacaacgtgtggctcaacgaatcgttcgcgacgttcttcgagacgaagacgacgatccagttcttccccgacgagttcagctggctcgaccaggtgaagaacaagtaccgcgtgatcaatcgtgacatcggcccgaacgccttcccggtcgcgccgaacttcaacggctgggcctcgaacgacttcgtgctgagcgccagcgcgttcacgtacgacaagggcggccacgtgctgaagacgctcgagaactatctcggcgaacagacgctgcgcaagggtttgcagcagtacctcgtcgactactcgttcggcaacggcacaccgaagcgcctgtgggatgcgctgtcgaaggaaagcggccaggcgatcggcgcgatcggcgacagctacgtccgccagaccggcgtgccgctgatctcgctcgacacgcaatgcgacctgacgaagaaccagacggtcgtcacgctgaaacagcagccgttcccgaacaagaacgcgtatccgggcctgcagtggacggtgccgatcacgctcgcgtacggccagggtctcgcgaaacgcacgacgctcgcgctgaaggatacgcagacgcaaacgcggatcgacggctgcacgggcgtggtggccgacccgagcgggctcgactactacgtcgtgaactacagcgacgcggcctggagcgggctgctcacgcaggtcaacggctcgaccgatccggtgctgctcgcgaacctgaagagcgaagccgcgctgctcgtcgcgaacaacctcgcgccggcatcgcgctcgacgtcgatcggctcggtcgcatcgcctgctgcgatgaagctgcgccagacgccgaccttcggcggcatcgaaccggtgacgaaggaacgcccggcactgcaataccagggcatcttcaagccgcgcaaggtagtcacgcagtaacggtgcgcgcccggccggtgccgcgcagcctgcggcggccggccggcgtaccggcttctccgactttgacgggcctcgcgtgcgaggccctttcatgcccggcgtgcgtcgggcccggcgacacgtcgccggccgtcgcccgccggccgtcgtcacgcccacgccgcatcccacgccggctgcgcgaaccacgtcgcgaggaacgcgacgagccgcgacgcgcgtgcggtgccgcgcgccggctggcgcaacacgtggatcgtcgccggctcgggcgccgccgcgaactgcggcagcaccgcgcgcaagcggccatcgcgcagcgcgtccccgcgagccaggtcggcaggtgcgcgagaccgagcccgtcgatcgcggcttcgagcaacgcttccgaatgattgctgcgaaaccgcggctgcgccggcgcgtggcggcgctcgccgaagcgccacgcgcccggcggcggcaccccgtgccaggcgaggcagtcgtgcccggcgagcgcgtcgggcgtatccggctcgccgcgccgcgccagatatgccgcgctcgcgcacagcacgcgccgctgcggcgccagcacggttgcgacgaggcgcgtgtcctcgagcgggccgatgcgcaccgcgagatcgacatcggagccgagccgcgcgccctgcagatcgaccatgctgtcggtcagcacgaggtcgacctgcagcgccggatgacgctgcatgaacgcggccagcgcggccaccagatgccgccggccgaacggcgccggacagtcgacgcgcagcagcccgctcggctcgtcgtgctggctgtgcaggtcttcctgcaggccgcgcagctcggccagcatccgcgtcgcgcgcccgtacagcaactgcccggcctcggtgggccgcagcgcatgcgtcgtgcgatgcaggaggcggatgccgagctgtgtctcgagccggtcgatgcgccgcgtgaccgacgacgcggcgacgcccagccggcgggcggccgccgagaagctctgctggtcgaccacgtcgacgaacagcgccaggtgcggggaaaggaaatcgtccattcggtgccttcggatttggctatgcgttcatcgcaaaacaatcatccgcttttgcgggtttccgcgtcaaaccgagccgactagactgcgttcatccatttcactcgctgcacgccccgccccaccgggccgcgcggcagccaaccgccacggagatcaccatgcgcagcatccgcttcgacgcccccgccgccgacatcgagtcgctcgacgcgcgggtcaggaaatcgacacgcccgtacaggccgacggccagatgctgatcgaggtgcacgcggccggcgtgaacccgagcgacgtgaaggccgcgctcggccgcatgccgcacgcggtgtggccgcgcaccccgggcgcgactgggccggcatcgtgcgcagcggcccggaaggctggatcggcgcgccggtgtggggctcgggcggcgatctcggcgtcggccgcgacggctcgcatgcgcaatggctcgtgctcgacgcggcactggtgcgccgcaagcccgccgtgctgacgctcgacgaagcggccggcgtcggcgtgccgttcgtcaccgcctacgaaggcttgcgccgcgccggcatgccgacggccggcgacgtcgtgctcgtgttcggcgcgaacggcaaggtcggccaggccgcgatccagctcgcgaccgcgcacggcgcaaccgtgatcggcgtcgagcgcagcgccggcggctatcgcggccacgcatcgggcgacgtgcacatgatcgacgcgtcgaaagagccggtggccgacgcggtgcgcgcggcgaccggcggccgcggcgcggacatcgtcttcaacacggtcggcagcccgtacttcgaagcggcgaacgcgtcgatggcgatcggtgcacggcagatcttcatctcgacgatcgagcgcagcgtgccgttcgacatcttcgcgttctatcgcggccagcacacgttcgtgggcgtcgattcgctgcagctcggcggcgccgcggtcgcgcagatcctcgacacgctcgcgcccggcttcggcaacggcaccctgcgcccgttcccgatcggcgacgactacgtctatccgctcgagcgcgcgcacgaggcgtatcgcgcggtgctggccggtgcgcgcgagcgcgtcatcctcaaaccctgacgccggatcacacgggagaccgccatgacggattacgtgacttcgctcgcggtgggcctcggcgtcggcgtgttgtatgcgctgctgcacgtgcgctcgccggccccgccgctcgtcgcgctcgtcgggctgcttggaatggtgatcggcgaacgcgcgatcgcgctgttgcgctgacgggtcgatgccgctagcggtcgtcgcgccggcggaatgcccaccacgcggcgagtgccgtgaagcccgccacgagcagcaccatcagccagaagccgtgcttgttctccgagaacggcacgccgccgacattcatcccgaagaagccggcgacgatgttgatcggcagcgcgatcacggtcacgagcgtcagcgtgaacagcgtccggttgttctgctcgtcgagacgcgaaccgatctcttcctgaagcagcttgatccgctcgttgagcccggccaggtcggcgagcaccagcgaaaactcttcggtcgactcgcgcagctcctgcacgtcttccacgtgcagccaggcgggcggtttcgcgagcagccggaagatcgacccgggctcgggcgcgagcatgcgctgcaggcgcgtcagcgtgcggcgcatcgcgccgagctcgatgcggctcgacgtgagccgctgcgacaggaaacggtcctcgatgcgatcgacgtcgacactcgtgcgccgcatgatctggatcagcaggtcggcctggtcgcgcagcaggtgcacgagcagttccgccggcgaccggaactgctcgccgtcgcgcacgcacgcgcgcagcgtgtcgaccgaacgcagcggcttgagccgcgcggtgaccatgatgcgccgctcgacgtggacgaacagcgtcgcgatctctgacggcgtcagttcgaggttgaacatcacgtcgttgacgatcgcgcgcagtgcgccgtcctcctgctcgatgcgcgtcgagcgcgacccttcgtgaaggaattcgaagaagctgtcgggcagatcgagatgcgtgcgcatccagcgctcgctcgcgccgtgcgcgagattgaagtgcagccagacgaaatcgtccgacgcgccgtcgtgctcgcggcacgtgcgcagccacgcggcggccgtgtcggcatcgagcgtcgcgccggatccgcccggatcgaagcggaatccgcacaccatgccggacgtatcggcgccgtaagtctgtacgatcaggtccatcgtgtcgaaggtcgtgcggcgcgcggcgcgccgcgcatcgcgggtcgcgagcccgcgccggaaaaggaaaggaaacgtatgcccgacgggcgtgacgcgcccgtgacagcgtcacgccgcatcataccggccgattccgcgccccaaagcaacgcgccgcccaacgggcggcgcaggtgcggcaggccggcaaacgcgagacgcgttactgccgcgtctccgactgcgcggcgctcgggcacgcgggatccttgccccagtgaccttcgcagacgcgccagcggcacagttgatcctcgaagaaaccgcgctccgaacattccttcacacgcgaggccagcgagccggccgtcgcggccgtcttggtcggcacggcctgcgccttctgcgcggcgagtttcttgtcggcgggcttcgtgcgcgcgacgagcgccgcgagcagatccgcatccggatcgtccttcccggccgccttcgcactgcgggtcggcgtcgcgtcgcgacgcttcttcgcctgcgcaagctcggcctgctgttccttgcgatgcttgcgggcctcggcctttgcgtcggccttggcatcggccttcgtgtcggtcttgccgtgcgccgcgaccttcgcgttcttcgctgcgtcggccttcgcggtcttggtcgcagcagcagcggcggccgcgccggccgtagccgtgcccgatgcatcgtcggcgccgttggcgagcgcgcgcgacaggcggctgttgtccgcggcggacgcggacgatgcggaagcaacggttcgggaaactgcgtcgtcgttgacgatcgtggccggctgcgcggcggatgccgcattttgcgcgacctgcacggcagcgtcgctggccgctgcggccttcgccggtgcggcggccgcgggtgcggcctcggccgtgacggcggcggcctgctctcccgaatgctgcatgcgccatgcgccccagccaccgacggcaaccaccagtgcaacgacggccgcgatcggcgccttcagcgaacggcgcggcggttcggccggcggcgtgacacgtccttccagattcgcgagaatgcgcgactgctgagctccgtcgcctgccggtttggtatcggacagcaggctgggcggagttttcgaatttgaattttccggcgcactcattcagcgtctcattgaatcctggtttaattcaccgcgataatatagcccggcctctcgaagcagcctgattctaagagcaagcattgcaaaacacaatcaattccaatttccggggatttcgttgattgccgtcgcactcgtcgcctatttcgcccttgccgtagcagttgcggcactgttgctttaccgggtatccgcgcgaccgttttcgaatccgtcgcccagtttcacggccgtctaacacgccgtgcgaacgatcgcgccgcgcgtacgcgaagtcagattgttaaatcggcaagcgttacgcgcggtgctttaaacgatgtgcaaaatttactggttcggcggcgcttgatgattatggtatcggcaggtattcttgcgacgccgccattggtcgccattgcgttacgcggccggcaattgttccagtacgacgacacggcgcgcgtgcccgacgagaagatcgccgccctgctgcagggcgaacagctcgtaccgcccccgccgctgccgccggaagtcttcgccaccaaggaagtcgaacaggtacgtccggcgctgaaggatgcgagccgcgactggaacctgctggatccggatttccgtacgcgtttgctgctggtctacaagatcatgcacgaacaatatggatatgaaatggcgttgctggaaggttaccggagcccggaacggcagaaccggctggcggcaatgggcggcaacgtgaccaacgcggcggccttccagagttatcaccaattcgggctggcggccgacaacgcattcctgcgcgacggcaagctggtcatttccgagaaagatccgtgggcgatgcgcggctaccagttgtacggccaggtcgccgaacaggttggcctgacctgggggccgctggaaaatgatggatctcgggcacgtggaataccataaacccggttttaaactgggacgcggcagctagccagggctgccggacaggaaataatgagggcggcatggggctttttaatatcccggcaggaaacgatatgggcggcgcaaaaatcatgcattccggtgcgcgatttttccggccgccgcttccgttttaaatctcacagcgtcctttcgttaatgcgcgcgccttctccgatgccgcgggcgcattgatgccagccccttcatcccgtttgacagcatggcgacacatcgcggcgccacccttgccgctcgacgcgcctgcgtcgcctcaccgaatcgcaccggaacctgaacgtcctatgcaacgcatcctcaacgtgctgactcatccgcgtacgctctcgatcgtcgggatcgtcgcgctagcggccatcctcttcatcgtcgccgacatgctgcagctgccgctcctgtgggcggcgatcgcgttcgcggcgatcctcgcgctgtggctcgtcgtcgcgctgtggcgccgctggcgcgtgaagcgcgcgaaccagcagctcggccaggtgctggaggagcaggcggaaaccggcaagatcgccgcgcccgccgccgccgccctcgcccccgacgcgaagacggccgacctcgacgtgctgcgcacgcgcctgtcggacgcagtgaagacgatcaagacgtcgaagatcggccaggtatctggcggctccgcgctgtacgaactgccgtggtacatcgtcatcggcaacccggccgcgggcaagagcagcgccgtgctcaattccggcctgcagttcccgttcgcggacaagaacagcgccgtgatccacggcatcggcggcacgcgtaactgcgactggttcttcacgaccgaagggatcctgctcgacacggccggccgttattcggtgcacgaggaagatcgcagcgaatggctcggcttcctcggcctgctcaagcgctaccgcccgaaggcgccgatcaacggcatcatcgtcaccgcgagcatcgccgaactcaccggcaaccgccccgaattcgcgatcaacctcgcgaaaaacctccgccagcgcgttcaggagctgacggagaagctcgaggtgttcgcgccggtctacgtgatgttcacgaaggccgacctgatcaccggcttcaccgaattcttcagcagcagcgacaagcacgagtacgaccgcgtgtggggcgccaccctgccctacgaacccgacgacaagcgcgacgtggtcgcgcagttcgacacgcacttcgaggaactgtacgaagggctgaaggaaatcagcgtcgcgcagctgtcgctgtcgcgcggcaaccagctgtcgccgggccagctgagcttcccgctcgaattctcgacgatcaagccgtcgctgcgcgcgttcctcgcgacgctgttcgagaacaacccgttccagtacaagccgatcttccgcggcttctacttcaccagcgccttgcaggaaggcgagaccaacagcgcggccgcgcagcgcatcgcgcagcgcttcggccttgacggcagcgcgctgccgaaaccgcacagcgcattctcgaagaacggcttcttcctgcgcgacctgttctcgaaggtgatcttcgcggaccgccagacggtgcggcagttcgcgagcccgaccaagacccggttgcgctatgcgaccttcttcggcttcgtcgcggcgctcgcgctcgcgctgggcggctggacctggtcgacgatcggcaaccagcagctcgtcgcgaacgtgcaggccgacctcgacaacgtcacgcgcctgcagcagggccgcaacgacctgcagtcgcgcctgcaggcgatggacatcctcgaagaccggatcgagcagctcgagcagttccgccgcgacaagccggtctcggtgtcgctcggcctgtaccagggcgaccgtctcgagcagcacctgctgaccgagtattacaacggcgtgcgccagatcctgctggccccgtgtcgcagaatctcgcgtcgttcatgaaggacgtgaacgcgcaccccgagcagctcgtgccgatgacgcgcccgcccgaatcgggcgccgtgcagggtggcgcgattccggtctcgacgaacgcggcaggcgccgcgccgcaggccggcgccgcactggccgcatccggcaccgcgccggccgccgcgcaacagccggccgctccgcagggcggcctctacagcgacgcgtcgccgaccaacgtgcaggatgcgtacaacgcgctcaagacgtacctgatgctgtccgacaagcgtcacgtcgaacaggcgcacctgaccgaccagctcgcccgcttctggcgcggctggctcgagacgaatcgcggcaacatgccgcgcgacgagatgatcaagagcgcggagcgcatgatctcgttctacctgtcgcgcgtgaacgacgacgactggccgatgatcgacgcgaacctcgcgctcgtcgaccagacccgcgagaacctgcgccgcgtcgtgcgcggcatgccggcccgccagcgcgtgtacgaggaaatcaaggcgcgcgcgtcgacccgcttcgcgccgatgaccatcgcgcgcatcgtcggcgacggcaaccaggggctcgtggcaggcagctacgcgattccgggcacgttcacgcgcgaagcgtggttcgactacgtgcagccggcgatccgcgacgcggcgaccaaggaactgcaggcgaaggactgggtgctgaacacgtcgacgcaggacgacctgacgctcgagggcagccccgagcagatccagaagacgctcgtcggcatgtacaagaccgagtatgcgcagcactggcagaagttcatgcagggcatcgccgtgcagggcttcagcagcttcggccaggccgtcgacgggatgaaccgcctcggcgacccgcaggattcgccgatccgcaagatcctcgagaccgcgtacgaccagacgtcgtgggacaacccgtcgctcgcgaacgtgacgatcaagaaggcgcagacgggtgtcgtgaactgggtcaagcaactgttctcgcgctcgccggccggccaggtggcggccgccaacatcgacatcaacggcaatccggccgaggtgccgatgggtccgatcggccaggaattcatcgggctcgcgcggatcgtcgcggtgcatgacggcacgtcgatgctcaagggctacatggagtcgctgtcgaaggtccgcacgcgcttcaacgtgatcaagaaccagggcgacccgggcccgggcgcgcgccagctgatgcagcagacgctcgacggcaacggttcggaactcgccgattcgctgaagctcgtcgacgaacagatgctgaccggcctcaccgattcgcaacgcaagtcgctgcgtccgctgctcgtgcggccgctgatgcaggcgttcgcggtcgtgatccagccggccagcgccgaagtcaacaaggtgtggaacgcgcaggtctaccagccgttccagaactcgctcgcgacgaagtacccgttcgcggcgagcgcgaaggtcgaggccggcgccggtgaaatcgcgcaggtgttcggtccggacggctcgatcgcgaagttcgtcggcacgacgctcgggccgctcgcggtgcgccgcggcgacaccctcgccgcccgcacgtggggcgacatgggcatcggcctcacgccggacttcacgaacggcttcgcgcgctgggtcgcgccgctcgcgggcggtgcggcaggcggcgcggccgcgtcgtccgagccgcagacggtgttccagatcctgccgcagccgagcacgggcacgacggaatacacgatcgcgatcgacggccagcaactgcgctaccgcaacacgccgccgcagtggaccaacttcgtgtggccgaacccgcagggctcgccgggcgcgacgctgtccgcgacgaccttcgacggccgcacggtgcagctcgtcaacgagccgggccgctacggcctcgagaagctgatcaactcggcgcaacgcaagcgccgtccggacggcaccttcgacctgacgtgggcgcagggcaacgtgaacgtgtcggtgacgatgcgcatcatcagcacgtcgcaaccgtccggcggcgggggcagcgaccagccgcagcagcagagcctgcgcggcctgcagctgccgtcgtcggtcgccgacgcgagcgcgggcgccgcgcagaacgcgacccagtccggcacgggtacgccgggcgcagcgccggccgtcgcggccgccaacgcaacgaatgcacagggggcgcaatgacgcaaaccgtacaggcgcaaatcgcctacttcggcaagattccgtcgcgcggcgacttcgtgaagagcccgcacaatccgcagttgctgcagacgctcgaccgctggatcgcgcaggcgctcgaactgctcgcggaagatccgcgctggaagctcgtctacgaggatgcgaagccgatgcatttcgcgttcctcggctcgcgcagcaagctcgcgatcgcgggccacatggtcgcgagccacgacgtgtcgatgcgccgcttcccgttcctcggcgcaacggcgctcgaggtcgaccggccgctcgcgttcctcgcgcgcagcccgctggcgttcgcgcggctgtggtcgcgcgtcgccacgcagatcccgccgctgctgggcaaggacgagccgcccggcgcgctgcaggcgctcggcgacacgcaggtgccgatcgacgtcggcggccccggcacgtcgcatgacggcaccttcaacgatttcgtcgaacaccagtcgctgtacggcctccaggagatgctgctcgacagcggtcatcccgtgcggctgcgcggcgcgatgctcgcgctcggctcgctgctgcggccggtgatgcagagcggctcgtcgcacatcgagcgcggcctcacgctgccgctgccggtcgatccgttctaccgcagcctcgtcgccgcgttctggctcgaactgatcgcgccgttcgtcgcgcaggccgacttcgagctcgcgatcttcatcggcacgatcgccgagcgcgaacggctcatcatcggcttcaacggcgcgtcggccaagacgctgctgagcgtcgtcgacccgcagacctacgccgcccacaacatcgacatcgacgatcccgagtggatcgacgcccatgcgcaaaacgatcaccagatcagcaagctcgtcagctacctcgaccaaccgcaactctcgctacgcgtcgccatcgacgcgttccgcgaagcgttcatcggaggctgacgggatgcatcgcatgaatcacgtcctcgccgccctcctcgcctcgggcctgttcatcggcagcggcacggccttcgcgcagaacacgggcgcgacggtcacgccggtcggcaacggcacggtcgcgacgaccgcgctgcccgcgaacaccggtgccgcaccggggacggcgtcaggcgccgtcgtgcacggcacggccggcgccgcgagcaccatcacgccgccgcccgcggccgcgacgcccggccaggtggtcgtcggcggcaaggtgcccgacgaggcgaccaaggccgccgtgctgcagaagctgcgcgacacctacggcgcgacgaatgtcgtcgaccagatcgaggtcggcgacgtcgcgacgccgccgaactggagcgcgaacgtgcagaagctgctcggcgcgcagctcaagcagatcagcaaggggcagttgaagatcaacggcacgcagatcgagatgaagggcgaggtgcacaacgaagcgcagcgccagcagctcgcgagcgacatggcgaacacgctgaacccgacgtatacgatcaggaacgggctgcgcgtatcggcgtccgaacagggcgtgctcgaccagacgctcgcgaaccggacgatcgagttcgaaacgggcagcgcaacgctcacgccgcagggcaagctgatcctcgaccagatggcggccgcgctcgcgaagatgcagaaccgcacggtcgacatcatcggccacaccgacaactcgggaaccgcacgtcgaacatcgcgctcagccaggcgcgcgcggatgcggtgaagggttacctgatcacgaagagcattccgccgcagcagatgacgacgacgggcgtcgggccggatcagccgatcgcgccgaacgatacggcggacgggcgcgcgcggaatcgacggatcgagttccgggtgggacagtaagcgtagagggatgtcacgggccgcttcgtacggagcggcccggcaggcgacgggcggcggcagcgatgcgccgcccgtttcgcgtttacgactgctcgtccggcctcacgcccagcagttcgcgaatatgcgacagcgagccgtcgtccttcacgacgctctcgagccacttgtgcagcggcatgtcggcccattcggccgccttgtcggcgagatacgcgaccgggctgtgcggctcggtctggcggaaatagcgggcgaccgcgcgcaactggtcgacggcctgcgcacggttctggatgccggcgatcatctgcgtcaccggggcgcgcggaacgggctgcggctgcacgtgagtctcctcggtctgaatcgggttgccgaacaccggctcgatgcgctcgggttgcgcctgcggtgccgactgcgtgtgcggcgcgctgcccgtataaccctgctcacgcgcaaagcgctcggcgagccggtacacggtctcgaacgcgtcgcgcgcctgccggaagctcggcgccgaatcgcccgcgcgctcgacgagccgctcctcgaacgcatcgagcgcgaattcgaacgccttcaggttcgcgagcagcgccgtgtagaacgcgatcgacgtcacgcgccgcgacgaatcgatctgctcgatcgacggcttgccgcgtgcgatgtcgtccgcgtgttcggggtcgcgcttgatggcctgcgcgacgtgctgcgccacttcccagtcgagcgtgctgaacgcgttcgacgcgccgtccgtcaatggcaccgcgcgcagcagctcggccgtgcgtccggacagccacgcgacgttgccgagccggtgctcgatgtcgtcgtcttcgggcagcgggtgcacggtgtcccagaagtcgcggcacaggccctcgagcagcgcatagccttcggtgaggccggtgatgccgtcctcgagcgcgagcgcctcggtcagccatacggcgagccgcaggtccttcgtgcgcgtgcgcagcagctcgcccgcgtgatcgacgacgaagccccagtcggcctccttgatctcggtcacccattcgccctggtcgagcgtcggatcgtcgtagcgccgcgcgtcctggatcgcgtcgaattcgttcgaaaacagcaggtcgtcgccgctgggcgacgcatcgctgatcggcgtcagcagctcggggagattgatcggcatggtttcagttcatcaatgctgggtgatgcgcggccgcgctcattcgacggtgtacgtgaattcgccggcctcgtccgcgcgcaccgcgatgcgcgcgatggccgcgccgtcggcgatccggccgagcacgtggcccgcgatctccggcagcagcgtgccgttcaggatatggtcgacgttgcgggcgcccgaatcgacttcggtgcagcgcgcgagcaccgcgtcgacgagcgactcgtcccattcgaacgccgccttgtggttcgcctcgatccggcggcggatccgctcgagcttcagctcgatgatctcggccagcacgtcgtcggaaatcgggtagtacggcacgaccttcatccgcccgaggaacgcgggcttgaacgtcttgtacagctgcggacgcagcgtctcggcaagggcatccggatcgggcagttcctcggccggcttgttcaggcacgcctgcatcaccgcggcggaaccgacgttcgacgtcaggatgatcagcgtgttgcggaagtcgatctcgcgcccttccgcatcgtccatcgcgcccttgtcgaacacctggaagaacatctcgagcacgtcggggtgcgccttctcgacctcgtcgagcagcacgaccgaatacgggttgcggcgcacggcctcggtcagcacgccgccttcaccgtagccgacgtagcccggcggcgagcccttcaggcccgacacgctgtgcgcttcctggtactcgctcatgttgatcgtgaccatcttgcgctcgccgccgtacaggatgtcggccagcgcgagcgccgtctcggtcttgccgacgcccgacggcccgacgaacatgaacacgccgcgcggcttgttcggatcctcgaggtttgcggtcgcggtgcgcacgcgctgcgcgatcgcgtcgagcgcatggtcctggccgatcacgcgcgcggtgagcagcggctgcagattcagcacggtgtcgatctcgtccttcaccatccggccgagcggaatgcccgtccacgcggcgacgatctcggcgacgacatgcccgtcgacctgcagcggcaccatcggctcgccgccctgcagcgcgtgcagcgccgcgacgcgctcggcgagcttgtcgcgggtcgcctgcacgtcgaccggctggccgtcttccgacgggccgcgtgccttgtcgagcgtgtcgcgcagctcggtgatctcggcgacgatcgcgcgctcggcttcataacgcgcttcgtccttcgccagttgttcgagcgccgtgtcgcgcgcgccgcgcagctcgccgagccgctcgtcgtgcgccgcgccgccggccgcctcgcgctccagcgacgcgatttccgcgtcgatccgctcgatgcgcttcttcgtgtcgtcgatcgccgccggcgtcgcgctgtgcgcgagcgcgaccttcgcgcatgcggtgtcgagcacgctgatcgccttgtccggcagctggcgaccgctgatgtagcggtgcgacagacgcacggcctcggtgatcgcatcgtcgaggatccgcacgttgaagtgcttttccatcaggccggacattccgcgcagcatcgcggccgcgagcggctcgctcggctcctcgaccttcacgacctggaagcgccgcgcaagcgccgcgtccttctcgaagtacttcttgtattcgctccacgtcgtcgcggcgatcgtgcgcagctcgccgcgcgcgagcgccggcttcagcaggttcgccgcgtcgttctggccggcctggccgcccgcgccgatgatcgtgtgcgcctcgtcgatgaacaggatgatcgggtgcgcgctcttcttcacctcatcgatcacgctcttcaggcgattctcgaactcgcccttcacgctcgcgccggcctgcagcagccccatgtcgagcacgtgcagcgcgacgccgcgcaacggcggcggcacgtcgtcggccgcgatgcgcagcgcgaggccctcgacgaccgccgttttgccgacgccggcctcgccggtcatgatcgggttgttctggcggcgacgcatcaggatgtcgatcgcctggcggatctcggcttcgcggccgatcaccgggtcgatcttgccgtcgcgtgcgcgctgcgtgaggttggtcgtgtacgtgtcgagcgcgggcgtcttcgacgggcccgccgcgggcgccgcgccgtcgactgccggcgcgaggccgccgtcttccgtatcggcctggcgcggttcggcctcgctagatccggccatgatttcgtcgaacttgtgcttcaggtccgtcacgttcacttccgcgaactgcgacgacatccgctgcgcgaattgcgcgagatccggcgcggtcagcagcgcgagcagcaggtgcccggaacggatgcggccgagctgcgaatcgagcgacgcgatcagccacgcctgctcgaacagcgcgatcaggtgcacggagaacaccggcgtgcgcgtgttgccggtcttcaggcgcgtcagctcccgctccagatcggcgcgcagcgcatgcggatcgacacggctcgcgcgcagcgcgagcggcaggtcgcccgccggctcctcgagcaacgcgaggaacaggtgctccagatcgacttcgtagtggccgcgcgccaggcacgcgctcgccgcacgctcggtcgcgtggcggcacagcgggttcagtttcgtgatcagggtcttcagaggcgtgctcatggcgtcgatctcaggttcgattgtgtgtttgttgtcgttcggattcagtgaatcacgtgcagttcgtagcgcgcgtcggagcgatcctcgagcgcgtcccgcgtgcacaggaacgcgtcccagccgagccgcgagcccgcgccgagcacgctcgcaccgacctcggtgcgcttgagcacgagcttcacctcgtattcgagcgtgacgccggcgagcagcgtcagcatccgctccagtgcgacggcctgcgcgccgccgggcaggaacgcctcgtagtcgcgcttggacagcgggccgacgacgatccgcgcgcgcatgtcgcgctgccatacgcgctcgccgaccagcgccgtcgcgccgagcaccgcgttgacctcgccgagcacgctcagctggtcgggcggcacgtcgtaccacttgccgacgaactggtcgatcttcaccggcacgcggaaatagtcggacagcgtgcgctgcaggtatgcagccgacatcggccggtgccgcgcggccagcgcataaccggcaacggcctcgtcgagcacgccgcccacgccggccgcgaggctgtcgcgcacttcgtcgctcggcacgcccgcgatcgcgagcagcagcggcagataacgttcgtcgcgatcgagctcgtaatggaacggcagccggtatttcttccacgcggcatagaacagcgcggtcgcgcggttcgagaacacgtcgaagaatgcgcgcgccgcgtggtcgcgcttcaggtgctcgcgcgcgatgatctgctcggtgtaatgcagcggcagcgcgccctgcccgccaagcagcccaaagaatgcgggcgtcagctcgacgtggccgagctcgccggccgcgagcgcggcgccgcgctgctcgtccgtcttcagttgcgtgccgtcgccgtcgaacgagcgcgcgccttcgatctcgctcggcggaaagccgagcgacagcgtgttgcggaattcgatgcgctgcgcgaccgtcgccctgccgccacgcgccgggcgcatccgacgcctgccgcgcgaacagcccttcgagcacgcgcacggcctggaagaactcgaagcggtgcggttcgtcgagcagtgcgtcgactacgccaggatcgattcgccggtccggggcttgcatcggatgatctcctcgccggtgcgcttcgacacgacgactagttgaacgaaactgttgaggtggacgtacagcccgaagaagctgtcgagcacgcgcacgaacgaggccaggctcgcgccgacgaagtgctcctcgtcgatcgtcaggcggatctcgatgccgcgcacgaaggtcgcgaacggcttgccgggcagccactgcacggcgccgcgctgctcgacgccggcgaggccgtcgatctggcgcatcgacacggcggtgcgccgcaggtcgtacagcgtcagcatttccttcagcggcgcgaggccgtgcgcgaccagcgacacgtgattgagcgcgaggtgcgacacgagccgccagtgcgcggcgcggccgcgctcgaagcgtacgctctgcgtcgggcggcgcagcatcgagatgccgctcgtctgcgcgccgccttcctggaacaggtcgccgccttcgagcccgaacgcgagcatggccggcaggtcgcggttcgtgcaggtgagatcgaggctcagcgtgtcggtctgcggcgacgtcggctcgaaatcgatgtcgacgatcgagatttcggtttcataaccggggctcttctgcgcgacccagtcgttgcggcgcgcgaaccagtaatggccgatccgcgccgattcgccgtgatgcagcgagtagaacggccggaattcgatcaccgattcctcgtgcgcctgctgcctgacgagcttcaccgaatcgatcgagtacacctcgtatgcgaacgcgcgccgcgcctcggcgatcaccgggtaggacaccgcgcggtgcgtgatgcggatcggctcgccgtgctggcggaacaggttgacgatcggcgtgcagaacagccggaagtggctcgccgtcagcagctcgagcagccgcgcgacgtgcgaatcgctgcgcacgtcctgcagcacgagatgcagtgtcgcccgctggcagcgtcccgtcgcgcgcgcgatcgccgcgatgtcgaagtcgacgaaatcgaacttgtcggggaacgcgaagtattcggtgagcaggcgatacgcgggatgcgatttcgccgggtagtcgatcagcgcgtcgtcctcgtcgaagccggcgtgcgcgatcggcagcttgcgcaacgcggtccagcggccgttgcgttcgggctcgacatacgcgccgagcacgttgacgaacaggcagtcggtcagcgcggcgacgaacgactgctcgccgtgcaggtgcgcgcgcagcgtcggcagcttcagcgcaccgagatcgagctgcgcggcgagcgactcgaacgtgatcgagatcacgcccgtcgcgttcgacggcagcaccgtcgcgctcggcgcgagcgcgactggcatgtagcgcgcttccgagatgcggatcggcgcgagcgtcacgtcataggcggtgcggaaccggcactgcacgccgcggatcgggcggctcttcagctcggtaccgcgatcgatcacgaccggctcggtctgctggccgggcgaggccggcgtgaactgcgcgatcgagcacgacgggaacggccgcaggtagtgcggatagagcacttccagcagcgcttcggtgaattcggggtaatcgtcgtcgagcttcttgttgatgcgcgcgccgagcagcgcgaacgactcgatcatccgctcgacgtgcggatcctcgcaatgctcgccggacagcgcgagccgcgccgcgatcttcggatagcgttcggcgaaatctcgcgaatagcgccgcaaaaacgataattcgcgctcgtaatacggcagcaattcttccatcgacgaccccgaacctcaatatttcctgccggaccctgaaccatcaccgggcggtccggcccgctcggcggcttgatttactgcattcttgcggcgcgtgcgcgcgtgaccgaatactgcagcgtcgacggctgcagcatcgcgtcgaaactcaccggctcctcggccgggtgcacgacgagcagcgcctggatcgcgaaatagagcgcgttggtggcctgctcgttcagctcgaacgtcacctgcacctgctgcaggcgcggctcgtggcgcgcgatggcctgctggatcgacttgcagatgaacgcgcggtcatagtgactcgcgaggctcagccccgcaaaatcgttcagcccgtaggtcagcaccgacttctggcactccggcagcgtggccagctcgttctcggtgtgggcgatacgggtgttgaggatcgcctcgacgtcgcgggcgaccgtgttcttgagctcgtccagcgacaattgccgcatcgctgccgaggccggcaggtgcggttcgtcgtcgaacagcttgtcgagaaaactgggttcgaatcgtttcataagggcctgtttccgctaataacgggcttgcgaacgtgtgttgccggtcgtagtgcaaggagtgaggagcgccgtttggccgagccaaacgccccgaaggaagtccccttgggggacaagcgacgaacgacgccgcaatacggccggcaacgcacgttcccctgtttgaaaaatcattcgtggggctggccccagaagggccgatcgccgcgtcacgctcctcgcgaatacgtcgagtattcgcttcgtcgcaatccttgcgctcggcccttctgggggccagcgcaagcccgttattagcggaaacaggccctgattcacagcgaaaacggcaacgggacgccgagcgccccgttgccgcgaccgaccttagaccgcgtaggtcttgtcgttcttcgtcagactccaggcgccttgcgtgttgccgccctggttgccgccgatcttctgctgggtttgcttccactgcacggctgcgtacttcagcgagaacgtctcgagcggcagaccttcctcgcgaacgctcggggcgatgctcgagatgatcacgtacttgagcttgacttccagatactgcacgcgcttgccttcaccgtcagcgcgcgagaaatgaaccgtcacctcgtcgaacgtggtaccgcccgaagcgtgttggtacagcagcgggctcgacgaatcgatttccttcgtgaaaatcatgtcgccgtgctcgcaacgcgtcatcgtgtgaccgccagcggtcgatgcggttgccgaacgcggctgaacgatcgagtgatcccacgatttcagttcgatccagccctggtggtccttgtccgcggattcgcccttcaccgcgggactaccaaactgcaagtgcatatgtaacatggcccttcgactccccaaagaggtggttttaacgtcctacccaggcggcccgcccgggcgatttactcgcttatgaatttgccggtttgggcagatcagcgacaagtcgcagagaaatcgagagttcgtcgagctgaaagtgcgggcgcaggaacgcgaccgaacgatacgagcccggcttgcccggaatctccgacacttgtatggatgcctcgcgcagcgggaattgcgccttctgttcctgcgacgcgttgtcgtcgagcaggacgtactgcgaaatccaccggttgaggaaagtctccacgttctgcgccgatgcgaagctgccgatcttgtcccgcatcatcgccttcaggtagtgcgcaacgcgcgacaccgagaagatgtactgaagctgggcggacaggacggcgttcgcattcgcgctgtcggtgctgtatttttcggtttctgcaccgattgcgcggcgaaaaacgcagcgtaatccgagttcttgcaatgaacgagcggaatgaagccgaggtcgctcagttccttctcgcggcgatcggtgatcgcgatttcggtcgggcacttcagcgcgacttcaccgtcgtcggtcttgaacgtgtgggtcggcaggtcctcgacgaggccaccgccttcgacgccgcggatcgccgcgcaccagccgaagtcgtcgaatgcggccgtcaggcgcgctgcgaacgcccacgcggcgttgcaccacaggtacttgtcgtggtcggtgccgtcgacgtcttcgacgaagttgaagttctccgcggtctggccgtccttcggattgaacggcaggcgaccgaggaagcgcggcagcgtcaggccgacgtagcgggaatcttcggcgtcgcggaacgacttccacttcgcatattcgaccgtatcgaacaccttgccgagatcacgcggcttgccgaggtcggagaacgactcgaggccgagcagctcgggcgacgccgacgcgatgaacggcgcatgcgcggccgccgcgacgtgcgacatctgctcgatgaagtacatgtcttccggctggcgcgagatctcgtaatcgccgatcagcgcaccgaacggcgagccgccgaacgtgccgaattcctcttcgtagaccttcttgaacagcgcgctctggtcgaattcgctcgcgcccttgaagtcgcgcacgaggtcgcgcttcggtgcgtgcagcgccttgatcttgatcgtctggccggtgttgctttccttgaccagatagtccatcccgcgccacgtgctttcgaggcgctggaattccggtgcgtgcatcaccgcggaaagctgcgtggaaatcaggcggtcgagttccgcgacgcgcgtcgatcgtggccgacaggttgtccgacacgatcaccgtgccgtcgagcacctggtgcacgagttcgccgatcaggtccttcgcacgcgcatgctcggaatcggatttcgcgaccttgctcttctcgacgatgtcgtcgagcagcgaagtcccggcggcgtattccgcgccgctcgcttgggccgcagccgtttgctggttcatctcaacactccgtcgtcattcgccgtctttgtcgccgccggtgcccttcgcgagctcctgcagctgctgcgtgttcttcagcacctcggacagcagatcctcgagcttgtcgttgccggcgagcttgttgcgcaggtcggcgagcttcgagcgcgcctcgagcaggcggcgcagcggctcgacctgttcgacgacttcgtccgggctgaaatccgacagcgaacggaacttcaggtcgaccgcgaacttgccgccaccctcgctcaggcggttttccacctggaacgcggcacgcggctcgatcgccttcatcacgtcgtcgaaattgtcgcgatcgatgttgacgaacttgcggtcgcgcagcttcggctgctcgatttcggactggcccgccagatcgccgacgaccccgacgacgaacggcagttccttcacctcgatcgcatcgcccttctcgacctcgtaggtcaattggacgcgcggcggccgtattttctgcaagcttttctgaatgctttctttcttggccatctcgacggctcccaggttagttgtggttatcgcgtcagttgcggtcagttgcgcagggcgccgaacggatcgccgcccttcggcgctccgccgcccgacgacgtgttcgtcggcggcaccgtagcggtggtttccgcaccctgcgtcgtgaatttcttgtgcacgaccgtgcgggtcttcttggttcggccactggcgcggggattcgtctccggcgggaacagcgccgattcgcccagcgtgtcgcgcagttgcttcgcgagcgcctgcgcatcggacttcgcgtcgcccgcgagcgacgaatcctgacgcagctcgccgagcgactgcgtcgcgatccgcaggccggccacggccagcacgctctttgcctgacggtcggtcgcgtcgcgctgcagcgcttcctgcgcggcaacgattgcctgaccgtagtggttctgtgcgaactggatttgcgcgatgcgcgaccacggctcttcgcgcgtcggatccgacttcgcgagctgctgatacaggccgagggccttgtcctggtcccccgccttcgcaactgcgtccgcatcggccagcgacttgttgaacacctctgcagtcggcggcgcgggaggctggctcgcacaaccggcgatcacgccgcaagccactactaccccagacagttttgcgaagagacggtctttcatcgttatatccaccggcgcgtgagttttaaatcgttgagaatctggttcttttgctttgcaagaagcgcgcgggtatagtaccgatcaatttttcataattcaatcgtcgtgtgaagagtaattccttttaaaaccgggcgctacccctccaatggccgctcgccgcgggctcgcagcgattttctttcggccggaatgggcaagttttactggttgcacgacacgccgccggggtggcggaaaaatttccggacgctcgccacgacgcgggcgtgcttaatagttgaacagtgcaatgccggggatacgcaacgagcgcggaaatacccggcagatttgacagggataaaggcagcacgccggaaatacgatgagatcgttgatgattcgctacgcgctgccgctggttgcctgcgcccttctggccggatgcgcggccgccccgctgctcggctcggccgcgagcgccgtgatgtccgccgccggcatcggcaagcccgaggtgcccgacgcgcagaagccgccgcgcagcctcggcatcacgctcgccgcggcgccgaacctgaatgccgcgaccgacaacaagccgctcgcgctcgtcgtgcggctctatacgctgaaggacccgacgtcgttccagcaggcgccgttcgacgcatttacggatccgaccaaggaaaaagccgcgctgggcgcggatttgctgaacgtacgtgaaatcacgctgattccgggccagcgctatacggcgaccgaaaggtttcgcgcgaagcgcaagcgttcggcatcgtcgcgctgttccgcgatcccgcactacaacgatggaaactgacgttcgacccggtgaagtcggagaaatccggcataatcatcggcctgcataattgcgcgatgacggtcaccgatggcaccgtcatcgcaccgcaacagggtgcgccttcgcaaccgctgaatttgctttcttcggtctcctgcggttaaacatgacgcacgaatgtcaattaacaagagttaacaattggcgatttaattcgggcacgaacgaatcgattacatcgcaacgcgacattaaccggatttgacatgagttattcggccaaggtgctgtggggaagggctgttcctccggcctcaacactttcagcgacaggacgcgtaccacgaagcgcgcctgttcgaatcgatccaggcgatccagccgtacaactggggcgtgcgctcggtgcgcatcgaccgcgacgcactcggcagcaacgtgctgcgggtggccgagctcgcgctcgtgttcccggacggcgcgctgtatgccgcgccgcaggccgacgacctgccgccgccgatcgcgctggacacgctgcctgacggcatcaacgaattcgtgttctatctcgcgctgcatccgctgcgcgagaacggcaccaactacagcgacgatccggccgccggcttcatgacgcgtttcgtcagcgagcagaccagcgtcggcgacaacttcaccgacgcagccgaagccgacatcacgttcctgaagacgcaggtcaagctgatcgcgcacagcgaaccgcgcgaccagctgctgtcggtgccgctcgtacgcgtgcgccgcaccgcgacgtccggtttcgagatcgacgacagcttcgtgccgccgtgcctcgcgatcgacgcatcgccgatcctgcaccagcggctgcgccagctcgtcgatgcgctgcaggcgaaggtgaacgcgctgtacggcttccaccgcgagccgtcgaagaacatcatcgaattccgctcgggcgacatcgcgtcgttctggctgctgcacaccgcgaatgccgcgttcgcgacgctcgcgcacctgcaccagcactcggcgctgcatcccgagcggctgttccaggaactgctgcgcctcgcgggccagctgatgacgttctcgaagggctacacgctcgcggacctgccggtgtaccgccacgacgatccgggcccgagctttgcgcgtctcgacctgatgctgcgcgagctgctcgacaccgtgatctcgacgcgctacttcgcgatcacgctcgacgaggtgcgcccgtcgttccacctcggccgcctcgattccggcaagatcgacgacaagaccgagttctacctcgcggtgtccgcggacatgccgagcgtcgagctcgtcgatgcggtgccggcccgcttcaaggtcggcgcacccgacgacgtcgacaagctcgtgctgtcggccatgcccggcgtgcggctgtcgtacacgccgcaagtgccgcccgcgattccggtgcgccccggcgcctgctacttcgcgctcgattcgcgcggcgcgctgtacgagcgcatgctgcaggcccagtccgcgatgatctatgcgccgactggcatcaatgacctgaagttcgaactgatcgcggtcacatcatgagctacgcgccttccctgttcggcgacaacgcgccgcctccctgcataccccggcgtcgacggacgcctcgttccaggcccgttcgctgctcgacctgctgtacgacgggttcttcatgctgttcctgctcaagaacgggcgggaaccggatagcgcgagtgagttcagcacgcggatccaggaattcctgtcggacttcgagcgcggcgcgaaaagctgaatatcgcggccgaggatgtgtacggcgcgaagttcgcgttctgcgcggccatcgatgagatggtgctgtcgtcgcagttcaagatccgcacggactgggaacgccggccgctgcagctcgtgctgttcggcgagcagctcgctggggagaagttctttcagtatctcgaggaaggtcgcgcgcagggtgcggcgcggctgcagtcgctcgaggtgtttcatatgtgcctgctgctcgggttccagggcaagtatctgctcgaagggccggagaagctggcttacctcaccgcgcggctggggacgagatcgcgcatatgaagggcaagcgggcgccgttcgcgccgcactggccgttgccggatcagatcgcgcatcgactcaaacgcgaagtgccggtttgggcgatcggggcagttttgcgctggtggcgctgctcgggtatctcgggctcaatacgtatctgaaggacaagacgctgcaggcgttggcgccttattcgcaggtcatcaaggtcgggccggaatcggccaatttgacgatttcgttgccttgaggggcggaggtttctcggcctcgcttcacgatgagaaaggaccgccccggcggtcctttttgttgcgacgtaccattcgtcgtgctcgcggctactcgccgttcgaatccagatcgaggaagtcgtcgtggcgatcgaagtggtcgagacagcggacgaggtcgtcgatcgacgcgcccggtttctgacgacaggccagatcgacgacgtcctggaagtgctcgcacgagtagcggaatacataaccgagctcagtgacacgttcggggtagcgctcgcgctcctcgtcgtcgacctgtaccttgtcggcgatatagatcgtctgccgcggacaccagtctgcatcgccgtcgtttccgtacacatcgtattgccacgccggatcgtagcccgccggccgttcggccttcgctcgcacaaccgcgatgaagtcggcaagcgtgaacgtcctgttcttgaaatcttccgggccgcgaatctgcaatccgatgcgctcgcattcgatacgcgccagcaatcgttcggccctgtcacgctcgcacgccagcaggccggcatcgaggtctcgtgccgccgcaagcgcccgctccaggaacgaacgcgccgatccactacgtgacgtctcgcacatcagatcgcccagcgcgacgagcgactgggcgagtgcaacgcgatcgccctcctgctcggcctcggtcagcgcaagatgcagcacggcttcgcctcgatccgtcatgccatgatcgagcagcatcagcgccttgcgaaaggtctgccgcgcactcatcgcgacgcctcgttgccgggcagatccatccagacgtcttcgtagccggcgtcgtcgatgatgaaacgcgcgccgggcggcagcatcaaatagggcaagacgagcggcaggtaggtgggcagatgtgcggcgtgcagcggctggtagaaatcgggcgcgtccgaatattcgccgcagtggaaaaaccagccgatgtcatcgccttccgacagcgcgatgcgcgtgccatagacaggcatccgcccgagcgtcgatatcgcgaccgcaaccttgtgctcgggttcggcagcgcgcagagcgtatcgcgcacacacggcctcctggcgctcacgccactcggccggatcattcgtcaggttcatttcccgcccctccatggcgccccgcatcgacagaaaggccgtgaaactgtcggataccggcgtcgtctcgcccgtctcatgcgaccaaaggacgacggccggctcacacgataccgctgtccggtcgtagtcgaagcagtagtagtcacctgtcccgaactcggcaaacggcaacaagtgcgagaaatcggcatccgtatggtcgaaattgtctcgccacgcgcgccagccttcgtcgtagcgccgcacgatcgaattccacgtcctgcgcggattgcgcgcatcgaagacggaaacacgggcagtccgccgagcgaccggccgttgttgagaagcagccatgcggcgaacgaacgcggcaacgcgcggccgagcaatgcttcggccgcttcgatttcggccacggtcgtgccgatggtcggcgtgggggcatcggttgatcttcctgtcggtatccccgacatacacgggttcgattttgcaccgtcacgactcgagccaccagtcgagcagcgtttcgtcgtccggatcctcgaagttccggtagatgttcgcgtagtaccaggcaaggccggttcttgccgtgaagccgtcgaagacggtacggattcgctcgcctcccgcaccggacggcaccgataacgcgagcgagccgccgtaacgaccgtcgagcgtaccgctcagttcggattcgacctcgctcgcaagccggttgatgtcgcgatccggaatcgcgtcgccatagatctggatgcagtagtttccgccgcgcttcagtaccgtggcaggacgatcggggtcatccatgcggacaagatcgcctttcgcgagattcagcgcaaggccaggcgatgccagcaattcgtagatgcccggctcgacctgacgcgcgggaagttcttcgtgaaccggtgcatctccggagctacctgcgtagacgtggatcaggtcgtcatcctggtcggggtcaagcatttcgttctcgccgtaagtaagaccgtgtttcagtcaatcacttgtgtcacccggggctgcctgcggattggcctcagcattgcttgagactgctcgcccgcactcacccgccgaccacctccaggaacaccagcgcttccgcatcgggcagcgcctcgcctatccgcgcccggacttcagcaaggaatgccgggcggatttcatacgtgtcgtcgaagatatcgcgtgagtaccttccaacgtacaactcgcaccagatacacagcgcgtgggcgaagtgcgtgagggatgacgcaacgcgcaatggtgcccaggagcccgcgccgtggcggtcgaacagcacatcgccttccgggacgacgatcacgggatcgccgcccatctgacccagcacgatccagtcgtcgtgccatccggacagacgccggccagatgcgtcgacacgatagccggcctggccacgcacgagactcgcctggttgccgtacaacaggaggtcgtcagcggtccagggaatcgacagatcgacatcgtcgagtgcgctgaaccacgcagcaatttcatcgctcacggagagggagctcgtgggtgttgcatggtcgggcgcaggtgcgccgatgcttgcttgcacgcccaccgtgtcgcgaatttcgacgatgaactgcttcagatcccgatcgtgcatcatgcctcccggcgacatggcgccttgtcgaatcgcttgcgaacgataccggtctcgcgtctctctgtcagccgcatgccgacacttgaattcaccgaaatcgtcgatggagtcatcggtcgctaaacgacttgcgaccttcgcatcccggacaacgtaatgcgccgcgggattgccgagatagacggtgccaaaaatgcatcctcctcgagaaatcgaacgagcggattggctgcaatcaggatgtcccgccaggatttcatgatgacgtgtggcaaaccacgtcgtcagaacaggatgaattcatcgttctctacgtaaaagacgaatgcgtcgagcaactgcgaaacgctcggttcgtcgatttggtcgtgggcgttgatcacgatatcttcgatcgtcgcactattcagcgtgacgctccagccgggttgcagcgcgatcgaggacgatgcatcgtcttcggcatgttgcgcgtctactgagaatgcgccctctgtatcgagcgtccacggcttcggcggtagatagagccagccagagaagtcgccgggcgtttcgaggatctgcttcaggctgactacggtcgtcaggtcggttgttgcgagcatgggttgtaggggagtgacgtttggcggtgcggatggcacggcgtcgtgacatgcacgtgcgatatcgtcggtagattcacgtgagcgctgcaaaacgcgtacgttgttcgtcggcatcacggaatcggacatcggcgctcgcgcacgatgccgcaaaaggtcgtgattatgccaatgaaacgggaggcgaaacctgccaccatttttgtgggtgtagcgatcgaacaacgtgttggctgcccgctgcggctggccattcagaccggttggccgaaataaacgacctcgaacatgtcgacccatcggtggaatggttccggcagcgcgttcagccaatcgcttttccctgcaattttcgcatcggacgcgaacacgacttcattgactttgggatcgccgtagacggtcagcacgacgaggcacccaccgcttcccgcgaacgctgcgcgccgacaaggccccgggtcttccacgtcgtcgaagaattcgacacccgatgcaatcaagtctgtctcccggcattcgaagtatccccggtccgcgatccggaccggacgatcccgaaaagccgcttcgagggatgggtagtgagtcgtcatatatctcaatgaggttcgctcgcaacgcaggatcgcgaccatcaggttcagcgaggcgtgtgtaagccgacggcctgcggcacgtggtcggcacgcttgtcgcgctaccccatcccaaagagcgaatcgacaacgttcctgatccacgtcttgacatcaccccaggcgattttcttttgcgtcgtaatttttacgataaaaattatcgaccacacgacggcgagacctgcggcgacacataggcttaaaaatgaaaattcactcattggaatgaacgcgttccaatttcttcgcgatgtacgcatgcgacatgagtgtacgtgaggtccagaggtctctggccgagcactatggcatcgatgtatcacccgacttcatcgagacggttactgaagggcgatcgccaaagcgctgagttggcagaaccgtccgcttgacgcgatgcatcaggtattgctcttcgactcgctgcggatcgaggagaccgacggcgctaagttccggcttcaggcgggtacccggaatccgcagcacttcgatggcaatacttcgaggctcggcgctgtcggccagttaacgtgtccgacgccacgtcgccttgtcggcttcgatatcgactccctgcccatccgtaggctcgcttcgccacatgaccagtacatgatgagcccaaccggtcaagcagctctgctctgatactcgccaaaacacttgtcgcaaacagcaacgagcccgtcgaagacggccgcatgctgatcctcgaaatccgatccaaacggcgcatcaccaggctccggcaaaccgaactgtttcgcgacctcggtcgaaacaaagtacgaaatgtcggcgagtccgtctcccagccagtcgatgtcgtaacggagaatcttcaagcgcctcgcgtccgttttcatgtcggcgccgatatcgctcgaaacatgtatcaccccggttgcgccatgcgatttacacagtatccggcccatgtctcatcctattgtcgtttcccattcgcaactagagcgaatcgatgacgttcctgatccacgtcttgacatcaccccaggtgattttcttttgcctggtaatttttccataaaaatggtcgaccacgcgacggcaagacccacggcgacacataggcttaaaaatgaaaattcactcattggaatgaacgcgttcaaatttcttcgcgatgtacgcatgcgactatttttcgactcactgcggatcgagatccgcgacgacggcgtagtcagcaacaaggccctctatccagaccgacgggcaggagcttatccgatcttttgtgtgaggcataaaccgagagccaaggaaccacttttatgccacgcaaacgcaaggaggaagtgacgattgaaccgggcacgacggcttgaaccttgacccggcactgatcaagcaactggtgcccgggacgctgaaccggtcgacgatcaacgaacagcttgcagcaggccagccaatccgcgtccaggcgtccaactccgtgcaatccactttcatcatcaattttctgcccctgaaatcgcaatgaatttcgagtgatttcgcccgtcactcgcgatacccgcgcaacaacttcttgcgcgactccccacgccttgtacgacgcctcccacacgccaatcacgcggccggccgcccccgccctgctgaaatcgatctcaatcagggccaattcgacttccggcgcggcgcggttgcgagtagtgtctacatgcccgtattccggccgccccgggttcgaccgatacccggcgctcaccacacacgacactgacctctggagatctgcgatgaaacgttcgaagttcctgctgtcgggcctgctgctcgcgtcggccctcggcttcacggccgtcgccgcgcacgccgacgacctgctcgattcggtcaagaaagccggcgtgctgcgcgtcggcctcgagggcacgtacccgccgttcaactcgcgcggcacgtccggccagctcgagggtttcgacgtcgacgtcgcgaacgcggtcgccggcaagctcggcgtgaagacgcagttcatcccgaccgaatggagcggcatcatcgccggccttcaggccggcaagttcgacgtgatcgtcaaccaggtcacgatcacgccgcagcgcaaggaagcgctcgacttcagcgagccgtacacgtactcggccgcccagctgatccagcgcaaggacgacacgcgcaacttcaagtcgctcgacgacttcaagggcaagaagctcggcgtgacgctcggcaccaactacgaccagatggcgcgcaccgtgccgggcatcgaggtgcagacgtatccgggcgcgccggagaagctgcgcgacctcgccgccggccggatcgaggcgacgctcgacgaccgcctgatgctgccgtacatgatcaagacgtcgaacctgccgctgcgcgcgggcgcagtgctgaacggcggcaagcaggaaatggcgatcccgttccgcaagggcaacccgaagttcgagaaggcgatcaacgacgcgctcgactcgctgcacaaggacggcacgctgaagaagatctcgatgcactggttcggcagcgatgtgaccgtgccggtcgcgcagtaagcggcccgacacttcaacgcgtcacgccattcgtttcggtgaatgcgtgacgcgcccctcgccgcttcgtcgaagcgcgccagcagcatctggccgatcggtgtcagcgccgggcgcgcggccacggcgttcatgcgcatctgcgtatcgtcgaccagccgcttctcgaccagcacggcaaaagccggattcgacggatcgacgctgtccggcgcacgtgcaatgcgcaacagcatcgagaattcatgcggactcagcatggtccctgtctcctgatcgtccgcgatccggttcgaaccggcgtcgatcgtcttttcgaatgaaatggcgcgtggcacgactgccgcgccgccgggagcgagatcccggcaggcctgcctgcgacgcgggcacgtcgtcgcgagcgggttgcgcacgtcccggctccggcgatgccgccgcgacgggaacgtgcaacgttatgggcgcaccatgacgcgaccatgacaggaaagcggggcgcaagacagcgtgcgttacatgccgcttcgattcgatgccgatcccattgacgaagacggatcgcatcgcatgcatggccggcggttgcctgctcgccggttgtttcgcgcccttcatcgcgggtcggccgaatacgggaacccgccgcttgccgatccgctcgcatggcgcatgcagcgcgcgaccacgttcaccgcgcgcccgagcgtcatcccgacgagcacgccccataccgcgaacgacagcatcacgaagccgctcgtcgccgcccacggcgcgtgcacggcgaccgcgtaatggatgccagtttcggcgacgaacgtcagcatcagcgtgacgagcaggctggcgtcgccaggcaggcgcacgcgcaggcccgacgacgccggacggtactcgagccgccaccggctcgcgtgcagccagcccagcgccgcaccgctcacgacggctcccagcgcaatcgcgttcgcgtcgatgccggcatgcggaaaaagcccgttcaggctgacgatgccgagcatcccgaacgcgaccggcgagatcagcggtcgtgccgccggcacctctcgcgggaaacagcgcttgatgccgatgtagagcagcacgcagaacattacgtacacgtaaggcttcaggtgaaggagcgcggacatggtcggagtcgcctggtcggagtggacacggcaacaccgtactgcgccgctcaggcagacggcacggcttgcgacgggcggccggaatttgcggacgagttgcgcgtcgcggcgatgatcgtccggcgaatctggacgaatgacgcgccaccgaagccggccgcctgcgacgtccgagctgaatggtccgccctccccgccagccggcgcttcgtgctcgacgcgcaaccggcaacacccgtgtccttccacagcgccttccactacactcgtggcggaaaccggccaaccgtcggcagccgaagcgcttcgtcgaagccgcgcgccgttcgtcgcaacgcgcgcgttatcggcccgtccggcagtaaggtcaggccatcggcgcatcgcgcacccaccttcacccgacaccatgcgagccacgtccgacccgtcgccgattccgcagccacccgccggcgccccgccgcggctgctgcgcgatccgtccgcgctgctcgcgttcgcgtgcttcaactcggtcgtcggcctcggtttctgggcgatccatttcaacgaaccgctgttgccctacctcgtcgtcgccaacacgatcggcttctgcgcgctgctgttcagccacgccgccgaccggctgctgccgcgcaagccggggctcgcgctgaagaccgtcgtggttgcgccggccagcgtgctcatcggtttcgagatatcggcagcgatcgtccgcgggaacgtgccgcacgtgttcgggcgcgccagcctcggaacgtgggacaactacgggccgtcgttgctcatctcggcgatcctgttcgtgtgcgtatcgttgttcctgcaatcgatgcgcatgcgtgcgacgctcgagaccgagcgccgcgaagccgccgaagcgcgccagtccgagaccgccgcgcgcctggcactgctgcaggcgcagatcgagccgcacttcctgttcaatacgctcgcgaacgtgcagagcctgatcgagcgcgacccggcccgcgcgtcgacgatgctcgacagcctgaaccgctacctgcgcgcgagcctgcggcgcacgcgcgatgcgacgtcgacgctcggcgaggaactcgaactcgttgaagcactgctgaagatcgcatcgatccggctcggcgagcggctttcttatacgatcgacgtgccggcggacctgcacgcgctgccgttctcgccgctgctgctgcaaccgctcgtcgagaatgcactgctgcacgggatcgaaccgtccatcgacggcggcgtgatcgtgattcgaggcaggatgcgtggcgacagactcgaactcaacgtgatcgatacgggcgtcggcctcggcaaaagcgacacgcgcctgcatggcggcgtcggactcgccaacgtcgcggcgcgcatccggacgctgcacggcgagcgcggccgcgtctgcgtcgaaacgaacgccgccgccgcgcatggcgtcaccgctaccctgctgatcccgatcgactgacatgccgaccgccctcatcgccgacgacgaaccgaacctgtccgcctcgctcgcgcagcggctggggcagctctggcccgaactggaaatcgttgcgatgccgcgcaacggcatcgaaacgctggccgcgctgaacgcatcgccgcgcccggacatcgcgtttctcgacatccgaatgcccggtatcgacgggttgaagctcgctgcgctggcgcccgatgtgcatgtcgtgttcgtcacggcctacgacgaatatgcggtcgacgcgttcgatcgcgcggccgtcgactacctgttgaagccggtgacggacgagcggctgctgcggtgtatcgcgaagcttcagcgcggcgggccggcgcttgcgcaggccgatgcgcttgcgcaggcggcacaagcaagagaagcagtgccgatccgctggctgacggtaggcgtgaaggatgcgacgcggctcgtatcggtcgacgatgtgctgtatttccaggcgtcggagaaatacacggaagtcgtcacggctggcgaacggctcgtgattcgcacgccgctgaaagagctgatgcagcggctcgatccggagcggttcgcgcaggtgcatcgcggcgtgatcgttgcgtatgcagcgatcgatcgcatcgagcgcgatctgctgggacggttgcggattcgcgtgcatgggcagcgggaaatgctgcccgtcagtcgtgcgtatgcggggttgttcaggcagatgtgaggggcgtctgcttgcggcacgcttaacaaggttacgttccgacaacgcgtgaacgacacgttgtcaaaccgcacaccatccaacacaatcgcgcgatcaggttgcactcggctgtatcgccccaagtcgacaagacaccctccccactagccggcgctgaaacgatgaaaacactgcgtggattaacgacatgcgtggttgcaacgctcgtaagcggctgcgtcgccacgcctgatctcatcggcgaaaacaccgcgggcatcgcgccgacagaagcgaccgcgatcctggtcgtcgtggacggcaaggcattcgacaggcccgagtacggcaacgaagggcacgcgtatctcgccggactgggtgaaggcatccaggctgcactggccggtgtgccgacgagaatcgtcgagctggacgagatgaagttcgtgaatccggtacctgcagcactgcgggccatgaggccgagtcatacgatccgcctgttcacggagtccgggaccacgcgtaacggcacgcccatcagcgcgacgtggcaaatggaggtatcgaatgtgacgacaaccctcgtcccggcgaccggcgacaaaccgggcggtacccgctacacgatcaaaccgatctacaaggcgcgcgccaatggggagacatgtctcgattcggacagcttcgcgaaaaagtgcggtgcggcgatgggaaagatgtttggcgatacgctgcgcgccgcgcatgtggtgcagatgagtgcggggacggccgctcagccggccaactgaagggccgcgcgggaatgacgaagggctgcgccatgcatcgcgcggcccttcgctggacagcgtggcgggcaaccgggccgaatccgctgtcacctcgactcggccgtcccggtcgttcgaatcacgagcgccccgaagtcggcaacgatgaaatcagaacggcaccacatgaggtcttgtgaccttcgaacgccgcattcgccccctcgatatcgaactgcccgtcgccttcgacgacgacgcacggcccatgtaacgggcacgtgcagcggtcaccgacacgtgcgggcgcacgccccatgacatcgctgttggacgcgcccgtctcgacataaccgccgtgactgtggacatcgcccactcgaatgattcctcgcatgatcggttatccggtcagtaggagtagccctgcatggcatagctggtgtcgtgacgacggccccaccacggaaggtacgcattgttctcgccacgcgcgcggaaccagtccttgtccgcatcgatcggcacgactttcgacggcggcaacaccaccaccgctgtcgggtgctgcgcatccgtcgtccctgccaccagcaccttctcgccaaggtgattcgcccggccgatcgccagcaccacgtccgtcagcgccgtacccgctcccatcgggcccagcagcgccggcgtattgaacgtctgcttgctgaagttgtagtccggcaacacttccgtcagcgtctgcgacaacgcgccgatccgctccgacgccgcttcgccgccccggcccgcgtcatgcaccacgaagttcagcgacggcaccggcacgcccgcgttgcgcgccgcgccgtcgatcgtggctttccacgcctgcaccgtgcgcgtggtgccggccttcgcctcgtagtccttgacgttgcccgtcgccgcgcggccgatccaggccagcggttcgcgctccgtcttgaagttcggcccgacgaggaacagcaccaccatgttctcgttgatctgcgcgtccttcggcgggaagctcggggcgtcccagttcatcacccacgcgctcttgtccgggttcgcctgcaggtaatccagtgcgcggttcagcgatgtgaatccggcgtttgcgccgccttggttgacgtggacgtcgggcggggtgtcacggctccagagatcctggaagtatttgttaccgatgttgaactcccgggtaatgctctcctgcaaataagcctgagcctcgccagcgtccagtctatccggcacggcaaactccacatggataccagccagttcacgccaatcatccttatttttggacttgaccgtgtagaaatacttggcgttcatcacatagcgatcgccgaacaggccaagcaatttgcgaacgtacttgtgatagaaacctttgaatgtttccgttccttggttgccgtacaccagcgcaccaattgactgcaacttcgaaaatttctgcggcatcgtccgaaccatatcgtcgttcttgttcggctgaacaagacccattgtccagagaatctgccactccgtcggatagtcgcgtcgctgcaatggattcagccactccaacccgacaacttgtgcgatgaacggctgagcgttttcgctcgtatccaacgcagcggcatctttctgaatcacagtatcggcctgcaccggcaccaccatcacgacggccaacacaacaaacgccagaagcgcacccaggaacgatcctgtagacaatcgattcacccattccccgaactctattcgtcacgaaacccgcgtgcagcaaaaacactcgagctgcacatcatacccatcgtggcaatcaatccacggaacggagtcgagatcagccggagtgttacccatccgatcattggaaaaatctcaccgatatcaagcaaacaacttgaaagccagtatcagaaacagcctttacccataaattcgatgcaagttgtcagacacgtcgcaaggaaataaactctggatataacaaagggccaagcgaatatcgcatagccctttgtttcgaaacgtgacgcccgggtacgacaatcgccactcgcgaagccgccccttccgcacacaatcagccgctccagcggttcttcgacaaatacttcattcccgaatcgcagaccaccactgcaatcgtcctgccacgcatctcgccggccagcagctgcagcgccgacacgacgttcgtgcctgacgaaaatccgccgaagatcccttccttctactcaagctcgcgtgcgatccggagcggttcgtcccctgcaaccggcagaaaaccgtctgcgcgcatgtcgttcagaaacggaagatcgctgatcgaataggcgctaccctggatcggatgctcgggtcgcgtgacaggttaccccgcgatcggcaccgccccaaccggctcgacggcataacagcgaactgcaaaattccgttccttgagcgccttgccgacaccgataccgacaaagctaccgtccgaacagacaaaatcgacaaacccgtcgatacggccatcggtcgcctcccggatttccggcccggtcgtcctgtagtgcacgagtcagttgccgtcgcgataaaactgatcggagcgaaacgcaccgcgctcggcttcgatacgctgagtttcgcggtcgatgagttcgagatcgccttgcgacacctgcccgggaacggagtccgccaactgatcgacccgcatgacttccgcgcccaacgcgcgcatcatcctggcgcgctcctcggagttgaccttcgacatcaccgcgacgaacggtatgttcttgctatggagatttgccggacagatcgggcaatgccgaagcgattggccgggctaactgtcgctgcaccgaacaagcgacaacccatgggccagtaaagtgagcgctgaaacgacgaagggccgggaggaaaacctcccggcccttcgttcaatttggtgccggctgcaggactcgaacccgccacctgatgattacaaatcaactgctctaccagatgagctaagccggcgtagcgcgagattctacctcatttcacgatcttgaggcgaggtctgttgccacctttcgaaccgtcgccatcgccgtcggttttcggcggttcgtcggcgccttcggagggttcctcgttcgcgccgcggtcggcaactggcgtcaacgcagcaggcgactcgtcgcgctgcgcgtcatccgcctgcgcggcttcttcgtcgaacgcgcccgaatcctcgccttcgcccgcaaccgcatcgacctggaacgccatccctgcccgttctcgcgcgcatagatcgcgagcacgttggcaaccggaatctcgatcttgtgcgccttcccggagaaccgggccgtgaactcgatccactcgttgcccatctgcaactggctcgtcgcctcgaagctgatgttgagcacgatctcgccgtcacgcacgaactgacgcggcacgcgcgtcgagttgtcgaccctcaccgcgatatgcggtgtgtaaccgttatcggtgcaccactcgtacagcgcgcgcagcagataaggcttcgttgaaatctcttgcatcacaatcctcgaacccggagcgggcgcgcggcacgccgcgccgccctccccgtcttgccttcattgcatcatcaacgacgcatgaccttttcggacggcgtcagtgcttcgatataggccggacggctgaagatccgctcggcgtacttcatcagcggcgcggcgttcttcgacagctcgatgccgtagtgatccagacgccacagcagcggcgcgatcgcgacgtcgagcatcgagaattcctcgccgagcatgtacttgttcttcacgaagatcggcgcgagctgcgtcaggcgatcgcggatcgcgaggcgagccttctcgtgattcttctccgctgccttgcccttctcgttctcgagcgtgctgacgtggacgaacagttccttctcgaagttgagcaggaacaggcgtgcacgtgcgcgctgcacgggtcggccggcatcagttgcgggtgcgggaagcgctcgtcgatgtactcgttgatgatgttcgattcgtacaggatcaggtcgcgttcgaccaggatcggcacctgaccgtacgggttcatcaccgaaatgtcttccggcttgttgaacaggtcgacgtcacggatttcgaagtccatgcccttctcgaacagcaccagccggcaacgctgggagaacgggcaagttgtgccggaatacagaaccatcatgtttgcgtttcctcaaagccgagggccggcacgcggcgaacctccttccggggttccaccttgcgccggccccacgccggtcaggcgtgattacttgatatctttccagtacgcggcattgagccgccaggccaggaaagtcaggacaccgagaaagatcagcacccatacgccgaggcgtttgcgggtctgctgagccggctcggacatccaggtcatgtacgccaccaggtcggcaaccgcagcatcataatccaccgcggacagtgtccccggcgtgacctgctggaagccgacgagcgtatggaccttctcgcccgtctcctcgtccgtcttgtcttcgaatttggcagtgcgctgcccagctgccacagtacatggggcatgccgacgttctcgaacaccgcgttgttccagccggtcggccgcgtatcgtcgcggtagaagctgcgcagatacgtatacagccagtcgcggccgcgcgcgctcctcgaccgacaggtcgggcggcgaggtgccgagccagttcttcgcgtcttcaggccgcatcgcgacggacatcgtgttgccgaccttgtcggtcgtgaacaggagattcttttcgatctccttctgggatatgcccagatccgtcagacggttgtagcgcatcaggttcgcgctgtggcagttcaggcaatagtttacaaacaattgcgcgccgtgctgaagcgaaacgagattttccgtgttatcgggcgcccggtcgagcggaaaattaccttccgcccgcaccgccggcgccaccagcagcgcacacgcggtcgccccgatcagcgcgagtgtcgaaagcagtttcttcatgtcgttctctcctcgctcacgttaatggggcttgaagcgcacccgctccggcggctgcttgaacgtgccaagcggcgtccagacgggcatgccgaggaagaacgcgaagtagatcagcgcgcaacactgcgcgatcagcgtggccgccggcgatggtggccgcgtgccgaggaacgcgagggtcaggaacgccgcgacgaagatcccgaggaacaccttgtggaacagcggccggtagcggatcgacttcaccgggctgcggtcgagccacggcaggaagaacagcgtgatcaccgccgaacccatcacgacgacgccccagaacttcgactccgtcaggtacatgaagacgacgatcgccgcggccagcaccggcaacccggccttccacttgccgcgcgcgcggatcagcgcgagcacgccgagcagcgcgatgacgatcatcaggacgatcttgaacgggtcggtggtcgcgcgcagcatcgcgtagaacgcggtgaagtaccagaccggcgcgatctcgggcggcgtctgcaacgggttcgccgggacgaagttgttcgcctcgaggaagtagccgcccatctccggcgagaagaacacgatcagtgcgaagaccatcaggaacacgcacacgccgaggaaatcgtgcaccgagtagtacgggtggaacgggatgccgtcgagcggaacgccgttctcgtccttcttcgccttgatctcgatgccgtccgggttgttcgaccccacttcgtgcagcgcgacgaggtgcgcgatcacgaggccgaccagcacgagcggaatcgcgatcacgtggaacgcgaagaagcggttcaacgtgacgtccgacacgacgtagtcgccgcgaatccacagcgacaggtcggggccgacgaacgggatcgccgagaacaggttcacgatcacctgcgcgccccagaacgacatctggccccacggcagcaggtaaccgaagaacgcctcggccatcaggcacaggaagatcgcgcagccgaagatccacacgagctcgcgcggcttgcggtacgatccgtaaagcagcccgcggaacatgtgcaggtagacgaccacgaagaacatcgacgcgcccgtggagtgcatgtagcggatcagccagccccacggcacctcgcgcatgatgtactcgaccgacgcaaacgcgagcgtcgagtcgggcttgtagttcatcgtcaggaagatgccggtgacgatctggttgacgagcaccagcagcgcgagggagccgaagaagtaccagaagttgaagttcttcggcgcgtagtactcggaaacgtgctttttccaggtggacgtgagcgggaagcgctgatcgatccagccggtgagacctgtcgtggagacttccttgttgtcggccatcacgcttctcctttctcgtccttgccgatcacgagggtcgtcgccgacgtgaacatgtagggcgggatgtcgagattctgaggcgccggcttgttcttgaacacacggccggcgaggtcgtaggtcgaaccgtggcacgggcagaggaaaccgcccggccagtcgtccggcaggttcggctgcggacccggcgtgaagcgctggcttggcgtgcagccgaggtgcgtacacacggccatcacgacgagaatgttcttgcgatcggcccgcgagcgatattcgttcgcgcaatacgcgggcaacggcatcgtatagggcttttcggtggtcggatcggccacttccttgtcggccttgaccacgtcggcaagcatcgcgtcggtgcggttcaggatccacaccggcttgccgcgccacggcacggtcaccatttcaccgggcttcagcccgctgatgtcgacttcgaccggtgctccggccgctttcgctttcgcggacggcgcaagcgacgccgcgaaaggtatgacggtggcgacgcctcctacgccacctgctacggatgtcgcaatcagccaggtacggcggccgctgtcgacgcgtttctcttccttgtctcgcatcacacgccccacttctgagttggattttccgtcacgactttccattccgccgctagtttgctcgaatggagtcgccatttacaaggcccggagatgaaaatcccttcgaagtgattgatagttaagggtttccccactatcggagcgattaaatcatttcgctattaagcattcgctacattgagaaatttcgatgcgctgccgcaaatccggcactcagaccgggttatggatatcgataaaaggtgttcgataccgaattcttcggacaagtgggcgccgagtgcctggattccgtagcgttcggtcgcatggtgccctgccgcaacgaacgcgacgccgctctccgcggccgtgtgcgtcacgtattcggacacctcgccggtcaggaacacgtccgcgccggcatcgatcgccgcgtcgaaatagctctgcgcggcgcccgtgcaccacgcgatgcgccgcagctgcatgtccggatcgccgagcacgagcggcgtgcggccgagcgtgcgctcgaccttcgcgacgaagtgctcgagcgagacgggcatcggcagcgtggccatccagccgaggtcgccttcgccgaaacgctgctcgccgatcagcccgagccgctcgccgagctgcgcgttgttgccgaattcgggatgcgcgtcgagcggcaggtggaacgcgaacaggttcaggtcgttcgcgagcagcagcttcaggcgctgatacttgcggcccgtgatctgcggcggctcgttgcgccagaaatagccgtgatggacgagcacggcatccgcccccattcgagcgcggcttcaagaaacgcgaccgacgccgtcacgccggtggcgatcttctcgatcttgcgacgcccctcgacctgcaggccgttcgggcaatagtccttgaagcgcgcggtttcaagggtattgttcaagtacaattcaagttcgatccgatccatataaacctctaatccattcagatgcttagacgcttctggctgttcttcgcgcaggcggttaccgtgctgctcgcgctgatgttcatcgtcgtgacgctcaagccgcaatggctgcaacggcaaggacagctcggcaagcagctcgccacgccgatcgttgcgctgcgggaagtcgcgccgggcatcggcggcgcgccggcgaccacgtcgtacgcggaagccgcgcagaaggcgatgccggccgtcgtcaacgtcttctccagcaaggacggctcgctgccgcccgatccgcgcgcgaaagatccgctgttccgctacttcttcggtgaccgcaacgcccgcaagcagcaggacgaaccggccgccaacctcggctcgggcgttatcgtgagcccggaaggttacattctaacgaaccagcacgtcgtggacggcgccgaccagatcgaggtcgcgctcgccgacgggcgcacggccaccgcgaaggtgatcggcagcgatcccgaaacagacctcgccgtgctgaagatcaacatgacgaacctgccgacgatcacgctcggccgctccgaccagtcgcgggtcggcgacgtcgtcctcgcgatcggcaacccgttcggcgtcggccagacggtcacgatggggatcatcagcgcattgggccgcaaccacctcggcatcaacacgttcgagaacttcatccagaccgacgcgccgatcaaccccggcaactcgggcggcgcactggtcgacgtgaacggcaacctgctcggcatcaacaccgcgatctactcgcgctcgggcggctcgctcggcatcggtttcgcgattcccgtgtcgaccgcgcgcacggtgctcgaaagcatcatcacgacgggctcggtcacgcgtggctggatcggcgtcgagccgcaggacgtcacgccggagatcgccgaatcgttcgggcttcagcagaaatcgggcgcgatcgtcgccggcgtgctgcagggcggcccggccgacaaggccggcatcaagccgggcgacatcctggtctcggtcaacggcgaggacatcaccgacacgacgaagctgttgaatacggtcgcgcagatcaagccgggcacaccgaccaaggtgcacgtcgtacgcaagggcaaggagttcgacatgaacgtcgtgatcggcaagcgcccgccgccgccgaagcagacgctcgacgagcaggacagcgataccgaatgacgtcgggcgggcggcgcgcagccgcgtgccgaactccaccggaaacgaaaagggcagccgcatggctgccctttgttttgcatcgaaagaccttctttccgggatggcggcctcgccgcacgcgttccggccggccacgccacccggccgctcaggcctggccggaaacccgcctgccgtacatcgcccggcacgccgccatcagctggcggcttcgccgttccccgcctcgccctcctcggccggcttcttcggcacgaagaaccgcgcggccagcagcccgatctcgaacagcacgatgagcggcaacgcgagcatcagttgcgagaatacgtccggcggcgtaacgaccgccgcgacgatgaacgcgccgacgatcacgtacggccgcatctccttgagcttcttcagcgacagcacgcccatccggacgagcagtacgacgacgatcggcacctcgaacgtgaccccgaacgcgatgaacatcccgagcacgaagctcaggtagttgtcgatgtcggtggtcatttccgccccgagcggcgcgttgtagtgcgccatcacacggaagatcgtcgggaacacgaggaagtacgcgaatgccatcccgcacagaaacaggaagtagctgctgccgacgagcggcgcgacgagcttttctcgtgctggtacagccccggcgcgacgaacgcccagatctggtacagcacgatcggcagcgcgatcaccagtgcgacgagcatcgtgaccttcatcggcacgaagaacgagccggtgacgtcggtgacgatcatcttgccgtccttcggcaggttctccatcaacggccgcgcaagcagccggaagatgtcgggcgcccagtagacgagcccgaggaacacgacgatcacggccgcccccgcgcgtatgatgcgatcgcgaagctcgacgagatgggaaatgaaagtttcttccggggcgtcgcccgggttctgctggggtcgctcacaccggccctcggtaggattgacgagcgagcatgcgctcggctcagaagaagcgcgtcggccggcgcaggctggccggctggtggcgcgcgacgcgcgcggcgcccgactgcacgtgcgtgcggcggatggtcgcgcgcttgtaccagacaggcgcagccgcctgcttgacgcgccagttgcggcgcttgggcgcgagcgcggccgtactgccgcgccacgacggcgccgcgggcgtgtcggactcatgggacccggtgctgcccgacgcttcgtcaaggccgccaaccgcggaatgccacgtgtcgttcagttccttttcgtgctcgcgcaggttgtcgtgaatcgtcgtctcgacattgcgcgcagccgattcgaaatcggtcttcatcgtccgcagcgcgtcgagttcgatttcgcgcgagacctcggccttcacgtcgttgatgtaccgctgcgcgcggccgaacaatgcgcctgccgtacgcgcgacgcgcggcaggcgctcggggccgagcaccacgagcgcgacgacgccgatcagcgccatcttcgaaagaccgagatccagcatcgcgaatgcctgtcagcgtgccggcgttacgccttgttcgaatcggaacgcgtcgtttccttcgcgttgacgtcgaccgagcccgagcgcggcagttgctgcgcgtcagccggtgcttcaccgtccttcatgccgtccttgaaacccttcacggcgctgccgagatcgttgccgatattgcgcagcttcttcgtaccgaaaaccagcgcgacgatcagcagcacgatcagccagtgccaaatgctcaatccacccatgatgaaacctctcctccacgccgctacgcggcgcaaatcgccggcaacgtgccggcttcgactatcgatgcgggaaacgccccgcgccatcaacccatccgctgccaggggcgcgggccggccaggatatgcgcgtgcaggtggtagacctcctgcccgccgcccgggcctgtattgatcaccgtacggaaacccgtttcgccgcccgtataggcgacgccgagctggccggcgagacgcgagacgagcagcatcagccggccgagcatcggcgcatcggcctcgctcgccgccgacagcgtcggcaggtgctggcgcggaatcacgagcacgtgcgtctcggccgccgggcggatgtcgcggaacgcgacgaattcgtcatcctcgtgcaccttcgtgctcgggatctcgcctgccgcgatcttgcagaacaggcaattcggatcgtgactcatgttgctcctgcagacgcccgaacgcggccggtcagaaccaggcctgcggatcgagcggcttgttgtcgttcaggtacagccaacccttgatgatacggtacagcgtccaaatccacgtgacaaacatcactgcgaatccgatcaccacgaacatcaacgcgaacccgatcacgtacgcgatcagcgcgcgccagaacgtgcggatctgccactcgaagtgggcggcatacggcgtgccggccacatcgtcgcgcttcacgtagttgatgatgatcgcgatgatgcccgtgacgccgcccgtgagccaatgaaacgcgtagaggccgtagagcacgtgagtcaacgtgcgcagcccgttcaggcgttcggcgtccgcggccccggcaccgacggcggcggaaactgacttggcgtatcggtcatgatgctaccccgttagatgacaattcttacagcttaccgcactgtggccatcccgcgacaagggtctgtcacccgccgttttcctcacgctcgcgacgcttgcgcagggccttctcctcgatccccgacagcccttcgcggcgctcgagctcggcgatcacgtcggccgggctcaggtcgaaatgcgacagcatcacgaggcagtggaaccacaggtcggccacctcaccgaccagcgcggtcggcgcgccgccctggcgcacgtccttcgcggccagcacgacttccgtcgcctcttcgccgatcttcttcagcaccgcgtcgtcgcccttgtggaacaggcgcgatacgtacgattgatcggggtcgccgcctttgcggctatcgatcacggccgcgaggcgcagcagcgtgtcttcggtcgattgcgtcatttgtagatgtgttcgggatctttcagcaccggttcgaccgcgacccagtcgccgctgtcgacggtgccttcgaatttctggaagaagcacgaatgccggccggtgtggcacgcgatgcccgacacctgttcgaccttcagcagcacgacgtcctcgtcgcagtcgagccgcacttcgtgcacgtgctgcacgtggcccgactcctcgcccttgaaccacaggcgcttgcgcgaacgcgaataatagaccgcgcgctgcgtctcgatcgtcttcgccagcgcctcgcggttcatccacgcgaacatcagcacgtcgttcgtcgacgcctcctgcgcgatcaccggcacgaggccgttgtcgtcccagcggaccttgtcgagccacgcgggcaatgcattcgtttccgtattcatcacagcctcaccgggatgccctggtcggccatgaagcgcttcgcctcgccgaccgtgtgctcgccgtagtggaagatgctcgcggccagcaccgcatcggcgcggccgtccttgatgccgtcggccaggtgctgcagcgagccgacaccgcccgacgcgatcaccggcaccggcaccgcgtccgacacgccgcgcgtgagcgcgaggtcgaagcccgacttggtgccgtcgcgatccatgctcgtgagcaggatctcgcccgcgccgagctcggccatcttgcgcgcccattcgatcgcgtcgaggcccgtgttcttgcggccgccgtgcgtgaagacttcccagcgcggcgtctcgccgtcggccgacacgcgcttcgcgtcgatcgcgacgacgatgcactgcgagccgtacttgtcggccgcgtcgcgcacgagctgcgggtttgcgaccgccgacgaattcatgctgaccttgtccgcgcccgcgttcagcaggcgccgcacgtcctcgacggcgcgcacgccgccgccgacggtcagcggaatgaagacctgcgacgcgacggcttcgatgatcggcaggatcaggtcgcgctggtcggacgtcgcggtgatgtcgaggaacgtcagttcgtcggcgccctggtcgtcgtaccggcgggcgatctcgacggggtcgccggcatcgcgcagttcgacgaagttgacgcccttgacgacacgcccggcagtcacgtccaggcaggggatgatgcgtttagctagagccatgatgttgcgccaaatgccgcgatgggacggccggttgcggaaagcctcgcgcgaggcttccgttggggccgcctgctggcagccccggcgagcgggacaaccgcgcgcttatgcgttgtcgagttcgccgttcagttcgtccgcgcgcttttgcgcggccgcgaaatcgagatcgccggagtagatcgcacggccgcagatcacgccttcgacgccgtgctcttccacttcgcacaggttctcgatgtccgtgaggttcgacaggccgccgctggcaatcacggggatgccgaccgcctgcgcgagcttcacggtcgcctcgatgttgatgccctgcagcatcccgtcgcggccgatgtccgtgtagacaatcgattcgacgccgtagtcctcgaacttcttcgcgagatcgaccacttcgtggcccgtgagcttgctccagccgtcggtcgcgaccttgccgtccttcgcgtccagcccgacgatgatgttgcccgcgaacgcggtgcacgcgtcctgcaggaagcccggatccttcacggccgcggtgccgatgatcacgtaggacaggcccgcgtcgagatacttctcgatcgtctcgaggctgcggatgccgccgccgagctgtacgggatttcatcgccgacttcgtcgaggatcgcttcgatcgcctcgagattcttcggcttgccggcgaatgcgccgttcaggtcgaccagatggagccgccgggcgccgagatcgacccacttgcgggccatcgccgccgggtcctcggagaaaatcgtggcctggtccatatcgccctgtttgaggcgcacacactgaccgtctttgagatcgatggccggaatcagcaacatagcaatcgggtgtcgtcgtggaaaagaaaagaatccggcgcgtaccggccaatccggtaccgcgccgtctcgctagtttagtacaactctttcggcgcttaggcgcgcgagccccgtaagacgggcctctgcggcccgccgactgtggcacgcacgcgacgttcacggtttccagtgtacgaagttgcgatacagacgcaacccgacctccgcgcttttctcggggtggaattgggtcgcgaagaggttgtcccgcgcgaccgcggacgtaaacggcgcgccgtaggccgtttcgccgaccgtatgcgccgggttgtccggcgtcacgtagtagctgtgcacgaagtagaaatacgcgtcgtcgggcacgccgtcccacagcggatgcggctgcgactggtgaacgcggttccagcccatctgcggcaccttgaagcgcgagccgtcgtcctgcacgcggccgtcgagttcgaagcgcacgaccttgccgggcaacaggccgaggcccttcgtgtcgccctccgcgctccagtcgaacagcatctgctcgccgacgcacacgccgagcagcggcttcgtgcgcgaggcctcgatcacggcctcctgcaagcccgactcgccgaggcagcgcatgcagtcgggcatcgcgccctggccgggcagcacgacacggtcggccgcgcggatcgcggccggcgtgtcgacgatcgccacgtcggcggccggttcggccttcttgagcgcctgcgcgaccgagcgcaggttgcccatcccataatccacaatcgcaatcgaagttttcatctcagtgcaggcagtagcgccctcagtccattgacgatgaattccaccgccagcgccgacagcatcagacccatcagccgcgtggcgatgttgatgcccgtgcggccgatccagttcgcgatcggctcggcgagccgcatcgcgacgaaacacagaaagccagggccgcgccgatcgcgaccaatccggcccgctcataccagtgacgcgagttcgccgcgtaaatgatcaccgtgctgatcgagccggggcccgtgagcagcggaatcgccagcggcacgaccgcgatgttgtccttcagctcggcctcgtggcgctcctccggcgtcgatcgcgtgttgccgatctgcgcgttcagcatgttgatcgccatcagcagcatgatgatcccgccgcccacctcgagcgacccgaccgaaatgccgaagaagtcgatgatctgctgcccgagcagcgccgtcaccgtcatcacgcagaacaccgacaccgacgcgatccggatcgtacgccgccgctcgatgtccgtctgctgcgccgtcaggctcaggaagaacggcaccgcaccgatcgggttgatcagcgccagcagcgaaatgaacgatttgagcagatccatcgcaagccggcgccgcgcgccgaagccgtgaggttgtccttgacgctccgtccggtcagttcaggttcagaggctgcccttcgtcgacgggatctgccccgccgcacgctcgtccagttccaccgccgcgcgcagcgcacggccgaaggccttgaacacggtctcgagctgatggtgcgcgttgatcccgcgcaggttgtcgatgtgcagcgtgacgcccgcgtggttcacgaaaccgcggaagaactcgatcgacaggtcgacgtcgaacgtgccgatccgcgcacgcgtgaacggcacgtggaattcgaggcccggccggccggagaagtcgatcacgacgcgcgacagcgcctcgtcgagcggcacgtacgaatggccgtagcgacggatgcccttgcggtcgccgatcgccttcgcgacggcttgcccgagcgtgatgccgacatcctcgaccgtgtggtggtcgtcgatatgcgtatcgccatgcgcttcaacctcgagatcgaccagaccgtgtcgagcgatctggtcgagcatatggtcgaggaacggcacgccggtagccagcttctgctggcccgtgccgtcgagattgagcttcacacggatctgcgtttcgctggtattgcgaacgacttccgccacacgcatggcaattccttgactgagtcgatgaaaatggggattgatcgtttcgcgccgcggcgcccgcaggctcaaccgggcagcgcgagtttcaaagcggccagcaggcgcgcgttttcgtcgggagaaccgacggtgagccgcacgcattcagccagcaacggatgcattttactcacgtttttgaccaaaacccgctcggtgagcagcgcgtcgaacacggcggccgcgtccggcacccgcaccagcaggaaattgccggcgctcgggaacaccgtcgcgcccggcagcgcggccacggcctgcgcgagacgcgcgcgttccgcccgcagatcggccgcctgcgcgtcgagcacgccgaggtggtcgagcaggaaatcggcggtcgcctgggtcagcacgttgatgttgtacggcgggcgcaccttgtcgaattcggtcagccatgcgggcgaaccgaccagatagccgaggcggatgcccgcgaggccgagcttcgacaccgtgcgcatcacgacgacgttgtcgaattcggcggcgcgcggcagccacgagcgcccggcgaacggctggtacgcctcgtcgatcacgatcaggctgtgccgcgcggcggcgacgatccgttcgatgtcggcatcgtcgtacagcgtgccggtcgggttgttcggataggcgagatagacgagcgccggacgatgctcggcgatcgccgcgagcatcgcgtcgacgtcgagcgtcaggtcggccttcagcggcacgccgacgaattcgagctgggcgagcttggcggacagttcgtacatcacgaagcccggcaccggcgcgagcaccttcgcgcccggcttcgcgcaggccaccgacatcatgctgatgatttcgtccgagccgttgccgagcagcacgtcgcaggcagccggcacgcccatcgcgtggcgcagcttgtcgatcagcgcggccgggcgcggcgccgggtagcggttcagcgcgacctgcgcgagacgctcgccgagcgccgcggcgagcggttcgggcagcgggtacgggttctccatcgcgtcgagcttcacgaatccgctcgcgtccggcaccggatagctcgtcatcgcgagcacgtcgcggcgaatgatgtcttgtggcgtcgtcatgatctcaagccggcgtgcgtcgcgccggcgtcaaatgatcggcaaggcggcggccgccgccctgcacaggtgtctccagccccggccttcggggtgcgggccgggcggcacattcgtgcctgccccggccccgcgctgcgtgcgctcagttcttcatccggaattcggcgctcttcgcgtgcgcctgcagcccctcgccgtacgcgagttcggacgcgatctcgccgagcgtctgcgcgccttcggcgctgacctcgatcaggctcgagcgcttgatgaagtcgtacacgccgagcggcgacgagaaacgcgcggtgcgcgacgtcggcagcacgtggttcgggcccgcgcagtagtcgccgaggctctcgctcgtgtagcggccgaggaagatcgcgcccgcatggcggatctgctggccccactgctgcggctccagcgcggaaatttccaggtgctcgggcgcgatgtcgttcgcgatccggcaggcttcggccatgtcgcgcaccttgatcagcgcgccgcggccttcgagcgacgcgcggatcacgtcctggcgcggcatcgacggcagcagctcgttgatcgccttctcgacgcgctcgaggaacgcaccgtccggacacagcaggatcgactgcgcgagctcgtcgtgttcggcctgcgaaaagagatccatcgcgacccagttcgggtcggtcgtgccgtcgcacagcacgaggatttccgacggcccggcgatcatgtcgatgccgaccgtgccgaacacgcggcgcttcgccgacgcgacgtacgcattgccggggccgcaaatcttgtcgacggccggcaccgtcgccgtgccgtacgcgagcgcgccgaccgcctgcgcgccgccgatcgtgaacacgcgatcgacgccgccgagcagcgccgcggcgagcacgaggtcgttcttcacgccgtccggcgtcggcacgaccatcacgatctcgccgacgcccgcgacgcgcgcgggaatcgcgttcatcagcaccgacgacggatacgccgccttgccgcccggcacgtacaggccgacgcggtcgagcggcgtgaccttctggccgagcaccgtgccgtcgctttccgtgtactgccagctatgcgtgccgcactcgatcttctgcttctcgtggtacgcgcgcacccgcgcagccgccgcttccagcgccgcgcgcgccttcggcgcgaggccgtcgagcgccgtctgcagcgcgtcctgcggcagctccagcgcggcgacgctgttcgcgctcagccggtcgaagcggttcgtgtactcgagcaccgcggcgtcgccgcgcgacttcacgtcggcgaggatctgcgcgaccgactgctcgatcgccgcgtcttcgcttgcctcgaatgcgagcagcgcgcgcagctcggcgccgaagccttcgctcgtcgaatcgagcttgcggatggtgatggacatgggagttccgttacggtgatgcgctcaaccgccattctgcgacgcgcgttcgaacgcgtcgaggatcggcttgagtgccgtgcgcttcaacttcagcgcagcctggttcacgacgaggcgcgacgagatcgccatgatctcctcgacctcgaccagattgttcgccttcagcgtgccgcccgagctgacgaggtcgacgatcgcgtcggccagccccaccagcggcgcgagctccatcgagccgtacagcttgatcaggtcgacgtgcacgcccttcgcggcaaagtgttcgcgcgccgtttcgacgtacttcgtcgcgacgcgcagccgcgcgccctggcgcacggcgctcgcgtaatcgaagccggccgatacggccaccgacatccggcagcgcgcaatgttcaggtcgatcggctggtacaggcccgagccgccgtgctcgaccagcacgtccttgccggccacgccgaaatcggccgcgccgtattcgacataggtcggcacgtcgctcgcgcgcacgatgatcacgcgcaggtccgggttcgtcgtcggcaggatcagcttgcgcgacgtttccggatcctccgtcacctgcacgccggcggcggcgagcagcggcagggtttcctcgaaaatccggcccttcgacaacgcaagggtcaacggcggggtcagcggcgcggtcatgcttggctcccggaaaggcggcgcacgttcgcgccgacggcggtcagtttggcttccatgcggtcgtagccgcggtccaggtgatagatgcggtcgacgagcgtttcgccgtcggcacgcagcccggcgatcacgaggctcgccgacgcacgcaggtcggtcgccatcacgttcgcgcccgacagcttctcgacgcccgtcacgagcgcggtgttgccgtcgatcgtgatgttcgcgccgagccggttcagctcctgcacgtgcatgaaacggttctcgaaaatggtttcgacgacctgcgcggtgcccgtcgcgaccgtattgagggccatgaactgcgcctgcatgtcggtcgggaacgccgggtattccgacgtgcggatcgtgaccgccgacggccggcggtccatcttcacgcgcagccagctgtcgccttcctcgatcgacacgccggcttcgcgcagcttgtcgatcaccgcgtcgaggatgtgcgggcgcacgcccgtcagcatcacgtcgccgcccgccgccgcgaccgcgcacaggaacgtgccggcctcgatgcgatcggggatcaccgaatggcgcgcgccgtgcagccgctcgacgccctggatcacgaggcgatcggtgccgatgccgtcgattttcgcgcccatcgcgaccagcaagtgtgcgagatcgctcacttccggctcgcgcgccgcgttttcgatcaccgtctcgccgtctgccagcgtcgcggccatcagcaggttctcggtgcccgtcaccgtgatcatgtcggtcacgatgcgcgcgcccttcaggcgcttcgcgcgggcttcgatgaaaccgtgctcgatgctgatctcggcgcccatcgcctgcaggcccttgatgtgctggtcgaccggacgcgcgccgatcgcgcagccgcccggcagcgacaccttcgcctcgccgaaacgcgcgagcagcggcccgagcacgaggatcgacgcgcgcatcgtcttgacgagctcgtacggcgccacgaggttgtcgacacgcgacgcgtcgagctgcacgcggcagccgtcgttctcgctcttcacgcccatctggttcagcaccttcagcgtggtgcgcacgtctttcaggttcggcacgttgtcgaggtcgaccggatcggcggtgagcagccccgcgcacaggatcggcagcgcggcattcttcgcgcccgacacgacgatctcgcccgacaggcggtggccgccttcgatcacgagcttgtccatcccatggccatgcgattccccgttggcggccgggtgtgccgtggcgacgctctggacggcgtcgcgctcgttgacggtgacttgcactcagtgagttccggttatgcgttctgccattcggcgggcgtcagcgtcttcatgctgagcgcgtgaatttcctgcttcatgcgatcgccgagcgccgcatagacgagctggtgccgctggatcggccgcttgccttcgaaggccgccgacacgatcgtcgcgaagaaatgctggccgtcgccttcgacttccagatgcgtgcaggcgagaccgccggcgatgtattgcttgacctgttcgggagtcggcaacatggtgtaaggctcctgtcggcgcgcgccgcctgcatggcggccgctgcctgtcgatatcaatgacgcagtttgtagccggtcgcgagcagccgcatcgcgatcagcgcgagcagcacgaagaaaccggtgacgatcgcgaggctcgcgaacgggttgatgtcggacgcgccgaagaacccgaaacggaagccgtcgatcatgtagaaaaacggattgagacgcgagatctcgcgccacacgggcggcagcgagtgcgtcgaatagaacacgccggacaggaacgtcagcggcatgatcaggaagttctggaacgcggcgagctggtcgaacttctcggcccagatcccggcgatcaggccgagcgtgccgaggatcgccgagccgagcagcgcgaacgcaatgatgaacagcggcgccgcgaaatgcatcgggataaaccagatcgtcacgacgaacacgcccgtgccgaccgcgaggccgcgcaccacggacgcgagcacgtacgcgccgaagatgtcgcggtacgacagcggcggcagcagcacgaacacgagattgccggtgatcttcgactggatcagcgacgacgagctgttcgcgaacgcgttctgcaacacgctcatcatcacgaggcccggtacgagaaaactcacgtactcgacgcccggatagacctcgacgcggcccgacagcgcgtggccgaagatcgtcaggtacagcagcgccgtcacgatcggcgcgagcaccgtctggaacgataccttccagaaacgcagcagttccttgtagaacagcgtttgaaaaccgctacccgacactcgcccgatagcgcccggctcaggagtttggagggaacggggcttcgcccccgagcgaacgcagttcgcgtggggttgttgattcatgccagtccctcgatcacctcggccccgttcatcacctggacgaacacgtcttcgaggtcggccttgcggacctcgatctcgtcgaacgtgcagcccgccgcgcggcattgcgcgaggatccgctcgacatcgtcgtagctcgacaggcgcagcaggtgctcgcccggcgcgcgcgcggcggatcggtctccagcccgcgcagctcggcgggcagcgcgcccgttgccagccgcaggtacagctgcagccccgcgaagcggcgcagcagcgcgtccgtgcggtcgagcgcgacgacttcgccacggcgcagcatcgcgatgcggtcgcacagcgactcggcttcctcgaggtagtgggtggtcagcacgatcgtgtgaccttcgcggttcaggcgcgagatgaatttccacagcgtctggcgcaattcgacgtcgacgccggcggtcggctcgtcgagcacgatcacgggcggccggtgcacgagcgcctgcgcgaccagcacgcggcgcttcatcccgccggacagcgcgcgcatgttcgcgtcggctttctcggtgaggtcgagattggccatcacttcgtcgatccagtcgtcgttacggcgcagcccgaaatagccggactggatccgcagcgtctcgcggacggtgaagaacgggtcgaacacgagttcctgcggcacgacaccgagcgcgcggcgcgcgccacggaagtccttgacgacgtcgtgaccgcgcaccgagatactgccttcgtcggcccgggcgagcccggcgaggatactgatgagcgtggtcttgcctgcgccgttggggccgagcagaccgaaaaactcgccttcctcgaccgacaggctgacgcccttgagcgcctgaagcgatttgtagcgcttcttgacgtgacggatttctatggctgacatgactgtgcgcggcgcaagggccgcgacgcctattctgtgcttgctgcgaatgaaaatgggggccggacgccgattggctgccccgcaaaacgcttgattatagggcaaaccggctggtggagccggtgccggaggcacgcggcctgaagcgtgcgcgcgccggctggcgcggcaggctccggtcggacagggtcaatgtcgcccggtgccttcgatgagcgcgtcgacgccgtaggcgcgcgcgaggctggcgagcttcggggagattgaggatgtcgagggtcgcgccgcgcgccttggcggcacgttgccatgcgagcagcacggcgagcgcggacgagtcgaactgcgtcagcgccgcgcaatcgacggcggtcgcgcccgcgccgatgcgcgcaagaccgtccgcgagcgcggacttcgcgctcgcgacggtcagcgaggagccggcttcgaagccgctcacgacgcttgcttgccggcggcaagttgctggttgcgctgcgtgaggaactggatcagcccttccacgccgctttgctggatcttctcgttgaactgctgctggtacgtctggatcagccatgcgccgagcacgttcaggtcatacaccttccagccgttcgacgtcttgtacaggcggtagtcgatctggaccggctggccgttgttcatcgcgaccgtcttgaccacgacatcggtatcggccggatcggcgcggaacggcgggtactggatctgctggtccggcttcagttgcgccagcgcgcccgaatacgtgcggatcagcagcagcttgaactgctcctgaacctgctgctgctgttcggccgtcgccgcgcgccagttgcggcccatcgcgagctgcgtggtgcggcggaaatcggtgtacggcaggatgtccttgttgacgatcgtgatgatgcggttggtgtcgccctgcttgatcgtctgctgcttgacttcgtcgagcacctgctgcgtcgccgtcttgatcagcgcctgcgggttcgactggtcgacttgcgcgtgggctgcgctgccgaacgagaacagcgccgcgaaaacggggatcaggaacagtttttcatcatagtgacctgcatgaatatgtcgatgcgaaggttggagcaggtagcttacgcgcaagttcgcgcacgctaccgactgaatcgtttctggctgtaacgaatgtaaatccgtcagtgcagacgaatgctcgggaagcggaacccacccggcgacggcggcgccacctgcatcggcggcacgttcgtttcgctggccgggttcggcgattcggccgtgcccgaggccggtgcggccaccgccgcgcccgatgcgcctgccggcgccgtcgcgccgcccaccgctgccgcgcccgccgtaccggccgcgccggctgccgccggtgccgcgccgtcttccggcaagtcgtacttcggcagcgcgtcgttgctcgacgtcgcggccgcctcgccgcgcgcgttgctgatcagcatctggcgacgctgcaggtacgcgttacgcacgaacgaatacttgtcgagcgccgcggcatccagcacgtcgcccgcgccgagcaggttcgcgcgcgtgttgacgaggttcacgccgaacaggccccagctcaggccatccggcttcacgtaggtgagcggattgccgacgtagtcgacgcccaggccggccgtgtcgcgcagcgtgctcgggccgagcagcggcagcaccagatacgggcccgacggcatgccgtagcggcccatcgtgatcccgaagtcggccgtgtgcttcggcagcttcgcgatcgtcgcgacgtcgaacaggccgccgacgccgaacaccgtgttgatcacgacacgcatgatgtcgccgacgccgtccgcgatccgcagctgcacgatgttgttcgccgcgatgtagacgtcgccgatgttcgagaagaagttcgtcacgctgtcgcgcaccggctgcggcaccacgtactggtaccccttcgcgaccggcttcagcgcatacgtatcgaccgtgtcgttgaacttgtacatcgtccggttgaagccttcgagcggatcgcccttggtcggcgtctgcacggtcgcgcagccgctcaacgcggcgactgccgctaccgccagcgcggcgtgcctgatgcggatcgtctgcatggtcattaccctcttctattctctcgtgtggttattgggccgcggaaccggacaccgccgacgccggcaccgccaccggtgcaggcgcggccggcgcgccggctgccggcttcgcaccgcccgcatcggcggccttgctgtaaaggaactggccgatcaggttctcgagcacgatcgccgattgcgtcatcgtgatcgtatcgcccgacttcagcatttcggtgtcaccgcccggatcgaggccgatatattgctcgccgagcaggcccgacgtcaggatcttcgccgacgaatccttcgggaactgatactggccgtcgacatcgatcgtgacaagcgcctggtacgtgttcgtgtcgaaaccgatcgccttcacgcggccgaccacgacgcccgcgctcttcacggccgcgcgcggcttcagcccgccgatattgtcgaatttcatcttcaccgagtaggtcggctgaaacgaaaacgagctcatgttgccgaccttcagcgccaggaacagcaccgcaaggaagcccaccaccacgaacaggccgacccagaagtcgagagcagtctttttcatcgtcatcccaaaatttggcttggctgaggcttagctgaacatcagcgcggtcagcaggaaatcgaggccgagtacggcgagcgacgcgaacacgaccgtcttggtcgtcgcgcgcgacacgccctcgggcgtgggcttcgcttcatacccttgaaacagtgcaatgaaggtcacggcgaacccgaacacgatgctcttgatcacgccgttgccgacgtcggcccagacctggaccccgccctgcatctgcgaccagaacgcacccggatcgacgccgatcagcacgacaccgacgaagtacccgccgagcacgccgaccgcgttgaagatcgcggccaggagcggcatcgcgatgatgcccgcccacaggcgcggcgcgatcacgttcttgatcgggtccaccgccatcatctcgagcgcggtgagctgctcgccggctttcatcagaccgatctcggccgtgagcgacgtgcccgcgcggcccgcgaacagcagcgcggtgacgaccggcccgagctcgcgcacgagcgacagcgcgaccagcaggccgagcgcctgctcggaaccgtagcggttcagcgtgtagtaccctgcaggccgagcacgaagccgacgaatagccccgacacggcgatgatcacgaacgaatagttgccgaggaaatggatctgcttcgtgaccagccgaggccggcgcagcagcgggaagaattccagcacgaggcgcacgaacagccgcgtgccgtagcccgcgcgctcgaggccgccgatgacataacgtccgatcgcgctgatcatgcgcgccctccgccgagcccgaaatccgccgccagcggcgggctcgtgtaatgaaatttgaacgggccgtccggcgcgccgtcgatgaactgccgcacgctcggatcggtcgacgcgcgcagctcgtcgggcgtcccctgcgcgagcacgccgccgttggccaggaaatacacgtagtcggcgatcgcgaacgattccggcacgtcgtgcgtgacgaggatcgacgtggcgcccagcgcctcgttcagcgtgcggatcaggttcgcggtgatgccgagcgagatcggatcgaggccggcgaacggctcgtcgtacatgatgagctgcggatcgagcgcgatcgcgcgtgccagcgcgatgcggcgcgccatcccgcccgacacctcggacggcatcaggtcgcgcgcgccgcgcagcccgaccgcgttgagcttcatcagcacgaggtcgcggatcaggtcttcgggcaggtcggtatgctcgcgcagcgcgaacgcgacgttctcgaacaccgacatgtcggtgaacaacgcgccgaactggaacagcatgcccatcttgcggcgcagcgcatacaggccgtcgcgcgtttgcgcgccgacatcggcgccgtcgaacagcacctggcctcggcgcgcgcgcacgaggccgccgatcaggcgcagcacggtcgtcttgccgcaacccgacccgcccatgaccgcgacgacctgcccacgcccgaagcgcaggttcaggttggacaggacgaggcggtcgccgtagccaaagtcgacgtcgcgaagttccagcagggtctcggtaggagtggggctcacggagctgacagtccttttacgcagaacgccgaattatagggcctgcattggaatgatgtcgtgacgccgttccgggccctgcggtcaatgattgtcaaattgtccgggaaaacattgctgcaacgcaacaacggcagcccgatagtcggccgcgcccgtcaccgcactgaccaccgcgacactgccgacacccgtcgccagcacggccggcagcgcgtcgagccccaccccgccgatcgcgacgagcggcacccgcgcccccgcgaagcgcgcatagcgggcaatccgcgccaggccctgcggcggcgcggcgacggccttggtcgcggtcgcatacacggggccgagcgcgaggtagctcgggcgctcgtgcaatgcccgcaacatttcgtaataaccgtggctcgaaagtccgagccgcaggcccgcgcgcgcaatcgcggccagatcggccgtttcgaggtcttcctggcccagatgaacgccgtacgcccctcttccacggcgatctgccagtgatcgttgatgaacacgcgcgcatcgggatggcggcgcccggccgcgaccgcgcgtgcgatttcccgccgcaacgtgtccggcgtcgcgcctttcacgcgcagttgcacggtccgcacaccgcaatcgagcacgcgctcgacccattcggcgtccggcacgaccggatagaggccgagctgcgcggggcacggcgcgaacgcgggttccggcgcggccggcagcccggcgacacgcgggaaccgcgcggcgtcgaccggccacgcatcggcggcgcgcgtttcgtcgccgtcgcgccaggccagcgccagcaccagcgcgtcgaccggcgcaaagccgcagtcgaggaacgcggcgagcgcggcaatccagtcgtccgcgagcggatgcgcggcgtcgagcgcgtagcgcgcgcccgccgtgtgcagtaccgcgccctgctcgtcgaattcgatcgcgaccgcgcccggcgccgcgggccgcgacgcggccgacgcgcgtgcctgcgcggcgcggtcgccggccgatacgatcagcacgtcgccgtcggccggcgcgtcgggcaccgcgacgcaaagccgccacggcgcggcggcgtccggccagtcgcccagccgggcgcgaatccgttcggccgcttcggccagttcgtcggccggcggccagaatgcatcggcgaaacgcacgctcatgcgccgcccccgtcctggtgccagaacggcatcccgacgaccggcgtgctggcgtgcgcggtctcgcgcgcgtccatcggcccggcgagatacgcggcacggccggcctcgacgccctgcgcgaacgcacgcgccatgatctccgggtgcgtggcctgcgacacggccgtgttcagcaacacgccgtcgaagccccattccatcacctggcacgcgtgcgacggcacgccgagcccggcgtcgacgatcagcggcacgtccggcaggcgctcgcgcagcacgcgcagcccgtacgggttcacgacgcccttgccggtgccgatcggcgcgccccacggcatcagcgcctcgcagccggcgtcgagcaggcgccggccgatcacgagatcctcggtgcagtacggcagcaccttgaaaccgtccttgaccagttgcgcggccgcctcgatcaggccgaccgggtcgggctgcagcgtgtagtcgtcgccgatcagctcgagcttgatccagtcggtgccgaagacctcgcgcgccatgtgcgcggtcgtcacggcttccgcgacggtctggcagccggccgtgttcggcaagagcggcaccgcgtgacgcttgagcaggtcgaagaagccggcttcggccgtgccgcccgtcatctggcggcgcagcgcgaccgtcaccatcccgggcgcgacgcggcgatcgaatcggacagcgactgcagcgacggatagcgcgacgtgccgatcagcacgcggcttgcgaaggtttcgccgtacagcgtcagcgcgtcggcggaggtgaggacgtcatgtcgttttcctgaaagagcggggacgaaccggcggcgctcagccgcccgcgaccgggtgcacgacgtcgagcttgtcgcccgccgcgagtgcgcgcgccgcatgctgcgtgcgcgcgacgaagttgccgttcagcgcgaccgcgtacggcggacgcgcaccgtacgcagcgagcgcgtcggccaccgttgcgccgtcgggcaacgtcaggttctgttggttgatctggatgtccatgaggcttcgtcgaattcggtcggcggtgcgcgtcaggccggctggcgcgcgtcgttgcggtgatgaaggagcgtcggccagcgctcggcgccgcgccacgcggcgaacgcgtcgggatcgccgaacgcgccgccgagcgcggcttcggcaagcgcgacggccgcgtgcgcgacttccggcgcgatcatgaagccgtgccggtacaggccgttgacggcgagcgtcgacgcaccatcccagatcaccgccgggcgatgatcgggcagcgtcggccggcactgcgcattgagttcgaggatgcgcgcctcgccgaacgccggatgcacggagaacgccgcgctcagcagttcgagcgcggagcgcacgctgacgggcgacatgtcctcgccctccacctcggtcgcgccgatcacgtagagatcgtcctgcttcggtgcgatatagagcgggtagcgcggatgcagcagccgcacgggccgggtgagcccgatgccggggcgcgcacgcgcgcgacttcgccgcggatgccgcgcaacgcgggcagcgcgggtttcgcgccgagcccgcggcaatcgatcgtgaaatgcgcggcgggcaggttcgcatcgtcgatcgtgacgtgccagtgcaggtcgacgccgcgctcggcgaggccggccgcgagggcgcgcagcgcctggcgattgtcgagctggccttcgttcggcagcagcaggccgcgcgcgaaacgacccgcgagcaccggctcggccgcgtcgacctgcgcgccggcgagggtcacgaaaccgctgtcgaacaggccggccggcgcgttcgcgcgcacgcgccgctcgaacagcggcgcctccgcgcgatccgcgtgatgccagacgacgagcgtgccgtgatgctggaagaagacgggttcgggcagttccgcgagccactgcggccagcgcgcgagcgacgcggcgccgagctcggtgatcagcagctccgcgctcgccgcttccgcgagcggtgcgagcatggcggccgcgatccacgcggccgactgctcgccgtccgggccgccgcgctcgtaaagcgcgacgcgatggccgtcacctgcgagccgccatgcgatcagacggccgacgaggccgccgccgagcaccgcgaaatcggggcgggtgtcccggacgttcattgcgccccctccgcacgggcgcgctcgacgaacgtcgacgcgcacgcgccgccgcatgcgaacgcacgcgacatcgggccgggaaccatgcaaaagactgaagattgtgcggtcatcattccttccgtaacgcgcaatgcgcgtacccaaaggacgaaaccggcagcaaaggccggccgggcgggactcgggcgctgaccatgtgggatggcagccagcgcgacccggcgggatcagaaacttccctcgccggtattacccggatcgggtgcgaagggtctttctcagcctcattgcgctgcccggaacatccgccggccgcgctacaaagcacccctgtttcgtcgtcggccattagaccataaaagcggaaagcgccgcaaactgtccccttgcggcaaattcgccgtcgtgccgcgccgctctggcacaatgcccgcaggtcggccgcgcgagcggccggttgccgcgtcaccgccggccttaagtgccgtttaagacacgcgggcgaccatccggacgcccgccgtcagtcggcgccgcgtcccggcatgccgtatcgcggcgcgcgcccggcttcgcccggcccgcgcgccggctactcatcaggaagcacatgacccaatcgatcgatcccgtccgctccgcctccgacgcgccgcaggacgagcgcccggtatccgcatggagcctcatcaagccctactgggtatcgtccgaatggaaaatcgcatggggcctgctggtcgcgatcatcgcgatcaacctctgcgtggtctggatcaacgtccggctcaacaagtggaacgcggagttctacaacgcgctgcagtcgaaggacgtccacgacttcccgaacctgctgatgcagttctccgcgctcgcgttcgcgttcatcatcctcgccgtgtacggccgctacctgcggcagatgctcggcttccgctggcgccagtggctcaccgaccgttttctcggccagtggctcggcgatcgcgcgttctaccggatcgaacgtgaccgtctcgccgacaaccccgaccagcggatcaccgacgaccttcagtcgttctcgacgaccacgctcgcactgtcgctcgacctgctgtcgacggtcgtcacgctcgtgtcgttcatcacgatcctgtggtcgctcgccggcgcgctgacgttctcgctcggcgcgacgccgatcacgatccccggctacatggtgtgggcggcggcgctgtacgcggtggtcggctcgctgatcatccagaaggtcggccacccgctcgtgtcgatcaactaccagcagcagcgcgtcgaggccgacttccgcttcgggctgatccgcgtgcgcgagaacgccgagcagatcgcgttctacgacggcgagaagaccgagaccggcaacgcgcaaaacctcttcatgcgcatccgcgacaactggtggcgcgtgatgaagtacacgaagcggctcacgttcgtgctgagcttctacgggcagatcgcgatcatcttcccgctcgtcgtcgccgcgccgcgctatttcgcgggcgcgttctcgttcggcgtgctgatgcagatctcgtccgcgttcggcaccgtcagcgattcgttctcgtggttcatcaacagttactcgaccctcgtcgaatggcgcgccaccgtcaaccgtctgcgcgaattcaagcgcgtgatgggcacgtcgcacctgaaggaaagcctctcgcccgcgaccgagcacggcggcatcaacctgcattacgtcgacggcgcgaagctgtcgacgtcgtcgctcaagctcgcgctgccgaacggcaacgcgctcgcgaacatcggcagcgtcacgatcgagcccggctcgcgctggctcgtgatcggcaagtcgggttccggcaagagcacgttcatgcgcgcgctcgcggggctctggccgttcggcgacggcgcgatcgatgcgccggtcggcgcgcggatgatgttcgtgccgcaaacgagctatctgccgatcggcacgctgaaggccgcgctcacctatccggcgaccgccgacgcgttcagcgacgaagcctgccgcgacgcgctgcgcgcatgccgcctcgaggattatgccgagcgcctcgacgagaccgcgcactggacccgcgtgctgtcgccgggcgaacagcagcgccttgccggcgcgcgcgtgctgctgcacaagcccgacttcctgttcctcgacgaagcgacgagcgcgctcgacgccgacaacgaggcgcgcctgtaccacctgttcgccgaacggctgccgaaggccgcgatcgtcagcatcgcgcaccgcgagtcgctggccgcgttccacgccggcacgatcaacgtcgagcgcgtgaacgacagcgacaaggtcgcggcgtgaagccacgcgccgcgcacgtcgcccggatcgcgctgatcaccggcgccggttcggggatcggcgcggcgctcgcgcggcggctcgcggcgcccggcatcgcgctggcgctgcacgcacgcggcgcggacgaagcggcacgcgcgcggctcgccgaagtcgcccgcgcgtgcacggcggccggcgcggagtgcgtcacgctcaccggcgatctcggcgagccaggcgtggccgcctcgctcgtcgatgccgccgccacgcgcttcggcgggctcgatcatctcgtcgccaacgccggcttcgccgcgcggcaatccttttccggtctttccacgaacgcgctcgcgtccgcgttcgccgcgatgcccggcgcgttctccgcgctcgcgggcgcgcgcggccgctgctcgaggcgtcggccgcgccgcggatcgtcgcggtcagttcgttcgtcgcgcaccgctaccgcgccgacgcgccgttcgcggccaccgctgccgcgaaggccgcgctcgaatcgctcgtgcgcaccgccgccgccgaattcgccgcgcgcggcatcaccgtcaacgcagtcgcgccgggcttcacgcgcaaggaccacgggccgagcgccggcaacgccgacgcgtgggcgcaggccgaacaggcgacaccgctcggccggatcgccgaacccgacgacgtcgccgcgctgatcgcgttcctgctgtcggatgcggcgcgacagatcaccgggcagatcgtccacatcgacggcggcctgacgctctgaatcgagcggccgtacgtcgtgcggacgcgcgggacgtcgctgccaccgacgttggcgtggcacgcgagcgcgatcggcactcgcacgttcccggaacacccgccccgttccacgccgccctcccaccctcgccgcccgccgcgccatcgcgccctcgctcccgtctttttggcgccccgctccccgcccgtaaaataaccgccacgcggcagcgcgagacaggacgagacaacaggggacggcaagcatgcaggcattccagtggttcgacgagctgtcgacacgcgaacgcaggacgctgtatgccggattcggcggctacgcggtcgatgcgttcgacttcatgatctattcgttcctgattccgacgctgatcgcagcctggggcatgacgaagagcgaggccgggatgatcgcgacgagctcgctgatctcgtcggcgctcggcggctgggtcgccggcatcctcgccgaccgctacggccgcgtgcgcgtgctgcagtggacgatcgcgacgttcgcgctgttcacgtgcctgtccggcttcacccactcgttctggcaactgctcgcgacacgcacgctgcagggcttcggcttcggcggcgaatggtcggtcgtgacgatcatgatggccgagacgatccgctcgcccgaacaccgcgcgaaggccgtcggcaccgtgcagagtagctggtcgttcggctggggcgcggccgcgatcctctactgggcgttcttcgcgctgctgcccgagcaggtcgcatggcgcgcaggcttctggatcggcatcgcgcccgcgctgtggatcctgtacatccgccgcaacgtcagcgatccggacatctacacggccacccgccgcgcgcgcgacgaaggccgcgtgtcgggccacttcctcgagatcttctcgccgccgcacctgcgcgcgacgctgttcggcagcgcgctgtgcaccgggatgctgggcggctactacgcgatcacgacgtggctgcccacctacctgaaaaccgtccgccacctgtcggtgttcaatacgagcggctatctcgtcgtgctgatcgtcggctcgttcgtgggctacgtggtcggcgcgatcctgtccgaccgcctcggtcgccgcgcgtcgttcatcctgttcgcaatcggctcgttctcgctcggcatggcgtacacgatgctgccgatcaccgacaccgcgatgctgctgctcggcttcccgctcgggatcgtcgtgcaagggatcttcgcgggcgtcggcgcgtacctgtcggagctgtatcccggtgcgatccgcggctcgggccagggtttctgctacaacctcgggcgcgggctcggctcgttcttcccgatcctcgtcggctcgctgtcgcagtcgatgtcgctcgtgaaggcgatcggcctcgtcgcgggcggcggctatctgctcgtgatcgtcgccgcgctcgtcctgccggaaacgcgcggcaagtcgctcgtcgacgatccggccgtcgcgtcctgagcaaccgccacgttcaggaaaccgcatgcacgtgatcgttctcggcgccggcgtgatcggcgtcaccactgcctggcacctgcgcgaagccggttgcgaggtcaccgtgatcgaacgcgaggccgatgtcgcgcaggcgacgagcctcggcaacgcgggcgtgatcgcgcccggctacgtgacgccgtgggccgccccgggatgcccggcaagatcctcaagtacctgttcgagcccgcgtcgccgctgatcttccggccgacgctcgaagccgcgcagtggcgctggatcgcgcgctggctgcgcgaatgcgaattcgagcggtttcgtgtgaacaagcagcggatgcagcgcatcgcctattacagccgcgcatgcctgcacgcgtttcgcgaccggcatccgttcgactacggcgcgagccggggctacctccagctgctgcgcggcgcgttcgacgtgcagatggtgcagcccgcgctgaaggtgctgcgcgacgccggcatcgcgtttcgcgagctcgatgcggccggctgcacggcgatcgagccgggactgcgctgggcgcggcaggcgcccgtcggcggcatctacctgcccgacgacgaagcgggcgactgcgcgcgctttacgcgtgaactgcgggcgctgtgcgaagcaaacggcgtgacgttccgctttcacacggacgtgcaggcgctcgacgttgaagcgggccgggtgcgcggcgtgcggatcgtcggtaacggcaacgaggatggcgatacgccggatcgcgcgcgagcgcatccgcacgcatcgaacgccggcggcaagcaacgcgacgcgcggctcgccgccgacgcgatcgtcgtcgcgctcggcgtcgacagcgccgcactgctgcggccgcacggcatcgacgtgccgctctatccggtgaagggatactcggcgacgctctccgtcgtcgacgacgaaaagcgccgcacgccgcgctgatggacgaatcgctgaagacggcgatcacgcgcttcggcccgacgttgcgcgtcgcgggtacggcggaactcggcaaccggcacgcagcgctgcgccggcaggcgctcgatacgctgatgaaggtgctcgacgactggttcccgcacgcggccgatcgcgcatcggcgcgcttctgggtcggccgccggccgatgacgcccgacgggccgccgctgctcggcgcgagcgggatcgacgggctctggctcaacgtcggccacggctcgacgggctgggcgatgtcgatggggtcggggaaggtggtggcggatctcgtcacgggcgggaaccggagatcgacttgtcgggcctgacgctcgcgcgctacggccggtagggccggtagggccggtggcgcggcggcgcggcggcgcggcggcgcggcggcgcggcggcccggtggcccggtggcccggtggcccggtggcccggtggcccggctggccggacgatatcgccgacgcgatacacatcgcgtccggcaatcacaccgcggcgcgcaagccgctcactgcggcgccggaccgtccgcctcaccgtccgcccatgcgatcggcgcggacgcgaccggccgatgcgacacgccctcgtgcgacagccggctttcgaacaacgtcagcgcttcgacacgcaccgcgaccgcccgcccgggcgcaccgccgtgcgcgggctggccgaccgcatcgcgcggcagccgcgcgagcgtcacgtgcggccggaacggccgccggtcggccggcacgccgagttcgcccagcagcgcgaccagcccggcattcagcgccaggcaggccggatcggccgcgagttccgcgacgatcagcctcgcgcgcggcaggctcggccaccacgcgatccgctcgaccggcagcaacggcagcgcatgggcggccgcaagcgcgggcagatgcgcggccagcgcctcgcatcggtcccgttcgatcgcgccgatgaacgcgagcgtcatgtgcagttgcgcggactgcgtgcgccgcgctccgcgggtgaccggcaacgcgtgcagcgcgtcgcgcgaggccgcatcgggcatcagcgcgacgaacgcacggagccggtcgccgttcatgactcgctcaccgcggcacgcggggcgcgtgccgtttgagccgaagcgggacgctgcggcagcgggccgtgctcgccccacacgtcggccggcagcacacgcgcgagctcggggatcgtgttgcgcgtgaacaccggatcggcgatgcccgccgcgcgctggcgacgatagtcggcccatgcggcgtgcgcatgcttgccgagcgcgaggatcgcgatcaggttgatgatcgccatcagccccatgctcgtatcggccatggcccagacgagcggcagttgcccgacgctgccgaacatcaccatgccgagcaccgcgacacggaacagcggcagcacgccgcgccgcttcgtgatgaattcgacgttgccctccgcatacgcgtagttgccgatcaccgacgaaaacgcgaggaagaagatcgcgacggccatgtagatgccgccccagtcgccgacgtggctcgagatcgcgcgctgcgtgagcgccgcgccttccatccccgtgccgacttcgtactggcccgacagcaggatcacgaacgcggtcgcgctgcagatcacgatcgtgtcgacgaacacgccgagcatctggatcagcccctgcgtgacggggtgccgcgtgctcgcggtcgcggccgcgttcggcgcgctgcccatccccgcttcgttcgagaacagcccgcgcttcacaccgatcgcgattgcctggctgaccgcgtagccggtcaggccgcctgccgcctgctcgagaccgaatgcgctcctcacgatcagcgcgatcacgtccggcacgagcgcgatgtgcgtcgcgaccgcatagaccgcgagcgcgagatagccgatcgccatcagcggcacgatcacctgcgcgaccgtcgcgatgcggcggatgccgccgaagatgatcggcgcggacagcagcacgaggccgaggccgaccgtctcgcggctccagccgaacgacgtatggaatgcgtcggcgatcgcgttcgcctgcaccgcgttgaacacgaaaccgaacgcgaggatcagcgacagcgagaacagcacgccgaagccgcgcgagcgcaggcccgtctggatgtagtacgcggggccgccgcgataactgccgtccgcgtgcgacaccttgaagatctgcgcgagcgtcgcctcgacgaacgcggacgacatcccgaccagcgccgtcatccacatccagaagatcgcgcccggcccgccgaccgtcagcgcgaccgcgacgcccgcgatgttgccggtgccgacacggctcgcgagcccggtcgcgaacgcctggaacgacgagatgctgcccggctcgcccttgctgccaaccagtttcatgctgaggaacagcgccttcagctggatcatccggaaccgcaacgtgaaccacgcaccggcgccgagcagcagcgcgatcagcacgtagttccacaacacgccgttgacggcgtcgatcagcccatgcaggagtgcttccatccggtttccttgtaaatagggtcagtcatgagcatcgaccgcgaacgcggcccgaggggcgacatgatatgacagtttcaagaaatattacaaaacgaaaggatttgggatgacgagaaatcgcatccggatgtcatcaggttagacgacgcttcgcgaaaatgatgcgtgtcggcacggcaaggcagcccgatcggacggcgtcgtctcgcacgcgaaaccggcgcgccccggctggcgccggccataaaaaccgggcgccctttcggacgcccggctttcgtcgaaacccgctcgcgatattcagctcagcgcggcaggttcgaatgccccatcaggtacgcatcgaccgagcgcgcgcactggcggccttcgcggatcgcccacaccacgagcgactggccgcgacgcatgtcgcccgcggcgaacaccttgtcgaccgacgtgtagtacgagcgatcgccttcggtcgccgcacgcgcgttgccgcgcgcgtccttcgcgacgccgaacgcttcgagcaccggcgccgccggctgcgtgaagcccatcgcgagcaggacgagatcggccttcagttcgaactcggagcccggcacttcctgcatcttgccgtccttccactcgacgcgcgcggcgatcagcttctcgaccttgccgttcttgccttcgagacgcttcgtcgcgaccgcccagtcgcgctcgcagccttcctcgtgcgacgacgacgtgcgcagcttgatcggccagtacggccacacgagcggcttgttctcctcttccggcggctgcggcagcagctcgaactgcgtgacctgcttcgcgccgtgacggttcgacgtgccgacgcagtcggaacccgtatcaccgccgccgatcacgatcacgtgcttgcccttcgcgagcagctggtcggcgagcttgtcgcccgcgttcacgcggttctgctgcggcaggaagtccatcgcgtaatgcacgccggcgagctcgcggcccggcaccggcaggtcgcgcggcgtttccgaaccgcccgcgatcacgaccgcgtcgaattcttccttcagcgtgtccggagaaatggtttccttcgcgagactgccgatcgactcgggcagcggatccttgccgatgaacacgctggtgcggaacgtcacgccttccgcttccatctggcgcatgcggcggtcgatcagccacttctcgagcttgaagtcggggatcccgtaacgcagcaggccgccgacacgatcgttcttctcgaacaccgtcacgtcgtggcccgcgcgcgcgagctgctgcgcggcggcgaggcccgcggggcccgaaccgacgaccgcaaccttcttgcccgtcttgtgctcggccggcagcggcttcacccagccttccgcccaggccttgtcgatgatcgcgtgctcgatcgacttgatgccgaccgggtcgttgttgatcccgagcgtgcacgctgcctcgcacggcgccgggcagatgcggcccgtgaactccgggaagttgttggtcgagtgcaggacttcgatcgcctgctgccagtcctggcggtaaacgagatcgttgaaatccggaatgatgttgttgaccgggcagccgttgttgcagaacgggatgccgcaatccatgcagcgcgcgccctggaccttcgcgtccgcgtcggtcagtgccgcgacgaattccttgtagtgcttcacgcgcgtgagcggtgcttcgtacgcctcgtggcggcgttcgaactccagaaaaccggttgccttgcccataaggtgctcttctgttcggtgtatcgggtggggagccgcgcgcggccgtcaggcgcgcgcggcattcgctatgtcgttcgtcgctcaggcggccagttcttccttcgccgccttcttcgcaccgatctcgcccagcgcgcgcttgtattcgtgcgggaacaccttcacgaactggcggcgcgccgcgtcccagttttccagcagcgacttcgcgcgcggcgaacccgtgaactggaaatgacgctcgacgagccccttgagcagcgcttcgtccgtcgtgcctgcgtgccagagtgcgcggtcgaccgtgcgctcctgctcggcctgctgcagcaccggctcgagcgcgaccatcgacttgttgcacttcgccgcgaacgtgccttccggatcgtagatgtacgcgagaccgcccgacatgccggccgcgaagttgcgcccggtctcgccgagcacgacgaccgtaccgcccgtcatgtattcgcagccgtggtcgcccgtgccttcgacgaccgccgtcgcgcccgagttgcgcacgcagaagcgctcgcccgcgacgccgcggaagaacgattcgccttcgatcgcgccgtacatcaccgtgttgccgcagatgatgttttcctcggacttgccgcggaagtcgttggtcggacggatgatgatccggccgcccgacaggcccttgccgacgtagtcgttgccgtcgccgacgaggtcgagcgtcacgcccttcgcgaggaacgcgccgaagctctggccggccgtgcccttcagctggatatgcaccgcgtcgtcggccaggccttcgtggccgtgcttcttcgcgatcacgcccgacagcatcgcgccgaccgtgcggttcacgttgcgcaccggctggatgaacgacacgtgctcgccgttctcgatcgccgccttcgccttctcgatcagcacgtgatcgagtgcacgctcgaggccgtgatcctgcacgtcgacgtgacgcggtgcgacgtcctcgcactcttccggctggtagaacacgcgcgagaagtcgaggcccttcgccttccagtgctcgatgcccttgcgggtgtcgagcaggtcggcacggccgatcaggtcgtcgaacttcgcgacgccgagctgcgccatgatctcgcgcacttcctcggcgacgaagaagaagtagttcacgacgtgctcgggctggcccttgaacttcgcacgcagcaccggatcctgcgtcgcgacgccgaccgggcacgtgttcaggtggcacttgcgcatcatgatgcagccttcgacgacgagcggtgccgtcgcgaagccgaattcgtccgcgccgagcagcgcgccgatcacgacgtcgcggcccgtcttcatctggccgtcggcctgcacgcggatccggccgcgcaggcggttcagcaccagtgtctgctgcgtttcggccaggccgagttcccacggcgtgcccgcatgcttgaccgacgacagcggcgacgcacccgtgccgccgtcatggccggcgatcacgacgtgatcggccttcgccttcgcgacaccggccgcgaccgtgcccacgcccacttccgacacgagcttcaccgagatgctcgagctcgggttcacgttcttcaggtcgtggatcagctgcgccagatcctcgatcgagtagatgtcgtggtgcggcggcggcgagatcaggccgacgcccggcaccgagtaacgcagcttgccgatgtactcggacaccttgtggcccggcagctggccgccttcgcccggcttcgcgccctgcgccatcttgatctggatctggtcggccgatgccaggtactcggcggtgacgccgaagcggcccgacgcgacctgcttgatcttcgagcgcagcgaatcgccgtccttcagcggaatgtcgctgacgatctcgtcgccgatcaccgacttcagcgtctcgcccgacttgatcggaatgccgcgcagctcgttgcggtaacgcttctcgtcctcgccgccttcgccggtgttcgacttgccgccgatccggttcatcgcgatcgcgagcgtcgcgtgcgcttcggtgctgatcgaaccgagcgacatcgcgcccgtcgcaaagcgcttgacgatgtccttcgccggctcgacgtcgtcgatcggaatcgccttggtcggctcgaccttgaactcgaacaggccgcggaacgtcatgtgacgcttggtctggtcgttgatcaggtgcgcgtattccttgtacgtctggtacgagttgctgcgcgtcgcgtgctggagcttcgcgatcgaatccggcgtccacatgtggtcttcgccgcgcacgcggtacgcgtactcgccgcccgcgtcgagcatgtcgcgcaggaccgggttgtcgccgaatgcgtcgcggtgcaggcggatcgcttcttccgcgacttcgaacaggccgatgccgccgaccttcgacgccgtgcccttgaagtacttctcgacgaggtcgctcgacaggccgagcgcttcgaagatctgcgcgcccgtgtacgacatgtacgtcgagatgcccatcttcgacatcaccttctgcaggcccttgccgaccgccttcgtgaagttgtagacggccttctccggcgacaggtcgcccggcaggccttcggccatcttcgcgagcgtttccatcgcgaggtacgggtgcacggcttccgcgccgtagcccgcgagcagcgcgaagtggtgcgtctcacgtgcggagcccgtctcgacgacgaggcccgtgctcgtgcgcagcccttgctggacgaggtgcgtgtggatcgccgacgtggcgagcagcgccgggatcgcgacatgctcggcgtccgtcttgcggtcggacacgatcagcatgttgtagcccgacttcaccgcgtcgacggcttccgcgcacagcgacgcgagacgcgcctcgatgccttccttgccccaggcgacgggatagcagatgttcagttcgtacgcgctgaacttgccgcccgtgtactggtcgatcgcgcggatcttcgcgatgtccttgaagtcgagcaccggctgcgacacttcgagacgcatcggcgggttgatgttgttcgtgtcgagcaggttcggcttcgggccgatgaacgacacgagcgacatgaccatgttctcgcggatcgggtcgatcggcgggttcgtgacctgcgcgaacagctgcttgaagtagtgatagagcgtcttgttcttgttcgacatcaccgcgagcggcgagtcgttgcccatcgaaccgacggcctcttcgccctgctgcgccatcggcgccatcaggaacttcaggtcttcctgcgtatagccgaacgcctgctggcggtcgagcagcgcggcgccctgcgtacggccggccgcgacttcctcggccttcggctcgatctcgtcgagcttgatgcgcaccgcgtcgatccagctcttgtacggcttcgcgttcgcgaggttgtccttgagctccttgtcgtcgatgatgcggccgtgttccatgtcgatcaggaacatcttgcccggctgcaggcgccacttcttgacgatcttcgattcggggatcggcagcgtgccggcttccgacgccatgatgacgaggtcgtcatcggtgacgatgtagcgcgccggacgcaggccgttacggtcgagcgtcgcgccgatctggcggccgtcggtgaacgcgatcgcggccgggccgtcccacggctccatcatcgcggcgtggtattcgtagaacgcgcggcggttctcgtccatcagcgtgtgctgttcccacgcttccgggatcatcatcatcaccgcgtgcacgagcgggtagccggccatcaccagcagttcgagacagttgtcgaacgaggccgtatcggactggcccgggtagatcagcggccacagcttcggaagatcgtcggcgagcacgtgcgacgcgatcgcgccggtacgcgcgttcagccagttcacgttgcccttcacggtgttgatctcgccgttgtgcgcgatcatccggtacgggtgagccagctcccatgccgggaacgtgttggtcgagaagcgctggtgcacgagcgcgagcgccgacacgacgcgcgtgtcctgcagatcgcggtagtacacgccgacctggcccgcgagcagcagccccttgtagacgatcgtgcgcgccgacatcgacggcacgaagtattccttgccgtgcttgagcttcagcgcctggatgcggtggctggccgtcttgcggatcacgtacagcttccgctcgagcgcgtccgtcaccatgatgtccttgccgcggccgatgaagatctgacggatcagcggctcgctcgccttcacggtcggcgaaatcggcatcgcgtggtcgaccggcacgtcgcgccagccgagtacgacctggccttcggccttcaccgtgcgctcgagctcctgctcgcacgcgagacgcgatgcgttttccttcggcaggaagatcatgccgaccccatattcgccggccggcggcaggttcacgccctgcttcgccatttcctcgcgatagaacgcgtccggaatctggatcaggatgcccgcgccgtcgcccatcagcggatcggcaccgaccgcgccacggtgatcgaggttctcgaggatcttcagaccctgctgaatgatctcgtggctcttcttgcccttgatgtgagcgacgaagccgacgccgcaggcgtcgtgttcgttttgcgggtcatacagaccttgtgcggcgggcaccgcggcgagcggctgctggtggtcgttcatggggacaccgtcgtaaaggggcctggaggccgttgaaccattttcttgttgccgtcgatcccgctcccgacgggagacggcgcggccgacagtgggtgggcatgcttcgcccgggccaccggaattcggaatatacgcgacgaatcaagggaatagcaacaaaaaccgcttgatcgaaccccaattaaatggatgcttcgatctggtgccattttattggggccgtatcgatttggtgcaaagaagcggcgcccgcagcgccgcttctggcccgcctttccggcgttactgctggatcggcggcgtgttctcgcgcacctttctggggcgtccgcgcggcagcggcgacacgcgccggttcgccgtgcgcgccgcccactcgcgatagttctcgccgccgagcacccagcctttcagcgtcgcctgctgcaactggtcggcctgccgctcgtcgagcggctgctcgcacagctccttgtacgcgcgctggcggtcgaacggcgtattgccgagcgcccagtagagcggatggtcggtgatcaggctgtcgacggtgagcccgacgtgatgccggtagctcgaccagcgataggcctccggcgtcgcgaccaactgcgcgcgcaccgggctcatctcgacgacgcggctcgcgagcaggaaatagcgctcgccttcgatcacggtcgcgcgatagcggccttcccacagtgccgcgccgcgaatagcgccggttgaaatgcgcgacgtagcggcggccgacagcctgcatcgctttcggcaggctcgcctcgtcgctcggcgtgacgagcagttgcacctggcgcggcagcagcacgtaggcgtgcaccgacaggtgatgatcgcgcgcggcggccttcaggcaatcgatgaagagttcgtagtcctggtcgtcgacgaacgcgggttgctgatccaggccgcgcagtatcacgtgctgcggctggtcgggaacgtagagtcgtgctaaccgtgccatgctgaatgtccgtttgaacgcgttaggaaatacccgagggtccggaagtgcgcacttgcacagaatgcccgtcctgtcggtgcgcggatgcgtacggtcgtactaatcctagggtgaaaactctaacttacgagcttgtttggttttaaacgcagtcgtcataatgagcacgccttagatcggaggagacacaatgaaacgaaaactggccattacggggctgcagcgctcgcatttacgtttgcgggcggtacggcacatgcacaatccgcaggtgatttctacgtcagcaccggctggctgcaccttgcgccgcaggacagcagcgacccgctgttcctgtacggcgtaggcggcacgccgatcaaccagtcggttcccaacaccggcgccggcatcagcgacgccgacacgctcgcactggcaaccggttacttcgtgaccgaccacatcgctaccgagttcatcgccggcatcccgccgaagttcgacatcaccggcaagggccagttctcgcgtttcggtacgctcggccgtgcgtaccagtggagccccgcgctcctcctgaagtactacttcaacgacgccaacgcgaagttccgtccgtatgtcggcatcggcgcttcgtatatctggttcaccggcgcaaagatcacgaacagcgcgttcgagaacggcgtgctcggcggcccgaccaacgcgcagaccagcaaccagtgggcgcccgtcttcaacgccggcttcacgtacaacttcacgaaacactggttcgccggcttctcgatgtcgtacatcccggtgagcgtaaccgcgaccttcacgacggccaagcggacccaggtcggcacgctgaccgaaacgtcgaaggctcacatctcgctgaacccgatcgtcacgtacctgaacgtcggctaccgcttctaagcgtagtcgaatatttggggaatggttaatcctgctgcaatttgtagcggatttttcctgacgtaacgtctccacgatgtaaaacgccccggcggaattcccgtcggggcgtcgttttgtctcagggtcttcccgtacgcgccgtcgcgcggggcattccgctacgcgatgtcgtccagcgcattggggcaatcaggtcgatccggtccgtgcagaccgcgtcgacaccccagcgcgcaagttcgcgagcccgttcgaggtcgttcaccgtgtaaaccaggatgcgcaggccggccgccttgatcgcgcgcacgagcggttcatccagccgtttgtggtctgcatgcaacgaaacgcagccgagcgcgccgacaacctgcgcatgccagtcgtccggcacggcctcgtaaagcatcccgcgcggcagcgccggcgccgtcgcgcgtgcctgttgcagcgcatcgaaggagaacgacgacaagagcggcgccaccgcggcatcgcgccagtacgcggccgcgtcggccgccacgcgctgcccggtctcgcgctcgcgccccgggcacggcttgatctcgacgttggcggccagcccgtgcgcgatgcagcgcgccgccgccgcctcgagcgtcggcatccgctcgcccgcgaagcgcgcgtcgcgccacgcgccggcatcgagtgcggccagcgcctcgtatcgcatgcccgccgccggcccgtgaccgttcgacgtccggtcgaccgtgtcgtcgtgcagcaggaacgtcacgtcgtcggccgacagcttcgcgtcgaattcgaccatccggtggccacggcgcgcgccctcgtcgagcgcggcgagcgtgttctccggcgcgagcgtgccgccgccgcgatgggcgacgacgcgcggatagggccagtcggtacgggttgtcatcatcagtctcccggcaggtgcagcaggttcagccggcacgcttgccggtctccggatcgaagaaatgcagccggtgcgcgggcagtgcggcggccagcgccgtgccgcgcgcgggcggtccgcgtgcggcaggcgcaccgcgacgtcgtggttgccccagcggccgtgcgcgaggttgtccgcgccgagcagctcgcacgagtcgaccggcagcgtcgcctgcgcgacgcccggctgcggtgtcatgtgctccggacgcacgccgagcacccagtcgcgcccggtggcgatctcggcgccgatgccgggcgaaccggcgaccggcagcgcggggccgccgcccgcgaccgtaaacgtcgcgccgtcgtccgacagccggccgtgcatcaggttcatcgcgggcgagccgatgaagcccgcgacgaacaccgttgccggcttctcgtacacgtcgaccggcgcgccgatctgctccgcgtagccgcggttcatcacgatcacgcgctgcgcgagcgtcatcgcctcgatctggtcgtgcgtcacgtagacgctcgtcgtcgcgagccgcgcatgcagccgctggatctcgagccgcatctgcacgcgcaatttcgcgtcgaggttcgacaacggctcgtcgaacaggaacaccgacggctcgcgcacgatcgcgcgccccatcgcgacgcgctgccgctggccgcccgacagctcgcgcgggcgccgcgcgagcagcggctcgagttcgaggatcttcgcggccgccgccacccgcgagtcgatcgtcgcgcgctcgatcccgcggatcttcagcccgtagcccatgttctgcgcgaccgtcatgtgcggatacagcgcatagttctggaacaccatcgcgatgtcgcgatccttcggctccagcgtgttgacgacgcgctcgccgatcgcgatctcgccgtccgtcaccgtctcgagccccgcgatcatccgcagcaacgtcgacttgccgcagcccgacgggccgaccagcacgatgaattcgccgtcggcgatctccacgtcgatgccatgcagcacgtgctgcttgccgtcgtaggatttcctgacgcccttcaagctcagcgcagccatacctggtccttctcccggttaccgtccgtggttcatttctcggaatcgacgaggccgcgcacgaaccagcgctgcatcgccagcacgacgacgagcggcggaatcatcgccagcagcgtcgccgccatcacgtattgccattcggtcgcggcgtcgccgctcgcgatcatcatcttgatgcccaccaccgccgtcgacagcgatgcctccgtcgtgatcaggatcggccacaggtactggctccagccatagatgaacgtgatcacgaacagcgccgcgatgctcgtcttcgacagcggcagcacgacgtcccagaagaagcgcatcggccccgcgccgtcgatgcgcgcggcgtccatcagttcgtcgggcagcgtcatgaagaactgccggaacaggaacgtcgcggtggccgacgcgatcagcggcagcgtcagcccggcgtaggtgttcgtcaggtgcagcgtcgacacgacctgcacggtcgggaagatccgcacttccaccggcagcatcaacgtgacgaagatcagccagaacgccgtgttgcgaaacgggaagcggaaatagacgatcgcgtaagcggacaggatcgataccgcgatcttgccgaccgagatgccgagcgccatcgcgaagctgttgacgagcaggcggccgaacggcgccgtcgcggcgccgctgccgtggccccagatataggcgatgttctcgaacaggtgcgtgctcggcacgagcgacagcggcaccgtgagcacttcctgcgcgctcatcgtcgccgcacagaacgcgacgtagacggggaacacgatcagcacgacgcccgcgatcagcaccgcgtggcagaacaggtcgaaacccttgcgattttcgatcatgcgtattgcaccctgcgttcgacgaaacggaactggatcaccgtgagcccgacgacgatgatcatcagtacgaccgactgcgcgccggagctgccgatgtcgagcccctggaagccttccgcgtagatcttgtagatcagcgtcttcgtgctctgcgcggggccgccgccggtggccgcgtcgatcaccgggaacgtgtcgaagaacgaatagacgaggttgacgaccagcaggaagaaactggtgggcgacagcagcggcagcacgaggttgaagaaacgtcgcaccggccccgcgccgtcgatcgccgccgcctcgatcagcgaacgcggaatcgcctgcaggcccgcgtagaagaacaggaagttgtagctcacctgcttccacactgacgcgagcacgacgaggaacatcgcctgcccgccgttcagcgcgtgattccacacgatgccgcccttcgcgagcgcataggtgatcaggccgatgctcggattgaacaggaacgcccacagcacggcggcgatcgtcggcgcgaccgcgtacggccagatcaacagcgtgcgatatgtgcgcgcgccacgggtcacgcggtccgcgcacgcggcgagcagcagcgacacgacgagcccgctcaccgtgacgagcgtgctgaacacaagcgtcgtgcggaacgaatcgagatacagcggatcggcgaacaggtgcgtgaagttcgcgaagccgacgaattcactcgacgtgccgaacgcgtcctgcatctgcgtcgactgccacagcgcgacgccggccggccacaggaagaacacggcggtgatcgcgagttgcggcgcgatcagcaggtacggcagcaggctcgtgccgaaacgggaacgggattgcatcgcggatatccggtcaggcgaaacggaaaggaaaccgcgccgccggccggcccgcgcgcttgcgcggccggccggcggcacgaacgcgatgcgcgctcagctgcccgacttctcgaagcggcgcagcagctcgttgccgcgcgaggccgccgaatcgagcgcatccttcggcgatttcttctgcgcccagacctgttcgaactcctcgtcgacgaccgtgcggatctgcggcatgttgcccaggcgcagccccttcgtgtacggcagcggcggcttgttcagcatctgcttgatcgcggtttcggcgctcgggttcttcgcgtagaagccctgttcgcgcgtcaggtcgtacgccgccttggtgaccggcaggtaacccgtgtcctggtgccacttcgcggcgacggccggcgatgcgagaaacgcgaggaatttcgcgacgcccttgtaggtcgccggatccttgcccgccagcacccacaggctcgcgccgccgatgatcgcgttctgcggcgcgcccttcacgttcgcgtcgtacggcatcatgcccgtgccgaagctgaacttcgcgaacttctgcaggttcgcgagcgcgcccgacgacgtcgtcatgatcccgcagtcgccgctgtagaacttcgccgatgcttcgtccttgcggcccgcgtacgtgaacgtgccgtccttcgccatctgctgcaggaacgacacgtgcgcgatctgctgcggcttgttgaattcgagcacggcgtccgtaccgtcgaagccgttgttgcggctcgcgaacggcagtgcatgccacgcgctgtagttttcgagctggatccagccctgccagccggtcgtgaagccgcacgccattcccgacttgcgcagcttctcggcatcgtccttcacgtcggcccacgtcttcggcggctggttcggatcgagcccggccttcttgaacgcgtccttgttgtagtacagcaccggcgtcgagctgttgaacggcatcgacacgagatggcccgtcttcgcgtcgctgtagtagctcgcgatggtcggcacgaacgccttttcgtcgagcggcacgccggcctgcctgaacacgtcgtagacgggcacgacggccttcttcgcctgcatcatcgtggccgtgccgacttcatagacctggaggatcgccggcgcattgccgctgcggtaggccgcgatgccggccgcgagcgcctggtcgtaggtgcccttgaagaccggcacgatcttgtagtcgctctgcgacgcgttgaactggtcggcgatcgcgttgacccgctcgccgagcgcggcttccatcgcatgccagaactggatttccgtcgcggcgagcgccgcgtgctgcaccccgaacatcagcgcgccgccgagcgcgatcgaacgaaccagtgtccccgcaggcttcttcttcatcgacctctctcctatgaaaacgttaccaacagcgtgtgcaacattcccatcgccattgaaccggcgaagtctagtgatcgtttgtgacagtcagttgtcgttgatgacgaacaggcgctgatactccttcagcgcgaagcggtcggtcatgccggcgatgtagtgcgcgacgaggcgcggctgctgcgcggcgtcgtcggactggtacggcggcggcagcagccgcggatcgtcgatgaacgcatcgaacagcccggtgacgacgcgctgcgccttgctcgccatgcgcatcaccttgtagtggcgatagaggttcttgaagaggaaacgcttgagggaggccgcctgggcggcaacggattcgctgtgcgacacgagcggcggcgccgcgcgcacgtcgtcgagcgacgccggcgcgacgcgcgcgagattgcgcgtggtttcgtcgatcaggtcgacgatcagcgtgttgatgatgcggcgcaccgtctcgtgcacgagacggcggccttcgaggtgcgggaactcggcgagcgccgcctcgtagtggcgctgccacagctcgacttccgcgagctgctcgatcgtgatcaggccggaacgcaggccgtcgtcgacgtcgtggttgttgtacgcgatctcgtccgcgatgttggcaagctgcgcttcgagcgacggctggcggccctgcaggaagcgctcgccgagcgcgccgagcttgcgcgcattctcgcgcgagcagtgcttcagaatgccttcgcgtgtctcgaagcacaggttcagcccgttgaacgcgccgtagtgctcctcgagctcgtcgacgaccgccaggctctgcaggttgtgctcgaagccgccatgctcgcgcatgcaggcgttcagcgcgtcctgcccggcatggccgaacggcgtatggccgagatcgtgcgcgagcgagatcgcctcgacgagatcctcgttcaggcgcaggttgcgcgcgaccgagcgggcgatctgcgcgacttcgaggttgtgcgtgagacgcgtgcggaacaggtcgccttcatgattgacgaagacctgtgtcttgtattcgagccggcgaaacgcggtcgaatggacgatgcggtcgcggtcgcgctggaattcggtgcgcgccgccggtggcgtttccggatggcggcggccgcgcgactgcgacgcgtgtgcggcatacggagcgagatgggcttccagcgccgccagtgtcggcggctcggccaccggcgcagcggatacgcggccggcttcgggcagtgtgctgctggatgtctcgctcacgtctcctccatgtcaggggcgccgttgcatccgggccgcccgttagcgcgtcgtctgcgccagtgtagcgaatacggcttcgtccggcgcctgcgtgatcagcgtatcgccgaatcgcttcagcaggatgaacttgatcgcgccggcctccgccttcttgtcgacgcgcatcaggtccatgtagcgcgcgtcgccgagcgcgggcccgcgggtcggcagatgcgccgccgcgatcaccgcatcgaggcgctgccgcgacgcttcgtcgagcaggccgagccgcaccgacaggtcgcccgccatcaccatcccgcagccgaccgcctcgccgtgcagccactcgccgtagccgagcccggcctcgatcgcatgaccgaacgtgtggccgaagttcaggatcgcgcgcaggccgccttcgcgttcgtcggccgccaccacgctcgccttgatctcgcacgagcgcttcaccgcgtgcgcgagcgcagccgggtcgcgacggttcagcgcgtcgacgttcgcctcgatccagtcgaagaatgccgcatcggcgatcgcgccggtcttgatgatctcggcgacaccggccgccagttcacggtcgggcagcgtcgtcagcgcgccgatgtccgcgatcacggcctgcggctggtagaacgcgccgatcatgttcttgccgagcgggtggttgatgcccgtcttgccaccgaccgacgaatcgacctgcgacagcagcgtcgtcggcacctggatgaacggcacgccgcgcatgtagcatgcggccgcaaagcccgtcatgtcgccgatcacgccgccgccgagcgcgacgagcgtcgtcttgcggtccgcgcggtcggtcagcaggccgtcgaagatcaggttcagcgtctcccagttcttgtatgcctcgccgtccggcagcacgaccgtcgacacgcgcttgccgagcggcgcgagcgccgcgcgcagcgcgtcgccgtagagcggatcgaccgtcgtgttcgtgacgatcgtgacggaagaacccttgatgtgaggtgcgaacagctcggcgcggccgatcaggccggcgccaatgtgaatcgggtaggcgcggtcgcccaggtcgacgttgacagtaatcatgcttgtagcggcttggcgatgacgcccgccagttcgagttgcatcagcaccatgttgacgagaccgttgaccgacggacggccggtctcgatgacgaaatccgcgcattcgcggtacagcgggtcgcgcacttcatatagcgcttcgaggcgccccttcgggtcttcggtctgcagcagcgggcggttcttgtccttgcgcgtgcgcagccacaggtcgtgcgggttcgcgcgcaggtagacgacgataccgttgcttttcaggcagtcgcgattttccgggcgcagcaccgcgccgccgcccgtcgcgagcacgatgttctcgcgctgcgtgagatcggcgatgacctgcgtttcgcgatcgcgaaacccggcctcgccctccagctcgaagatcaccggaatgcgcgcgcccgtacgggcctcgatttcgtggtcggagtcgaagaacgtcctgtcgagacgacgcgcgaccgcacggcccacggtggtcttacccgctcccataaggccgacgaaaaatacgtttgcatgtgggtcccgcgcttgcaacggcttcctctgcttcaatcttgctggtgtgtggcgcagcttactggcaaagcggctgccttgtcgagcctgcgccggcggcttccggccccgttttatcggcatccgcgctgcccatgccgcgtgcatcgcagcgcgcatcgacgaccgtcggcgtgatgaagacgaccagttcgctgcgctggtcgcgttgcgcgcggtgccggaaaagcgcgcccagaaacggtattttgcccaagagcggcacgcgcgtcacatcgttccggttcagttgctcatagatcccgccgatcgcgaccgtcccgccgttctcgacctcgacgcgcgtctgtacgtgcttcgtatgaatcgccgggccggccgccgtcggctcgccgacgctgtccttcgtcacgtccaggtcgagcacgacgcgcccgtccggcgtgatctgcggctcgacctcgagcttgagcgtcgcccggcggaactgcacgccgctcacgccattgcccaccttcgcctggtacggcagctccgaaccctgttcgacgatcgccttgacgcgatcggcggtcaccacgcgcgggctcgaaacgatctggccccgcccctgcgcctcgagcgcgctcagttcgacgtcgagcacacggctgagcggcgcggcaaacagcgtaaagccggcggtcgccgcttcgaagccgccgagcggccgcccggcaaggtcgagcgcgttgcgcgcgccggtcgtgaacgaggcgctttcgctcgcactctcgcccgacggcggccgcgcctgcgccctcagcgcgacacgagcgccgagattgcgcgaaaagccttgctcgccctcgacgatgcgggcctcgatccggacctgccgcgacggccggtcgatcgcatcgatcaggcttgcgatctggtcgaggcgcggcgcgagatcggtgacgaacagcaggtttgtccgcggatccgccgccgcggcgccgcgcttcgacagcaggcgctggccggtcgcgccggccagcagccgttgcacgtcctgcgcgcgcgggtagcgcagcgcgaacgtccggctcgcaagcggctccagatccgcggcccgcgcgtgcatttcgaagcgctcgcgttcgcgcgccgccagctcggccgccggcgtgacccatatcacgttaccccgccgcgacatcgcaagcccgtgcgtgtcgagcagcgtgtcgaaggcatcgcgccagcggacattgttcagacgtaacgtgacggtgccgcgcacctgctcgccgacgacgatattgagcccggtgaaccgcgcgaatgcgtcgaacgcggccgcaagccccgctcctgcagattcagcgaaatccgccgtgcgtcgtccgcatcgcccgggtgccgcgcggcggcatcgcccatccgggccggcggcgccaacgggatcggcggcccctccagcccgggtgccggggcgacggcctccgcctgaagcgccgtgcgagccgcctggtcgaacggcggcgggccggcctccgcagatgcggggccgtccgccccgtccaccgcgccttgcggcaacggcaggcccggcaccggcacctccatcgatgccgctggccagacggccggcagcggcggcaacgaggcgcttgcaccggccgccgtcaatccggcccaggcggcgagcgcccgacatccgtgcttcatcatgggtgcctcccgtcgtccagagcgactcggtacgcgccatccgccgtcgcgagcgtcacggcgacgggatcgactcgcaccacccgcgcggccccgagggcttcgccgggcaccagggcagcgaatgcgccgccaccgtcgtcgaacaacgcgagaccggcacgcctgtcgcgaatcgtgccggccaggcgggcagccgccctccgtttcagacgagccggccccgccgaacggatcggcgccgggcgcgtcggccagaaccggcgtctccgcgcccttggacgtcatcgccggtaaccccggaaacacgtcgaccgccatttccacacgcgcagcctcctttcctcgttcgacacgcagcgtggtcggcaccgccagcaccgggaaacgcgccagccatccgaccatctgcagcaacgcgcgatacccgccatccgcgacgatgcgcaccgagcgttgcccttccggcactgcccctcggcgcgcagcggttcgatcgatacgccgcgcagcccgctcgacgcggcgcgatcggccagttccagcatcaacgcggcccattccggcgcacgcgacgagcgatcgccgtctgccgccgccggattcgcgtcgtgttgccgtgcagcggctgcgagaacacgctgcgcgtcggcctcttgcttctgcgccgccgccagcaacgcgcggctgtgcgcgagcccgctccagtccgcggcattcgccagatgaatgccgcccgtcagcacggccgcgaacgcgagcacgcagcctgcgatatgcgcggtcgccggcgacacgcgccgcacgccgttccgccatcctccgcgatacggtgcgggccgatgcgcgagcgccgtcatgcgccacctcccgatgctttgcggggcggcatcgcgtcgtgccagcgcaactggaccgagaaccggaacggcatcccgccggcagcgaccggtgcatccggggctggcttcaacgcatcgatatcgatccgccagccacgctgctcgcgcgccatccccgcaagccatcgcgcagccgcccggtagctcacggcgcggacatcgagcacggcaccggccgacgtcgtgcgcaacgcatcgagccgaaccgtgccgtcgtgcacctgcgccagggtcgccagcagccccgcgacgtgccggtaaggtgcggcatgcgcggccgcctgcgcgtcacgctgcgcgacgacggccgccgcattggcggcgcgtgtcgcggcgcccatctgcggctgcaattgccgcagccgcgcctccacgattgcgcgctccgcatccacacgccaccgcgctccgctggcgacacccgtccacaggccggcgccgagtacgccgagcagaaccgccgtaccgcactgcgcggcccgacgacgtcgcaacgcccgcgccagccgctcccggtacggcaacaggttgaagccgcccggctccgcatgaagggccgtcattcccacaccccgcgcaatgccagcccgaatgcaacagccaatgccgggccgcccggcatgccggtggacaggcacgattgcgcgccccaacccgcgcagtcgaacggcaccgcaaccgcgccgaccacgtcgccgatctcggcgacggacgtttcgaagcgggcgatacaccgctcgtccccggccacgaggacacagcgcacggccccgagcgcgcgccggcgcaatgcatcggaaaacgccccggcaccacgccggacagcgtcagcaccggtacggccgacggaccgtcgattcgccagccctgcacgcccgagtcatggaaccagagcgccgcgcaggggcccgcctgcgcgtcgagttcgcattgcgccgcatagcgcaacgcacgcagcgctgcggccgattcgccgtcgaccaccgtcagatcgacaccggcctgcgcggccacatcgacccgccgttcgatcagcgccagcgaggccacggcaacctcgatctccccgcaccgccatcctgccgccagtcgaacgcgagactgtccggcgcgagccccgaaatgcgttcggccgcctgccgcgcggcgtcctcgatgtcgtcccgcccggccaggtccagcatcgcggtgcgcatctcgtcatcgggcaacgccatcacgccgcgcgcgccgcaccgcacgtcggccgccgacagtctcgacacggccgcggccagcgcccgagcgaccgccgcccaacgcgcatcctccgggccgcccgccaacccgaccggctcccgctccagccctcgacgcacacctcggcgccccggccgcgccggctcagcacgaccaccctcacctcgtccgcaccgacgtcgattcccgtcgaccggtgcccgccctgcgcaaaccgcgctcgccatcttcccgccatcccagcctcccgagatcgtcgcggcccacgccgcgtttccggactgattctgcaaaacggcgcgtcgggccgacagtcggcctaacggccagcatccgctcgcgacggccgcgcgcgggctatgctggaagcacgccggcccgcggcttcggggcgggcggcccccgcgtcagggccggtcttaccgggcagctataatcgcgggactgttttccggtatgcctatgcaatccacgactcctacgtccccgcctcccgccccggagccgaagaagcggccctggtggcaaaaagtcctgctcggattcgccacgatgtgcgtggcgctcgtcgtggccggcggcctcgtgctcggctacgcgctcgtcgtcgcgtggccgaacatgccgtcgctcgacgcgctgaccgactatcgcccgaaggtgccgctgcgcatctatacgtccgatcacgtgctgatcggcgaattcggcgaagagcgccgcgacgtcgtccatttcaaggacgtgcccgactcgctgaagaaggcgatcctcgcgatcgaggacgcgcggttctacgatcacggtggtgtcgacctcaccggtatcgtgcgcgccggcttcgtcgcgctgacgaacggccatgcgtcgcagggggcgagcacgatcacgatgcaggtcgcgcgcaacttcttcctgtcgagcgagaagacctacacgcgcaagatctacgagatgctgctcgcgtaccggatcgagcgtgcgctgacgaaggatcagattctcgaggtctacatgaatcagatctatctcggccagcgcgcatacggcttcgcgagcgccgcgcgggtctacttcggcaaggacctgaaggacatcacgctcgccgaagcggcgatgctcgcggggctgccgaaggcgccgtccgcgtacaacccggtcgtgaacccgaagcgcgcgaaggtgcgccaggaatacatcctgcaacggatgctcgagctgaacttcatctcgcgcgagcagtacgacgaggccgtcgcacagccgctcgtcgtcaagggtccgggccgcgatttcagcgtgcacgccgagtacgtcgcggaaatggtccgacaaatgatgtacgcgcaataccacgaggaaacctacacgcgcggcttcaacgtcgtcacgacgatcgactccgcggatcagcaggtcgcctataccgcgctgcgcaagggcatcatggattacgaacgcaggcacggctatcgggggccggaaggcttcatcgagctgccggccggcgccgacgaccgcgaacaggcgatcgacgatgcgctgctcgaacaccccgacaacggcgaactgattgcagcggtcgtcacggccgcgaacccgcgccagatcacggtcgcgttcatcgacggcagcaatgcgacgatcgaaggcgacaacctccgcttcgcgtcgggcgcgctgtcggccaatgcgcagccgaatcgccgcatccgtccgggtgcgatcgtccgcgtcgtgaagaacgacgccggcaaatggtcgatcacgcagttgccgcaggtcgagggggcgttcctgtcgatcgtcccgcaggacggcgcgatccgctcgctcgtcggcggcttcgactacaacaagaacaagttcaaccacgtcacgcaggcgtggcggcagccgggttcgtcgttcaagccgttcatctattcggcgtcgctcgacaagggcctcgggccggcaacggtgatcaacgacggtccgctgtatttcagcgcggccgaaacgggcggccaaccgtgggagccgaagaactacggcggcggcttcgaaggcccgatgtcgatgcgcaccgcgctgcagcgttcgcgcaacctcgtgtcgatccggatcctgaaccacatcggcacgaagtacgcgcagcagtacatcacgcgcttcggcttcgacgcggaacgccatccggcgtacctgccgatggcactcggcgcgggccaggtcacgccgctgcagatggcgggcgcgtattcggtattcgcgaacggcggctaccgcgtcaatccgtacctgatcgccgaagtcaccgatccgaacggcgcgatcgtcgtgcgcgcgcagccgctcgtcgccgaacagaatgcgccgcgcgccatcgacgcgcgtaacgcgtacgtgatgaacagcctgctgcagagcgtcgcgcaacgcggcacgggcgcacggaccaacgtgctgaagcgcaccgacctcgcgggcaagaccggcacgacgaacgactcgcacgacgcgtggttcgccggctaccagcacacgctcgccgcgatcgcgtggatcggctacgacaatccgcgcagcctcggcgatcgcgaaacgggcggcggcctgtcgctgcccgtctggatcgactacatgggtgccgcgctgaagggcgtgcccgagttcaagccgacgatgccggacggcgtcgaatcgctcggtggcgagctgtacttcaccgagttcgcgccgggtcacggtttcgtgtcgacggtcggcgtgccgcaagcgccagccgcgcagaacgtcgatgcgaccgtgccgcacgtcgacgagcaggaaaagcaggacatcatgaacctgttccaggcgcattgactctcggcggacatgaaaaagcgcccgcggggcgctttttcgttgggtcacgcgtcggggcggggccccgatcgtcatgcgctgaacgtgatcggcaggccggcctgctgagtcgcgtattcggtgagcgccgagaagaactcggtgcccgtgcgcgtatcgcgccatgcgccgtcgatgaaccggtaatggaaaccgccggccttcgcggcgatccacacttccttcatcggcggctgcaggttgacgatgatcttcgagccgttctcgaacgtcagcgtcaggacgctgccgttgcgctccagatcgatgtcgtgatcgccgtcgttggcgtcgtcgacggtacgctcgacggccgccagcacggcctcggcacgggtcaggtattcggtatcggacatgctaaactctatcggttcaattgttcagggacgatcatgcgagtcgttttccggatgagcgcgattgtagcggctttggcgattcttgccggctgcggtcaaagcggcgcgctctatctgcccaccgtgcctccgctgcccaagccactccagcagcaggacacaccgccgtcggacgtgaagccgaccgatgaaaacgcgtcgaccgacagtgtgcctgattcgtccggcacgccgctcatgctgtcgcccgaattgtcgagcggggcatccgccacggctgcaccggcatcgagcccggccgtcgcgaagtaacgacgcgccgcctgcgcaggctcgcgaaacgaggcgatgacttcccggtcatcgcctttgtttttggctgcgccgtcacgcgcgcacgcgccgccatccccatgcaaccagccgccagccgagcagcgcgacgacgatcgccgcatacagcttcggctgcgcgagattgtgcttgccggccctcatccaccagaagtgcagcacaccgaacagcgcgatcgcgtagatcgcgctgtgcagcgtcgcccagtggcggccgagccggcgcaccatcgcgcgcggcgacgttgccgcgagcggaatcagcagcacgaacgcggcgaaaccgaccgtgatgaacgggcgcttgccgacgtccttcaggatcgcgacgacatcgaaccacttgtcgaaccacaggtaagtcgtgaagtgcagcgtcgcgtagaagaacgcgaacagcccgatcatgcggcgaaagcgcagcagcgcggcgaaccccgtcatgcgccgaagcggcgtgacggcgagcgtgacgcacagcatcacgagcgtccagaggcccgtcgagcgcgtgatgaactcgatcggattcgcgccgagccggtcggtcagcccgaacagcacgagacgcgtgagcggataaaggcccgccgcgaataccagcaccttggccagcgcgagccagcgcggcgcggcggggcgggtcgcgccggcccgcacggcacgtgcagccgggccggcgcccgctgcacgcgcgggcgtcagcgtcgaaggaggcatgtcgtttctcaccttcgccctcagaaattcttcttcaggtccatgccctgatacatcgacgcgaccaggtcgccgtagccgttgaacatcagcgtcttgcgcttcggcgtgaaagccgtcctcgccgatgcgccgctcggtcgcctggctccagcgcggatgatcgacgttcgggttcacgttcgaataaaagccgtactcgttcgacgcatacgtgttccagctcgtcttcggctgcttgtcgacgaagcgaatcttcacgagcgacttcgcgctcttgaagccgtacttccacggcacgacgatacgcaccggcgcgccgttctggttcggcagcacctgcccgtagacgcccatcgtcagcagcgtcagcggattcatcgcctcgtccatccgcagcccttccgagtacggccagtcgagcacgggtgtcgacaggccgggcatctgcgacgggtcggccagcgtgatgaactgtacgtatttcgcattgccggtcggctgcacccgcttgatcagctcggacagcggcacgccgatccacgggatcaccatcgaccatccctcgacgcagcgcaaccggtacacgcgctcttcgagcggcgcgagcttcatcagttcgtcgagatcgaacaccttcggatgcagcacctcgccctcgacgctcacgcgccacgggcgcggccgcagcgtgcccgcattctgcgcggggtcgctcttgtcggtgccgaattcgtagaagttgttgtaggacgtgatgtccttgaacggcgtcaccttgtcggccgcgacgaacttcgggttcgttttcgccgcgagcttcgctgcccgcgcgtcgggcgacgcataggcggcaaatgccgcgccgctgccgccgagcagcccgcccgccgccgcgaggccggccgcctgcaacacgcgccgccggttctcgaagaccgcgcgcggcgtgatttcgccgggcgcgatatcgccaccggtcagtacgttcagcaaagggcgtttgatccacatcgtgctgctcctcctgcctgcgccgcgcgcagcttcatgggcgttcgacccgactcatcttgcgccgttcgccggccggaccgcccgtccgttacaaagaaaaccgccgggcacgcagtgcaccggcggtctcatagtcggacgagcagcgggaatcttacagcttgccgtagctgtgcagcccggacaggaacatgttgacgccgaggaacgcgaaggtcgtcacgagcaggcccgtcagcgcccaccacgcggccaccgtaccgcgcaggcccttcatcaggcgcatgtgcagccacgccgcatagttgagccacacgatcagcgcccaggtttccttcgggtcccagctccagtagccgccccatgcctcggccgcccacagcgcgccgaggatcgtcgcgatcgtgaagaacgcgaaaccgaccgcgatcgacttgtacatcacgtcgtcgagcacgtcgagcgtcggcaggcgatcggcgagcacgccgcgctccttcatcaggtacgcgaccgacaccatcgccgacagcgcgaagctgccgtagccgatgaagttcgccggcacgtggatcttcatccaccagctctgcagcgccggcacgagcggctggatctgctgcgcatcgcgcgcgaccgagtaccacatcaggaagccgaccgccgcgctgatcaccagcagcacgaacgcgccgagcgaacgcgtcccgtagtggccttcgtaatagagatagagcagcgcggtgatcaggctgaacagcacgaacacttcatagaggttcgacaccggaatgtgcccgacatccgcaccgatcaggtaggactcgtaccagcgcaccatcaggccggtgaagcccatcagcacggcgacccaagtgagcttctggccgatcgcggagcccgattccgagcgcgcgagcaggccgatccagtagaagatcgtcgcgagcacgaacagcgcgctcatccacaggattgccgactggctcgacaggaagtacttgaggaagaacgccgaatcggcgcgcgcgagatcgccctggtagatctggatcgacagcagcgccagcacggcgatcgacgccatcatcagccgcgcgggcttccagcgccagccgagcgcgacgagcgccggcacggtgccgatcatcaccgccttgtcgtagtaatccatgtgcgcgttgtagtgcacgagcgcatagcccgcgcccaccacgagcgccagtgcgaacagccagtcgagcaacgacaggcgcgcgaggaacggacgatcgtcgaacaacggtgccgtgaccggcgcctgggccgacgcccgatgggaagaggaaacttgcgtgagatccatgatgttaccgggtggaattctcggaatcggaaccgccgccggcaggcgaacgggccgtcgatgccgcaccggccggcgcggcgtcgcgaggtgcggcgtgcaaggcggcaccggccgcgtcgcgcgtctgcacgtattctttctcgaaatcgaaggtcttgcgggccgtggacattgccatcaccacatcgacgcccgaaccggcgtccttcagccagaaccagaggcgccgctcgcgcacgtagaacatcgaaaagatgccggcgaccagcagcaggctgccaagatacaccagattcttgccgggtgcgcgcgtcaactgaaataccgaagcttgcacctgcttgaatgagtcaagctgcaaatagaccggcgatccatacaaaaagctgtcggatagcgcgttgatcgcgttctgtacgaaacggatcgtgtcggtgccctgctgcgccgccggctccccgcacgctcgcgcgcgatctgccagacctcccacatcgagccttcgagcatccgcagcagcaggctcgcggccttctcctgctcggccttgggcaccgagcggtcgatgaacgtcgccacggcctggaagccgccgatcggctggccgtcggcgccgcggccgacgctgtcgtcgctcgccgcaaacagggtcagcaccttcagcgcactgtcctgcaggcggccgcgcagcgatgcgtcggtgcccggcagcgaacgctgcgcgaagcgcgcggcggcttcggcgcgcacggaaggatcctcgagcgcggcgcgcaggtgcatccattcgccgatcgaatcctggctgtcggccggaatccgcatgtagcggaacgggtcgttcgggctcgtgcgcacgccggcgaggaacacgcgctcgccgttcatgtcgacgggcagcatgtagttgttgaattcgcgcgcctggccgtccttgccgcggatcttgtactgcacggacgggccgatgttgtggagctgcgtcggcttcgacgtcttcgcgccggagccgagccgttcgtcgaacacttccttcagcgagctcgtcgtcgccacaccacgcacgtccggcttgccgttcgcgtcggccatgttctcgacgttgatcgcgcggaaatcggcgaactcgatcgtgtcgccgtcggcgcccggcatctgcagcggcgccgaactgccgatcgtgccctgcacgggaaggtcttcgcgttgccgcccgtcatcggataggccgtcatctgcatctgcgagccgccgtcctggaagctcgactggtagatcgacacgcccttgtaagtgaacggcttgttgacctcgacgcgcgccgggattttccggccggtctcgcgatcgatcacgacgatgtcgctcgcgaacagtttcggcatgcccgtcgtgtagtagtcgacgatgaacttgttgagctggatcgagaacggcaggtcctggatcagcgagccgctcggctgattcaggatcgcggtcgacacgaactggccctcgggcacccatgcgtagccgcggaacgtcgggttcgacgcggacaggcgatggtcgggcgagatctcgctgattgtcgcgctcgtattgaccgggctcttgccgaacatccacatctggaatttgatcggcaggttgctgtcgagcaggccgccgatacagatcacgacgatcgcgaggtgcgcggagatatagccccacttggtcatcgcgccgcgcttcgcggagatcagcgtcgcgccgtcgttttcacgcacgacgtgcttgtagccggccttggtgacgaaggtggcgagcgttgccgtgacggtcgcgcgcgtgccggaagccgtgtactcggccttgtggtggaaagcccgcaggctgccttcgcgaaccttgtccttccagctctttgcatcggcgagcatcttcggcgcgttgcggatcacgcacagcgagatcgacacgacgaggaagatcaggatcagcatgaaccaccacgcgctgtacacgttgtacaggccgagcgagcggaagatgtccgcccagaacggcccgaactggttcacgtagttcggatacggatcgtcctgggtcaggaccgtgccgatgatgctcgcgatcgacagcaccaccagcaacgcaatcgcgaagcgcatcgagctcagcagctcgaccgcgcgcttcgacgcaccctgactcgacttcgactgcaaccccgacgtggtaacgctcattcaaactccgactgacaacaaaaagggcaaggcggccgcgactgcgcggcgccccaccctttcttgttctgactccggccgcccttcgggcgtccggtcatttccttcgcggctgaccgctcaacgcaggcccgcgatgtaatccgcgacggccttgatctcgttgtccgacagccgcgtcgcgatctgatgcatcgcctcgttgttgttgcgcgcgccggcaccctgctggaacgcggtcaactgcgcgaccgtgtaatcggcccactgtccagacagacgcgggtactgaaccgggagaccctgccctgtcggcccgtggcagctcgcgcaggcgggtacgcccttctccgcgatgccgccgcgatagatcttctggccgatcggcacggtcgccgcatcgcgtgcggtgccgagcttcgtcgtctgcgacccgtagtacgcggcgacgttgcgcatgtcgtccgcgctcagcgcgctcgcgaatccgaccatcactgcgttggtccgcaccggccccttcgcgcccggctgcgtcttgaagtcgttcaactgcttgaccagatattcgggatgctggccggcaagcttcgggaaactgcccgacgcgctattgccatcggcaccgtgacacgatgcgcacacctgcccggcaatcgccttgccgcggtcgagatccggctttgccgcctccgccgcgtttgcctccgctacgaaacctacgaaccctgctgcaacctgaagcaccatcagagacttgcacagtcgattcattcgcacaccctgtttcgtcttgtgggaatttgaggttctgcaaaaacgacggcgttcagtctaccgcagaagccacataaaagcgcgaggcaggcgcccggtggccttcggtaaaaccgccgtattgtacaatatcgcgttgaaagctcccgcgcctatcggggctacccgcctccaccaagcggctcgcgccgcccgtccttccggttcccatggcctttctgctccatcaagcccgcttctacacgaccgtcaaccatctgcgcgacctgccgccgacggtccagccggaaatcgcgttcgcgggccgctcgaatgccggcaagtcgacggcgatcaacgtgctgtgcaaccagaagcggctggccttcgcgtcgaagaccccggccgcacgcagcatatcaactacttctccgtcggcccggccgccgagcccgtcgcgaatctcgtcgacctgcccggctacggctacgcggaagtgcccggcgccgccaaggcccactgggaaatgctgctgtcgtcctacctggcaacccgctcgcagctttgcggcctgattctgatgatggattcgcgccgcccgctgaccgacctcgatcgccgcatgatcgagtggttcgtaccgaccggcaagccgatccacacgctgctgacgaagtgcgacaaattgacgcggcaagaaagcatcaatgcgctgcggaccacgcaaaaggggctcgatgcgtatcgtgaccagggcgtccagggcaagctgacggtccagctgttttccgcgatgaagcgcacgggcctcgacgaggcgcacgaactgatcgagagctgggtgcggccgtccgccgccgacgaaaaagcgagcctgtagcacaatgatcgggcaacgcgcggccgggatcggcggcgcgcacctgacggcgcctgcggattcggccggctcataaaaacccgccgttgaacggcgggtcaaacagcctaatcgaaaaacgacaggcacccgctcagggagagcggggagctgcacgcgacgcgtgccgctcgatcgctatcatataccaacgctcccgaaaatgaccgaagggttccgtaaggtccttcttgccctgatttctacccaatcgccatgagctttcatccgcttcatcgtccgcgccggatgcgccgcgacgacttctcccggcgcctgatgcgcgaaaaccgcctgaccaccgacgacctgatctatccggtattcgtcgtcgaaggcaccaacgaacggcagccggtgccgtcgatgcccggcgtcgaacgcgtgtccgtcgatctgctgatgcatgtcgccgagcaatgcgtcgaactcggcgtgcctgtgctgtcgctgttcccggccatcgaaccgtcggtgaaaacgcctgacggccgcgaggcagccaacccggaaggcctgatcccgcgcgcggtgcgcgagctgaagaagcgctttcccgaactcggcgtgctgaccgacgtcgcactcgatccgtacacgagccacggccaggacggcgtgctcgacgagaacggctacgtgatcaacgacgacacgatcgagatcctgatcgatcaggcgcgcgcacaggccgaagccggtgtcgacatcgtcgcgccgtcggacatgatggacggccgcatcggcgcaatccgcgagatgctggaaagcgacggccatatccatacgcgcatcatggcctattcggccaagttcgcatcggcgttctatggcccgttccgcgacgcggtcggctcggcgtccaacctgggcaagggcaacaagatgacctaccagatggacccggcgaacagcgacgaagcgttgcgcgaagtgcgcctcgacatcgacgaaggcgccgacatggtgatggtcaagcccggcatgccgtacctcgacatcgtgcgccgggtgaaggacgagttccgcttcccgacctacgtgtaccaggtgagcggcgaatacgcgatgctgaaggccgccgcgatgaacggctggctcgaccacgacaaggtcgtgctcgaatcgctgctcgcgttcaagcgtgcgggcgccgacggcgtgctcacgtacttcgcactcgacgccgcgcgcctcctgaaagcgcagcgctaagccacgcgccggcagcgccacgaaaaacggcgggacacttcggtgtcccgccgttttcatttgcaatcggtgtacaagccaccgacaagcgtgcgctacaccgttggtaccgccgcgcgatcgagactgcgcagaaacgtctcggctgcctgatagccgaccacacggccgatttcgttgccgttgcgatcgaagaagatgatgccgggcggcccgaacaggttgaagcgcttgagcagcgcctgatcgtccggattgttcgcggtgacgtccgcacgtaccaggtgaagctgcgcgagccgcgcctgcacgcgtgcatccgtgaacgtcaggtgctccatctccttgcagctcacgcaccagtcggcgtagaagtcgagcatcacgggctggcccgacgtcttcagcagcgcatcgagttcgccgctggagcgcaccgaagcgaacgccggccccggctgcccggcagccgcaccggctgccgacacatcgcccgacgcgaccgtgcgcgcagcaaggacagccagcggtttcacggggtcgttggagcccgccgcaagaccgacgagcagcgtcgccgcccagatcgcgagcgcggcgccgaggccacggccgaggcggcgccagatcgacacggcgccggcatgcggcgtgaacaggccgagcgccgcggcagcgatgagtagccacaacgcagcgagcaccatcttcaggccgccggcaagcaccggccacacgatccacgcgcggccgcgagcagcacgatgccgaagaacaccttcacgccgtccatccatgcacctgcgcgcggcagcaccgtaccggcaccgatgccgaccacgagcaacggcacgccgagccccagccccatcgcgaacagtgcggcaccgccgagcagcgcattacccgtgtgtgcgatgaaagcgagcaccgcgaacagcggcgccgtcatgcatgcgccgaccaccagcgccgacaacgcgcccatcgcggcaaccgcaacgaagtgaccgccctgtcgcgcgctcgacacttcggctgcaccgttctgccagcgcgcgggcagcgcaatgtccttgcccgaaatcagcgaaaccgcgaacgcggtgagcagcacgccgaacgcgccgagcacccacgggttctgcaaccacgcgccgaggctctggccgaccagcgccgcggcgatgcccagcaccgtatagacgagcgccatgccgaccacgtacgtcagcgacagcgcgaagccacgcgcatgcgtcgcgcgcgtgccctgaccgatgatgatcgccgacacgatcgggatcatcgggtacgaacacggcaggaggctcagcacgacgcccgcgacgaaatacagcgcgacgatcgtgaagaagccatgccctcgagcagcgactgcgcgaaatcggcgctcgtgaccttgtcgaaccaactgccctcggctgccgcatcgccggaagacgaggccgcacccagtgcggcgccgtcgaccttcacgacgtgctcggcgggcggatagcagatcccttcgtcggcgcagccctgcgacgtcaccgcgagctcgaacggccccgacgcctgcttgacgggcacgtgaacgacgacttcgtcacggtaggtctcgacgttcttctggaacgtctggtcgaacttcacatggccggcggggaactgcggctcgccgagcgtcgcctgcccgctcttcaccgcgaatgcgaaccgctcgcggtacaggtaatagccgttggcgaccttgaagcggacgtccacctgccccggcgattcgctcgcgctgaacttgaacgccaccgacggatcgaggaaatcgtcggccgcacgcgcgaccgacaggccgccgcccagcacgagcatgaacgacaacaggactgcgaggaaccgcagcgcgcgcacgcgcacggaaagcgccataccgttaaacatgaaatagacgttgagtttcgctggtcacccactggccgtaagcggccgaggccgtcgcctgccacgagacgatttcaggtgtctcgtatggatgatgcgcgagaataaatcgctccagttcgagcgcccgcacggggctcgtcttgaacagcaactggatctcgtcggccgtttcgaccttgccctgccagtgatagcgtgacctgatcgcaccgagctccgacacacacgcggcaagccgcgcatcgagcgcaccggcggaaagcgcctcggcggtcgcggcatcgggcaccgtcgtcagcatcagcaccactatcatccgcgccctcctggctggtctatcgactcctggctcctgccggcgcgcgttgcccacccgggagcgcaccggctgccctgtatcgtagcgcagcccgcgcaacactgccggcaccaccctgcgacaatcgatcgcagccgccgcttcaaaaacaaagggccaagcaattgctcggcccctttcagatactgctgcgtaccggaagcttattcagcttcttgcacggtttccgtttcgtcgacttccggacgatcgagcagctcgaccagtgccatcggtgcgttgtcgcccacgcggaagccgaacttcagcacgcgcaggtagccgcccggacggttcgcgaaacgcggaccgagcacgtcgaacagcttcgccaccgagtcacgatcgcgcaggcggttgaacgccaggcgacggtttgccagcgacggcttcttgccgagcgtgatcagcggctcgacgactttacggagttccttcgccttcggcagcgtcgtcttgatgacttcgtgctcgatcagcgagttggacatgttacggagcatagccagacggtggctgctcgtgcggttcagtttccgcagaccatgacgatggcgcatttcagtttccttgattcaaagttttgatccagctcttctatcgcacctcgatgggtgcacgggccggtaacgaaaaagcaagatgcggattttaaaggaaaatccgcatctttgccaactacagcaacagcagcgctacaagcgggcttacttgtcgagaccagccggcggccagttttcgagcttcatgcccagcgtgagaccgcgcgaagcgagcacttccttgatctcgttgagcgacttgcgaccgaggttcggcgtcttcagcagctcgttttccgtgcgctggatgagatcgccgatgtagtagatgttctcggccttcaggcagttcgccgaacgaaccgtcagctcgagatcgtccaccggacgcagcaggatcggatcgatctgcggtgcacgcgacggcgcttcggctgccgtttccgtgccttccagcgccgcgaacacggacagctggtcgaccaggatgcgggccgattgacggatcgcttcttccggcgtgatcacaccgctcgtttcgatgttcatcacgagcttgtcgaggtcggtacgctgctcgacacgtgcgctttcgaccgcatagctcacgcggcgaaccggcgagaacgatgcgtcgaggacgatgcggccgatgatcttggccgtgtcttcgccgtagcgacggacgttgccgggcacatagccgcgacccttttcgatcttgatctgaacgtcgagcttgccacccttcgacaggtgcgcaatcacgtgattcgggttgatgacttcgcagtcgtgagccagctcgatatcgccggccgtgacaacgccttcaccttccttgcgcagcgtaaccgtcacttcgtcacggttatgcagcttgaacaccacgcccttcaggttcagcagcaggttgacgacgtcttcctgcacgccatccagcgtcgagtactcgtgcaccacgcccgcgatcgtcacttcggtcggcgcgtagccaaccatcgacgacagcagcacgcggcgaagcgcattgcccaaggtatggccgtaaccgcgttcgaacggttccatgaccaccctcgcgtggttctcgcccagcgattccacggcgatgatcttgggtttcagcaaactggtttgcatgggctttccttttcaataccctcggctcgttacaccgataaggctgaccggtaacaaccagaaaataaacagccgaggcccctccttgcgcaacgcaatcggggtacctcggccgtcaatcggattaacgcgaatacaattcgacgatcaggctttcgttgatgtcgcctgcgatttcagcgcgttccggcatttgcttgaacgtgccttcgaacttcttcgcatcgactgcaacccagctcggcatgccgccttgctcggccagcgacagcgcttcgacgatacgcgcttgcttcttcgccttttcgcggatcgcgacgatgtcacccgccttcacttgctgcgacgggacgtttgcgacgacgccgttcacggtgatcgacttgtggctcaccagctgacgcgcttcagcgcgggtcgagccgaagcccatgcgatacacgacgttgtcgaggcgcgactcgagcagttgcagcaggttttcacccgtgttgcccttgcggcggtcggcttcagcgaagtagcgacggaactgacgctccagcacgccgtagatgcgcttgaccttctgcttttcacgcagctgcgtaccgtagtcggacgtacgtgcgcccgaggtacggccgtgctggcccggcttgctgtcgagcttgcacttgtcggcgagcgagcggcgcgcgctcttcaggaacaggtcggtgccttcacggcgggacagcttggccttagggccgatataacgtgccactttgcattcctttatcaatcagtcacgcggatcgaaatccgcgctagttcgctccctttggggcgaacggtgggcttagtcaatcagcaacgcccgtcgacgctacgcggcgacaggcaatgtgccagcacgaacgtgccagcacacctttagatacgacgacgcttcggcggacggcagccgttgtgcggaatcggggtgacatccgaaatcgcggtgatcttgatgccgaggccgtgcagtgcgcgcactgccgactcacgacccgggcccgggcccttgatccgcacttccagattcttcacgccgtattccatcgcgacgcggccagccgactcggctgcgacctgggcagcgaacggcgtcgatttgcgcgagcccttgaagccctgaccgcccgacgtcgcccatgccagtgcgttgccttggcgatcggtgatcgtgatgatcgtgttgttgaacgacgcgtgaacgtgaaccacgccttcagcgacgttcttcttaaccttcttgcgaacgcgttgcgccgcggtgttcgaagccttagccattacgttttcctgtaactgtcagttccgcttacttcttcagcgcttgcgctgcacgacgcggacccttgcgagtacgtgcgttcgtacgcgtacgctgaccgcgcatcggcaggcccttgcgatgacgaacaccacggtagcaaccgaggtccatcaggcgcttgatgttcatcgtcacttcacggcgcagatcgccttcgacgacaaacttgcccacttcttcacgcagcttttccaagtctgcgtcggtcaagtccttgaccttcttcgaaaaatcgacgccagctgccacgcagatgctgcgcgaacgggtgcggccgataccgaagatagccgtcaggccgatctcggtatgctggtgattcgggatgttaaccctgcgatacgagccattgttttcctcaaacaaaagcgcaaacaaacgcgcggtcagccttggcgctgcttgtggcgcggatccgagctgcagatcacgcgaacgacgcctttgcgcttgatgatcttgcaattgcggcaaatgcgcttaaccgatgccatcactttcatgataataccctttttcaaatcacttcgcccggaacacgatccgcgcacgagacagatcgtaaggcgtcaattcaaccgtcaccttgtcgcccgggagaatgcggatgtagtgcatccgcatctttccggagatatgccccaacacgacatggccgttttccagcttcacgcggaaggtagcattcgggaggttttcgatcacctcgccttgcatctggattacatcgtctttggccatagtccttattaacgcattgggatgttgccgcccttgaagttagccttcttgagcagtgactcatactgttgcgacataacgtacgactgcacctgcgccataaagtccatcgtgacgacgacaatgatcagcagcgacgttccaccaaaataaaacggcacgttccagcgcagtaccaggaattccggcagcagacacacgaagacgatgtagatcgcaccggccagcgtcagacgcgtgaggatgcggtcgatatatcgtgcggtctgatcgcccggacggatacccggaacaaacgcgccgctcttcttcaggttgtctgcggtttcctgctgttgaacaccagtgcggtgtagaagaagcagaaaaacacgatcgccagcgtgtacagcaacacatagaccggctggcccggcttcagcgcttccgcaacgttatgcaacgtgttggaaatccagcttcccgtcggctgaccggtactgaaccagccgagaatcgttgccgggaacagaatgatcgacgacgcgaagatcggcggaatcacacccgacatgttcagcttcagcggcagatgcgacgactgcccaccgtagatcttgttgccgacctggcgcttcgcgtagttcacgaggatcttgcgctgcccgcgttcgatgaacacgaccagataagtcaccgcggcaatcaggacgacgatgatgatcgccgaaatgatgctcatcgaacccgtacgcaccagctcgaacaacccaccgacggcattcgggaaccctgctgcgatcccgccgaagatgatgatcgagataccgttgcccagaccacgctcggtaatctgctcgccgagccacatcaggaacatcgtgccggtaaccagcgtcacgaccgtcgtcagacggaacagcatgccgggatcggtgacgaggcccggctggttttccagcgcagccgcgataccgaacgcctggaaggtcgcgagcacgacggtgaaataccgtgtgtactgcgtgatcttccgttgccctgcctgcccttccttcttcagcgcctcgagctgcggcgatacgatcgccagcaactgcatgatgatcgacgccgaaatgtacggcatgatccccagcgcaaagatcgtgaagcgggaaagcgcgccacccgagaacatgttgaacatgcccaggatgccgcccgcctggctctggaacagcttagccagttgatccggatcgatgcccggcacggaatgtgcgcgccgatgcgatagacgatcagcgccaggagcaggaacatcgctcgccggcgcagatcgccgaatttcgccgtgcttcgaccgggttttgcaagactcgggctgttagccaagtaccttctccgatgaatgcaaatgacgacgcgctacgcgtgtcactcggcgaacgaaccgccagccgcttcgatcgcagcacgcgcacccttggtggcaccgagacccttcacgacgatcttgcgcttcagctcgcccgtcgcgatgatctttgcgctcttcgtcagctcgccgaccaggccggcttgcttcagtgcgagcagatcgatctcatcgaccggcagcttctcgaggtcgcccaggcgcacttcaccgacgaattccttcgtcagcgacgtgaagccgcgcttcggcagacgacgttgcagcggcatctgaccgccttcgaaaccgactttgtggaagccgcccgaacgcgatttctgacccttgtgaccacggccagccgtcttgccgaggcccgaaccgatgccacggccgacgcgacgcttggcgtgcttggcgccagctgccggcttcaggttattcaattccatatcaactccttgatccgtagggccgcttacgcgatgaccttaacgaggtacgagaccttgttgatcatgccgcggaccgccggcgtgtcctgaagctcgctgaccgagttgagtcggcgcaggcccaggccacgcacggtcgcgcggtgcgattcgcgggtcccgatcaggctcttaacgagctgaaccttgacagtttttcagacatggtgaccacccgggcttagcccaaaatttcttcgacggacttgccgcgcttcgccgcgatgtctgccggggtggactgcttgcgcagaccgtccagcgtggcgcgaacgaggttgtacgggttcgtcgaaccgtggctctttgccacgacgttctgaacgcccatcacgtcgaacactgcgcgcatcgggccgccggcgatcacgcccgtacctgccttcgccggagcgaggaggacagccgatgcgccatgcttgccgtgcacttcgtgttgcagcgtgccgttcttgagcggcaccttgaacatgttgcggcgagcttgttccattgccttctggacagcgaccggcacttccttcgccttgcccttgcccataccgatgcggccatcgccgtcgccaaccacggtcagtgcggcgaagccgagaatacggccacccttcacgaccttggtcacgcggttgaccgaaatcatcttttcacgaaggccgtcgtcgcgctcgtcagcctgaactttcgcttgcatctttgccatgacgaattccttccttagaacttgagcccagcttcgcgagctgcctcagccagcgccttgacgcggccgtggtagcggaagcccgagcggtcgaaggcgacggattcgatgccggcagcctttgccttctcggcaatacgcttgccgatcagcgtcgcggcattaacgttgccgcccttgcccgacttgtcggccagttcagcgcgcacttctgcttcgagcgtcgacgcgctggcgagcaccttggtgccgcagggcgagaacacttgagcgtagatgtgcgtgttcgtgcgatgcacggcgagacgcgcgacctgcagctcagcgatcttgatacgcgtctggcgagcgcggcgcaggcgagattgagtcttatccatgattgcgcacccttacttcttcttcgtttctttgaggatcacaacctcgtcggaatagcgcacgcccttgcccttgtagggctccggcggacggtaaccgcgaacttccgcagctacttgaccgacttgttgcttgttgatccccttgatcacgatttcggtttgcgtcggggtttctgccttgacgccttccggcatctggtgcaccaccgggtgcgagaaacccagcgacagattcagcttgtcgccttgcgcttgcgcacgataaccgacgccaaccagcgtcagcttgcgctcgaaacccttggtcacgccgtgcacggcattcgcgatgatcgcgcgcatcgtgcccgacagtgcatttgcttcgcggctttcgtccaccggcgacaggttcagcgtgccgtcgttgttcgccacgttcacgagcggattgatcgcttgcgtgatggtgcccagcgggcccttgacggtgatcgcaccgtcggccagcttgacttccgcgccttgcagcgcgatcgggctcttacctactcgagacatgtttctctctcctcggctttaagcgacgtagcagatgacttcgccgccgacgccggtagcgcgcgccttgcggtcggtcatcacgcccttcggcgtcgacacgattgccacgcccaggccgttcatgacctgcggaatgtcgttacggccgcggtacacgcgcagaccaggcttcgacacgcgctcgaggcgttcgatgaccgggcgacctgcgtagtacttcagcgcgatattcagttcggacttcgcaccttccgccttgacggcgaaatcgtcgatgtaaccttcgtccttcaggacttgcgcgattgcaaccttgaccttcgacgagggcatcgcaaccgataccttctcgaccatctgcgcgttgcggatgcgagtcagcatatcggcgataggatcactcatgctcatttacgtttctcctattaccagctcgccttggtcaggccaggaatctcgccacggaatgcgatttcacgaatcttgttacgcgcgaggccgaatttacggaacgtgccacgcggacggcccgtgatcgcgcagcggttacgctggcgggtcgggtttgcgttgcggggcagttgctgcagctcaaggcgtgcttcgtagcgctcttcttccgacttgctttggtcttcgacgatcgccttcagcgcatcgcgctttgctgcgaacttcgcgaccaggcgggcgcgcttcttttcacgttcgatcagtgccagtttagccacggtaacctcagtttctgaacgggaacttgaagctggcgagcagagcctttgcttcgtcgtcggtcttcgcagtcgtcgtgatgctgatgttcagcccacgcagtgcgtcgatcttgtcgtagtcgatttcggggaaaatgatctgctctttcacaccgatgttgtagttgccacggccatcgaaagcacgacccgacacgccgcggaagtcacgcacgcggggcagggcaaccgtcacgaaacggtcgaggaattcgtacattgcacggccacgcagcgtcaccatcgcgccgatcgggtaaccctggcggatcttgaagcctgcgattgccttgcgtgccttcgtcacgaccggcttctgaccagcgatcttcgtgaggtcgccgacggcgttctcgatgatcttcttgtcagcgatcgcttcgccaagacccatgttcagcgtgatcttggtgatgcgcggcacttccatgaccgacttgtaaccgaacttctcgatcaggccgggcacaaccttttctttgtaaaactcttgaaaacgagccatttttactccgctgcgtcaggcgctcagtacggcaccggtcgtcttcaggaagcgaaccttcttgccttcctcgaccttgatgccaacacgcgacgccttgccattcgcgtcgaccagtgcgacgttcgaaatatgcaggggcatcgtcttcgcttccacgccacccgtcgtacccttcatcgggttcggcttcacatgcttcttgacgaggttgataccttcaaccgtcacatgctctgcaccgacagccagcacgacgccgcgcttgcccttgtccttgccagtgacgacgatgacttcgtcacctttgcgaatcttgttcatcgcgactccttacagcacttccggcgccagcgaaacgatcttcatgaatcgttcgctacgcagctcacgcgtcaccggcccgaagatacgggtgccgatcggctcgagcttgttattcaaaagcacagcggcgttgccgtcgaacttgatcagcgagccgtcttgacggcgcacgcccttggcggtgcggaccaccacggcgttgtaaatttcgcctttcttcacgcgcccgcgcggcgttgcctctttgacgctcaccttgatgatgtcgccaatgccggcataacgacgcttcgagccgccgagcaccttgatgcacaggacttcacgtgcacccgtgttgtcggctacttcgagccgagattcggtctggatcatggtttgtctttcccaacttaatccggatgcaccaccatgatgcattcggtcagtcttggtcccgtcagccaatcggctgcttgggttggaacagcagcgacggcaaacgaaacccgccatcgcaattcggtgaatctttcggacaggcaggcgccagtccgcttccccaccaacttcgcccgcgacggggctcccataaagaggaagaccgggattataacaaataatcccggtcacgcaagcaaaaactttgcgatttcaagcacttcgtggagaagtgcctgttactgcctactgcgctgcccgcttagatgacgcgagctgcttcgacgaggcgcgacaccgtccaggccttcgtcttcgaaacaggacgagtttcctggatttcgacgagatcgccttcgttgtaggtgttcgcttcatcatgcgcgtggtacttcttcgagcgcacgacatacttgccgtagatcggatgcttgacgcggtgctcgatcagcacggtgacggtcttgtccatcttgttgctgacgacccgaccgaccagcgtccgcttcagcgaggttttcacgctatcgttcatttctggttcgccttctgagtcatgacggtccgcacacgtgcgatgtcgcgacgaaccttcttcagctggctcgtgttcgtgagctgctgggtcgcgagttgcatgcgcaggccgaattgcgccttcagcaggtccgccagctccttgttgagcgcggcctggtctttctggagaagttcggaagccttcatgttttctccttaggcgccgagctggcgcacgatgaatgccgtcttgagcggcagcttggtgcagccagacggaacgcttcgcgtgccagttcttcggttacgccgtccatttcatagagcatcttgcccggctgaatctcggcgacgtagtactccgggttacccttaccgttacccatacgcacttcggccggcttctgcgaaatcggcttgtccgggaagatccggatccagatgcggccgccacgcttgatgtgacgcgtcattgcacgacgtgccgcttcaatctgacgtgcggtcaaacgaccgcgaccgatcgccttcaggccgaattcaccgaacgacactgcgttgccgcgcgtcgccttgccggtgttacgacccttctgctctttacgatactttctgcgtttcggttgcagcatcgttattctccagtcttgccgtcttcgggcttgccggcgccgcggcgcggtgcgccacgacgagcacccggagcgccgccttcgccgtcacggcgcggacgacggtcgcccggacgcgcattgcgacgcggacgcttgtcttcggctacttcttccaccaccggtgcgtcgttgcggccgagcgtatcgcccttgtagacccacaccttgacgccgatgatcccgtaagtcgtcttcgcttccgaagtcgcgtagtcgatatcagcacgcagcgtgtgaagcggcacgcgaccttcgcgataccactccgtacgagcgatttcgataccgttcagacggcctgcgctcatgatcttgatgccttgggcacccagacgcatcgcgttctgcatcgcacgcttcatcgcgcggcggaacatgatccggcgctcgagctgttgcgtgatcgagtcagcgatcaactgagcatcggtttccggcttgcggatttcttcgatgttgacgtgaaccggcacgcccatgcggcgttgcagttccgtcttcagctgttcgatatcctcgcccttcttgccgatgaccacgcccggacgcgagctgtaaatcgtgatgcgcgcgttcttcgccggacgctcgatgacgacccgaccgaccgaagcgttcttcagcttcttcttcaggtactcacgaacaccgatgtcttcctgaagcatcgccgcgaaattgttgttgttcgcgtaccaacgcgaagcccaattgcggctgacagccaggcggaagccagtcggatgaattttctgtcccatcgtatggctccttaattcccgaccgtcacagtgatgtgacaggattgcttctcgatgcggttaccgcggcccttggcgcgcgcggtgaaacgcttgagcgatgcagccttgtcgacgtagatgctcttgatcttgagctcgtcgatatcggcgccttcgttgtgctccgcattcgcgattgccgacagcacaaccttcttcacgatgccagccgctttcttcggcgagaacgtcagaacgttcagcgccttgtcgaccggcaaaccgcggatctggtcagccacaaggcgcgtttttgcgccgagatgcgggcaccgcgatgaattgctttcacttccatcttgattgccccttatttcttggccttcttgtcggccgcgtgacccttgaacgtacgggtcagtgcgaactcgccaagcttgtggccgaccatgttttccgagatgtacaccggaacgtgttgacggccgttatgaacagcgatcgtcaggccgatgaaatccggcagaatcgtcgagcgacgcgaccaggtcttgatcggctttttgtcgcgcgaagctgcagccgcctcaactttcttcagcaaatgggcgtcgcagaacggacctttttacagaacgtgccattgcctactccttaacgcttgtgacggcgctggacgatcatcgtcgtcgtgcgcttgttgctacgggtgcgataacccttagccggcgtaccccacgggctaaccggatcgcgacctgcagccgtcttgccctcaccaccaccgtgcgggtgatcaaccgggttcatcgcaacgccacgcaccgtcgggcggataccgcgccagcggttcgcgccagccttgccgatctggcgcaggctatgctcttcgttgccgacttcaccgatcgttgcacggcactcgatgtgcacgcggcggatttcgcccgaacgcagacgaacctgcgcgtagacgccttcacgtgcgagcagcatggccgacgtaccagccgaacgcgccatttgcgcgcccttgcccggcagcatctcgatgcagtggatcgtcgtaccgaccggaatgttgcggatcggcagcgtgttgcctgcgcggatcggcgcctccgaacccgacatcagctgttggccgacggtcaggcccttcggggcgatgatgtagcgacgttcgccgtctgcgtagagcaccagcgcgatgttcgcgctacggttcgggtcgtactcgagacgctcgacctttgccgggatgccatccttcgtgcgacggaaatcgacgatacgatagtgttgcttgtgaccaccacccttgtgacgcgtggtgatacggccattgttgttacggccggcggtcgagctctgcgagtcgagcagtgccgcgaacggcttgccctggtgcaggttcttgttgaccaccttgaccatcgcgcggcgacccggcgatgtcggcttaactttaacgattgccatgattacttggcctccgcttcaaagttgatttcctggccgggcttcaggcaaacgtacgccttcttcacgtccttgcggcggcccatcgaacggccaaagcgcttttgcttgcccttctgaaccagcacgttgacggaatcaacttcaaccttgaacagcagctcgacagccgccttcacttcctgcttcgtggcatccggtgcgacttcgaacacgacttgctcgttcttgtcggcaaccagcgtcgccttttccgagatcaccggtgcgagcaggacctgcatcaaacgatgatcgttcttgcgaatctcgctcatgacagcaactcctcgatctgggcgaccgcagccttcgtgaccagcactttcttgaagtagatcagcgacagcgggtcagcgtagcgcggctcgacaattgccacgtgcggcaggttgcgcgatgccaggtacaggttttcgtcaaccgtgtcggtgatgatcagcacggagtcgagacccatggtcttgaatttgtcggccagcagcttggtcttcggcgcttcgaggatgatgtcctcgacgaccgacaggcggccttcacgggccagctgcgagaagatcgagcagagacctgcgcgatgcatcttcttgttgaccttgtgcgagaagttttcttccggcgaattcgggaagatacgaccaccgccacgccacagcgggctcgacgacataccggcacgagcacggcccgtacccttctggcgccacggcttcttggtcgtgtgcttgacttgctcacggtccttctgtgcgcggttaccctggcgagcattcgcctggtaagcgacgacgacctggtggatcagcgcttcgttgtagtcacgaccgaacacgacgtccgacgcgttgaccactgcaccttcctgaccattttcgttcaggagcttgagttccattatttcgcccccttggtcttgacggccggcgtcacgaagaccttgccgcccttcgcgcccggaatcgcacccttcacgagcagcagcttgcgctctgcgtcgatacgagcgatttcgaggttctgcaccgtcaccgtcacgtcacccatgtgacccgtcatgcgtttacccgggaaaacacgacccggatcctgcgccataccgatcgagcccggcacgttgtgcgagcgcgagttaccgtgcgtcgcacggccggaggagaagttgtaacgcttgatcgtaccggcgtagcccttaccgatcgacacgccttgcacgtcgaccttctggcccacttcgaaaagatcagcaccgaccacggcgccattcgacagctcagctgccttggccgcgtcaatgcggaattccttgaggatttcaccggcttcgacaccggctttggcgagatgacctgccagcggcttcgtcacgcgcgatgcacgacgggagccgaatgcaacctgcacggccgtgtagccgtcggtttcaacagtcttgatctgcgtcacgcggttgtccgacacgtccagcacggtgacgggaatcgaatccccttcagccgtgaagatacgggtcatgccaaccttgcgacctacgagtccaaggctcatcattttctccattcccgactgcgattggtcggggctgatttacaaaatgccgggcacgcaaggcccaactttttacgcgaatacgcgaaaagccaagcagtatagcccgactcctcgatttccgcaagcaatacaaagacttagcaccacccgacaagccggttggcgccgaaagccttactgcagcttgatttccacgtcgacgccagccggcaggtcgagcttcatcagcgcgtcaaccgtcttgtcggtcggatcgacgatgtccatcaggcgctggtgggtacggatttcgagctgatcgcgcgacgtcttgttgacgtgcggcgaacgcaggatgtcaaaacgctgaatgcgcgtcggcagcggcaccgggccacggacgattgcgccagtccgcttcgcggtatcgacgatttcggcagccgattgatcgatcagacgatagtcgaaagccttcaggcgaatacggattttctgttgctgcatgacgattccttgaaaagagcgaggcgatgttgcaccgccggacaccaaagaacgcgaaacctgctgcctgcggggagcgaagcgacaggttccgaacggtacttccactgctaagcccgcgattctacacgaaaaatcggagaggtggtgcgggtttgtcaatgtgcgcgacggcacgccataaagaaaaaccgggtgccagcgcaagctgaacacccggtttcgacggtacaactgcataccgcgggatcgcggatcccggaaggatccgcggatcgtcgatcttagtcgaggatcttggcgacgacgccggcgccgaccgtacggccaccttcgcggattgcgaagcgcagaccttcttccatcgcgatcggtgcaatcagcttcaccgtgatcgacacgttgtcgcccggcatcaccatttccttgtccttcggcagctcgatcgagcccgtcacgtccgtcgtacggaagtagaactgcggacggtagttgttgaagaacggcgtgtgacggccgccttcgtccttgctcagcacgtacacttcagccgtgaagtgcgtgtgcggcgtgatcgaacccggcttcgccagaacctggccacgctccacgtcttcacgcttcgtgccgcgcagcaggataccgacgttgtcgcctgcctgaccttggtccagcagcttgcggaacatttcaacgcccgtgcaggtcgtcttcaccgtcggcttgataccgacgatttcgatttcttcgccgaccttcacgatgccgcgctcgacacgacccgtcaccaccgtaccacggcccgagatcgagaacacgtcttccaccggcatcaggaacgcgccgtcaactgcacgctccggcgtcgggatgtacgtgtccagcgcgtctgccaggctcatgatcgccacttcgcccagctcgcccgtgtcgccttccagcgccagctttgccgaacccttcacgatcggcgtgtcgtcgcccgggaagtcgtacttcgacaggagttcgcgaacttccatctcgaccagctcgagcagttcagcgtcgtccaccatgtcgcacttgttcaggaacacgatgatgtacggaacgccaacctgacgcgccagcaggatgtgctcacgcgtttgcggcatcgggccgtctgctgccgagcaaaccaggatcgcgccgtccatctgcgctgcgcccgtgatcatgttcttcacatagtcagcgtggcccgggcagtcgacgtgtgcatagtggcggttagccgtttcgtactcgacgtgtgccgtgttgatcgtgatgccgcgcgccttttcttccggtgccgcgtcgatctggtcgtacgccttcgcttcgccgccgaacttcttcgtcagaaccgtcgtgatcgctgccgtcagcgtcgtcttgccgtggtcaacgtgaccaatcgtaccaacgttcacgtgcggcttggtccgctcgaatttacctttgccatgattctcttctttcaaaaattatcgattgagatagcgaattacttcgacttcgcgctgatgatcgcatcagcaacgttgcgcggagcttcagcgtagtgcttgaactccatcgtgtacgttgcacgaccttgcgtcagcgagcgcagcgacgtcgaatagccgaacatttccgacagcggcacttcggcgcgcacgatcttgccgccgccaaccatgtcttccatgccctggacgataccgcgacggcccgacaggtcgcccatcacgttgcccatgtagtcttccggcgtctcgacttcgacagccatcatcggctcgaggacgaccgggttcgccttgcgcattgcttccttgaacgccatcgaaccggccatgcggaacgcgttttcgttcgagtcaacgtcgtggtacgaaccgaacgtcaggtgaaccttcacgtcgacgaccgggaagccagccagcacgcccgacttcagcgtgtcctggatacccttgtcgaccgccgggatgtattcacgcggaatcacaccacccttgatctcgtcgaagaactcgtagcccttgccttgttcgttcggctcgagcgtgatgaccgcgtgaccgtactggccgcgaccacccgactgcttgacgaacttgccgtcgacgtccttcgccgtcgaacggatcgtttcgcggtatgcaacctgcggcttgccgacggttgcttccacgccgaattcacgcttcatccggtcgaccagaatttcgaggtggagctcgcccatgcccgaaatgatggtctggcccgactcttcgtcggtctgcacgcggaacgacggatcttcctgtgccagacggttcagcgccaggcccatcttttcctggtcagccttggtcttcggctcgacagcctgcgaaatcaccggctccgggaacaccatgcgctcgagcacgatcgggtttgccggatcgcacagcgtgtcgccggtggtcgcttccttcaggccgaccgcagcagcgatgtcgcctgcacggacttccttgatttcttcacgctggttcgcgtgcatctgcagaatacggccgaggcgttccttcttgcccttggtcgagttcagcagcgtgtcgcccgagttgacgacgcccgagtacacacggaagaagatcagctggccgacgaacgggtcggtcatgatcttgaacgcgagcgacgagaacttctcgtcgtccgacgccttgcgctccgcttcttcaccgttttcgagctcgcccttgaccggcgggatgtcgaccggcgacggcaggaagtcgatcacggcgtcgagcatacgctgcacgcccttgttcttgaacgcggtaccgcacagcatcggctggatttcgcacgcgatcgtacgatcacgcagcgccttgacgatgtcggcttccggcagatcgccttcttccaggtacttgttcatcaggtcttcgctggcttcagcagccacttcgaccatcttttcgcgccattccttgcaggtctctgcgagttcggccgggatgtcgacgtagtcgaacttcgtgccttgcgacgcttcgtcccaaatgatcgccttcatcttgatcaggtcgacgacgcccttgaagttttcttccgcgccgatcggcaccacgaccggaaccgggttcgccttcaggcgcagacggagctggtcgtagaccttgaagaagttcgcgccggtacggtccatcttgttgacgaacgcgagacgcggcaccttgtacttgttagcctggcgccacaccgtttccgactgcggctgcacgccgcccactgcgcagtacaccatgcacgcgccgtcgagcacgcgcatcgaacgctccacttcgatcgtgaagtcgacgtgacccggggtgtcgatgatgttgatgcggtgttccggatagttgccgcccatgcccttccagaaggccgtggtagcagcggacgtgatcgtgatgccacgctcctgttcctgctccatccagtccatcgtggctgcgccgtcgtggacttcaccgatcttgtggttcacaccggtgtaaaacagaatgcgctcggtcgtcgtcgttttgccggcgtcgatgtgagcgctaataccgatattgcggtagcgctcgataggagtcttgcgagccactttgatcctctactgggataacacgatgcagccctgctgcatcatgcttcaacacaaacgggcgaggcgcctgaaaagcgcacccgcccggaatttatttccgcaaacagcccagccaggcgcttagaaacggaaatgcgagaacgcgcggttggcttctgccatgcggtgaacttcatcgcgcttcttcatcgcgccgccacggccttcggccgcttcggagagttcacctgccaggcgcagagccatcgacttctcgctgcgcttcttcgcagcctcacgcagccagcgcatcgccaatgccatacgacgcgacgggcgcacttcgaccggaacttgatagttggcaccaccaacgcgacggctcttcacttcgaccaccggcttgacgttgttgagcgcaaccgtgaacacttccagcgggtccttgccacccttggtctggatctgttcgaatgcgccataaacgatgcgctctgcgaccgacttcttgccggacagcatcagcatgttcatgaacttggctacatcaacgttaccgaacttcggatccggcaacacttcccgcttggggacttcgcgacgacgcggcatgattcttcctttacttgttcagttggagctggaaccagctccgcggccaccaacaaacccgatcacatcttcacgactaaccagcttggccgggtgaccacttactcgacagcaccggcaatccggcactcccgccttgaccgccctgcggcgatccctgatcaaaaactgcttacttggcagcctttgcacgcttcgcgccgtacttcgagcgcgcttgcttacggtccttgacgccctgggtatccagcgagccgcgaaccatgtggtaacgcacacccggcaagtccttcacacggccgccgcggatcagcacaaccgagtgttcctgcaggttgtggccttcaccgccgatgtacgaaatcacttcgaagccgttcgtcagacgaaccttggcgaccttacggagtgccgagttcggcttcttcggcgtcgtcgtgtacacacgggtgcacacgccgcgacgctgggggcagtcctgcagggccgggctcttgctcttcgtcgtttccgactgacggcctttgcgaaccagttggttgatggttggcattgtttattcctgaaattgaacaaaatctgcacatcgatttcgggcaaagcgagaatcggcgcacagttgacttccgaaccggcgaaacgggtgcgagctttcgaacgcaactcggcccaccgaataccggaacccagcatcatattccggaaataccaactaagtcaacggcttgcgtgattcgccggccggacgcgtggtttaccggaagggtcggaacgcctgtgtcaggcagactcgacgacgtcgatgatctcgtcgccgaagcgctccagcttgcgcaccccatgccggggatatggcgcaggtcgtcgatcgtctccggcgcgttgcgtgcgatctcggcgagcgtcgcgtcgtggaaaatcacgtaggccggcacgccgtccgtcttcgccgtttccgcgcgccacgcgcgcagcgcatcccaccttgcgcgctcgcgcgtgcccatgccggccgtcggatcgacgcgcgtgccgctgcggcccgacgactggcgcgtgcgctgcggcttcacgtagcggcgcagcgtgaccttctcctcgttcttcaacaccggcttcgcggcctcggtcagcacgagtgcaccgaagccgccgtgatcgacggccaggtagccgtacgcgacgagctgccgaaatatcgcgcgccactcgggctccgacagcgacgcgccgatcccgaacgtcgtcagctggtcgtggccccgctgcaacaccttctcggtgcgcccgccgcgcaggatctcgatcaggtggctcgagccgaaattgaagccgctcgcgcgctgcgcgcggaacacgcacgacagcgccatctgcgcctcacgcgtcgcgtcccatgaagcgggcggctcgaggcacgtatcgcagttgccgcacggcttgctctcctcgccgaagtagttcagcagccgcacgcggcggcacgagatcgtctcgcacagcccgagcagcgcgtcgagcttcgacgtctggacgcgcttgtgtgcgtcgtcggcatccgattcgtcgatcatcttgcgctgctggacgacgtcgccgagcccgtacgccatccacgcattcgcgggcatcccgtcgcggccggcacggcccgtttcctggtagtagccttcgacgctcttcggcagatccaggtgcgcgacgaagcgcacgtccggcttgtcgatgcccatgccgaacgcgatcgtcgcgcacatcacgatgccttcctcgcgctggaacatttcctggtgcttctgccgcacctcgaactccatccccgcgtgatacggcagcgcacgcacgccttgcgccttcagccattcggccgtttcctcgaccttgcgacgcgacagacaataaacgacacccgcatccgtcgtgccgtcggcattcgtgtgttcggcgcggatgaaatcgagcagctgcgatcgcgcgttgtccttttcgacgatccggtagcggatgttcgggcggtcgaagctcgacacgaacacgcgtgcgtcgtcgagcgcgagacggtggatgatctcgtcgcgcgtgatcgcatcggccgtcgcggtcaatgcgatgcgcggcaccgacggaaatcgctcgtgcagcaccgacagctggatgtattccgggcggaaatcgtgcccccattgcgacacgcagtgcgcttcgtcgatcgcgaacaggccgatcttcgcgcgctcgagcaggtcgaggaagcgccccgtcatcagccgttcgggcgcgacatacagcaggtcgatttcgccttcgcgcagcgcccgctcggtcgccgcggcctcggcgcccgacagtgtcgagttcaggtacgccgcgcgcacgcccacttcgctcagtgcggcgacctggtcctgcatcagcgcgatcagcggcgacacgacgataccggcaccctgcccggcctcgcgacgcagcagcgccggaatctggtagcacagcgacttgccgccgccggtcggcatcagcacgagacaatcgccgccgccggcgacgtgttcgacgatttcgccctgctggccgcgaaaagcgggataaccaaatacttcgtcgaggatttcgagggcgcgggacatggaagaggacggggacggctggacgatgaccgcaattttaacaacccgctcgcgggacgcggggcgaatcgtgcggttttggccgatcggccagggttcgttcgcgtgcatgacgagcctgccacgaccgcgccgcaagtgattgcaacggcttcggcggcgcttgcagtcaggccgcacgtccgtcgcgagcaagcgaggccggcacggcacaggcgcgtcatgcaagcgaacgacagatgaaaaaccgcccggcaaaaccgggcggtctcggcgacagcgtggtgaggcaaggcggctcgcgccgcccgcgcttactcggctgccgggtgctgttgcggctcttccgcagcaggcgtgctcggcgtgccgaaatcgaacgcctcttccgctgcgatctggtcgaaacgctcgcgatccgacgattccttcgccttgcgtgccttgtggaacgcgagacccgtaccggccggaatcagacggccgacgatcacgttttccttcaggccgcgcagatcgtcgcgcttgcccatgatcgccgcttcggtcagcacgcgggtcgtttcctggaacgatgccgcggagatgaacgagtcggtcgacagcgatgccttcgtgataccgagcagcacgttgtcgtacgaagccggacgcttgtcctcggcgatcatgcgatcgttctcgtccagcatgtcggaacgctcgacctgttcgcccgggatgaagcgcgtatcgccgttgtcggtgatctgcacacgacgcagcatctggcgaacgatcacctcgatgtgcttgtcgttgatcttcacgccctgcagacgatacacgtcctgcacttcgtcgacgatgtagcgcgacagcgcctcgataccctgcagacgcaggatgtcgtgcggatcggccggaccgtccacgatcatttcgcccttgttgacgacctgggcatcgtgaaccagaacctgcttttccttcgcgatcaggaactcgtgctgattgccctcgagatccgtgatgacgagacgctgcttgcccttcgtgtccttaccgaacgacgtcgtaccggtgacttccgcgagaatgccggcatccttcggcgaacgtgcttcgaacagttccgccacccgcggcagaccgccggtaatgtcacgcgtcttctgcgcttccgtcgggatacgtgcgagcacttcaccgacctgcacttgctgaccatccttcacggtgatcagtgcgccgacctggaagccgatctgcaccgcgtgctccgtgcccggaatcttcacttcgtcgccgttcgcgtcgagcagcttgacctgcggacgcacgctcttcgaagcctgcgaaccacggcgcttcacgtcgatcacgaccagcgtcgacaggccggtcacgtcgtcgatctgcttcgcgacggtcacgccttcctcgacgttctcgaacttcaccgtaccaccgtactcggtgatgatcggacgcgtcagcggatcccacgtggcgagctgcgtgcctgccttgatcgtcgcgccgtcgagctgcagcagcgtcgcgccgtacggcactttgtgacgctcgcgctcgcgaccgaaatcgtcggtgatcatcgcttcgcccgaacgggaaatgacgatctgctcgcccttcgcgttcgtgacgtaacgcatcgtcgccgtgaagcggacgataccgttgctcttcgcttcgaccgacgaagccactgccgcacgcgatgccgcaccaccgatgtggaacgtacgcatcgtcagctgcgtgcccggttcaccgatcgactgtgcagcgatcacaccgactgcttcgccgacgttcacgagcgagccgcggccgaggtcacggccgtaacacgacgcacacagaccgtagcgcgtttcgcaagtcagcggcgtgcgcacgcgcacttcgtcgatgccgaggcgttcgatttcctcgaccgccgtttcgtcgagcagcgtgcccgattcgtacaccgtttcctgcgtttccgggttcacgacgtccgcaaccgcaacgcggccgaggatacggtcgcgcagcgcctcgacgacttcaccgccttcgacgagtgccttcatcgccacgccgttcgacgtgccgcaatcgtcttccacgacgaccagatcctgcgtgacgtcgacgagacgacgcgtcaggtaacccgagttcgcggtcttcagtgccgtatcagccagacccttacgtgcaccgtgggtcgagatgaagtactgcaacacgttcagaccttcgcggaagttcgcggtaatcggcgtctcgataatcgagccgtccggcttcgccatcaggccacgcataccggccagctgacgaatctgaaccgccgaaccccgggcgcccgagtcggccatcatgtagatcgagttgaacgactcctggcgcgtctcgttgccgtcgcggtccgtcaccggctccgtcgacagctgctccatcatcgccttgccgaccgcttccgacgttgccgaccagatgtcgaccacgttgttgtagcgttcctgcgcggtgacgagacccgacatgtactggcggtcgtactccttcaccttcttcgcggcgtcgccgacgatcgtttccttctgcggcggcacgagcatgtcgtccacgcagatcgaaatgccggcgcgcgtcgcgagacggaaacccgactgcatcagctggtcggcaaacaccaccgtcgcgcgcagaccgcacttgcggaacgccgtgttgatcaggcgcgagatttccttcttcttcagcggcttgttcagcaccgagaacggcaggccgtgcggcaggatctccgacaggatcgcgcggccgacggtcgtcgcgtacagcgagatcttcggcacgaacggcggcgcgccttccgacgtgtcttcgttgtggaccatttcggtgatccgcacgttgacgcgcgatgcgagctcgacttccttgttctcgtacgcgcggatcacttccgacacgcccgtgaacgacaggccttcgcccttgccgttgaccgcttcgcgggtcgcgtagtacagacccagcacgatatcctgcgacggcacgatcgacggatcgccgttggccgggaacagcacgttgttcgacgccagcatcagcgtacgcgcttccatctgcgcttcgagcgacagcggcacgtgaacggccatctggtcaccgtcgaagtcggcgttgaacgccgcgcagacgagcgggtgcagctgaattgccttgccttcgatcagcaccggctcgaacgcctggataccgagacggtgcagcgtcggcgcacggttcagcatcaccgggtgctcgcggatcacctcttcgaggatgtcccacaccaccggcgtctggttctcgacttccttcttcgcagccttgatggtcgtcgcgacgcccatcacttccagcttgttgaagatgaacggcttgaacagctcgagcgccatcagcttcggcagaccgcactggtgcagcttcagcgtcgggccgaccacgatgaccgaacggcccgagtagtcgacgcgcttgcccagcaggttctgacggaaacgaccgcccttacccttgatcatgtcggcgagcgacttcagcggacgcttgttcgcacccgtcatcgccttgccgcgacggccgttgtcgagcagcgagtcgacggcttcctgcagcatccgcttttcgttgcggacgatgatttcaggggccttcagctcgagcaggcgcttcaaccggttgttacggttgatcacgcggcggtacaggtcgttcaggtccgacgtcgcgaaacggccgccgtccagcggcacgagcggacgcagttccggcggcagcaccggcagcacttcgaggatcatccactcgggcttgatgcccgagcgctggaatgcctcgaggaccttcaggcgcttcgcgtacttcttgatcttcgcttccgagccggtgttcttcagctcggtgcgcagcgtctcgacctgctcgtcgatgttgatcgcgcgcagcagttcacgcacgccttccgcgcccatttcggcacggaattcgtcgccgtattcctcgaccttgttgtagtaatcctcttcggtcatgatctgccgcgccttcagcggcgtcatgcccggttcgatcaccacgtacgcttcgaagtacagcacgcgttcgatgtcgcgcagcgtcatgtcgagcaccatgcccagacgcgacggcagcgacttcaggaaccagatgtgcgcgaccggcgaggccagttcgatgtggcccatccgttcgcgacgcaccttcgccagcgtcacttcgacgccgcacttctcgcagatcacgccgcggtgcttcagacgcttgtacttgccgcacaggcactcgtagtccttgatcggcccgaagatcttcgcgcagaagagaccatcgcgttccggcttgaacgtacggtagttgatggtctccggcttcttcacttcgccgaacgaccacgaacggatcttgtcaggcgaagccagaccgatcttgatcgcgtcgaaaacttcttcctgttggacttgcttgaatagatcgagcagagctttcattgctttctctccgtagtccgattaattgcggtcgagatcgatatcgataccgagcgagcggatttccttcacgagcacgttgaaggattccggcatgcctgcatcgatcacgtggtcgcccttgacgaggttttcgtacaccttcgtccggccggtcacgtcgtccgacttcaccgtcagcatttcctgcagcgtaggacgcgccgtacgcttcgagtgcccacacttccatttcaccgaaacgctggccaccgaactgcgccttaccacccagcggctgctgcgtgacgagcgagtacgggccggtcgaacgcgcgtgcatcttgtcgtcgaccaagtggtgcagcttcaggtagtgcatgtagcccagcgtcacgcgacgttcgaacatttcacctgtgcggccgtcgtacagacggacctggttcttcgacgggttcatgccgagctgttcagcgatgtcgtccgggaacgcgaggtcgagcatcttgcccatttcttcctcggtcgcaccgtcgaacaccggcgtcgcaaacggcacgccttcgcgcaggttcttcgcgagttcgaggatctcgtcgtcggtgaagctttccaggtcttcctggcggcccgactcgttgtagatcttcgtcaggaacacgcgcagttcctcgatcttcgcctgacgctgcagcatttcgccgatacgccagccgaggcccttcgcagcccagccgaggtgcacttccagaacctgacccacgttcatccgcgacggcacgccaagcgggttcagcacgacgtctgccggacggccgtcggccatgtacggcatgtcttcgatcgggacgatcttcgacacgacacccttgttaccgtgacggcctgccatcttgtcgccaggttgcagacggcgcttcaccgcgaggtacaccttgaccatcttcagcacgcccggcggcagttcgtcgccttgcgtgagcttcttgcgcttctcttcgaacgcgaggtcgaactggtgacgcttctcttcgatcgagttcttgatcgcttcgagcgatgccgctgcttcgtcgtccgcgaggcggatgtcgaaccagtggtagtggtcgaggtcttccaggtaagcctggtcgatcttcgtgcccttcgcgagcttcttcggaccgccgttcgcgaccttgcccaccagcatgcgtgcgagacgctggaacgcgtcgccttccacgatgcgcagctggtcgttcaggtcgagacggtagcgcttcagttcgtcgtcgatgatctgttgcgcacgcttgtcgcgctggatgccttcacgcgtgaacacctggacgtcgatcacggtaccgctcatgcccgacggcacacgcagcgacgtgtccttcacgtccgaagccttctcgccgaagatcgcgcgcagcagcttctcttccggcgtcagctgggtctcgcccttcggcgtgaccttgccgaccagcacgtcgcctgcttcgacttcagcaccgatgtacacgatgcccgattcgtcgagacggccgagctggacttccgccaggttcgagatgtcgcgcgtgatttcttccggcccgagcttcgtgtcgcgtgcaacgacgttcagctcttcgatgtggatcgacgtgtagcgatcgtccgcaaccaccttctccgagatcaggatcgagtcttcgaagttgtagccgttccacggcatgaacgcgatcagcatgttctggccgagcgcgagctcgcccaggtccgtcgaggcgccgtcggccagcacgtcgccgcgcgagaccttgtcgcccatcttcacgatcggacgctggttgatgttcgtgttctggttcgaacgcgtgtacttgatcaggttgtagatgtcgacaccgacttcacctgcgaccgcttcgtcgtcgttcacgcgaatcacgatacggcctgcgtcgacatagtcgacgacgccgccgcggaacgcctgaaccgtcgtacccgagtcgaccgcgcaggtgcgctcgatacccgtcccgacgaccggcttttccggacgcagacacggcacggcctgacgctgcatgttcgaacccatcagtgcacggttcgcatcgtcgtgctcgaggaacggaatcagcgaggctgcaaccgacacgatctgcgacggcgcgacgtccatgtactggatacggtccggcgtgaccatcatcgtttcgccggcttcacgcgacgacacgagttcgtcgatcagcgtaccgttctcgtcgatcgcggcgttcgcctgagcgatcatgtagcggccttcctcgatcgccgacaggtagtcgatctggtcggtcaccttgctgtccacgaccttgcggtacggcgtctcgaggaagccgtactcgttcaggtgcgcgtacagtgcgagcgagttgatcagaccgatgttcggaccttccggcgtttcgatcgggcacacgcggccatagtgggtcgggtgcacgtcacgaacttcgaagcctgcgcgttcgcgcgtcagaccgcccgggcccagtgcggaaacacggcgcttgtgcgtgatttccgacagcgggttggtctggtccatgaactgcgacagctgcgacgaaccgaagaactcgcggatcgccgacgaaatcggcttcgagttgatcaggtcgtgcggcatcaggttttcgctttcggcctggccgaggcgttccttgaccgcgcgctcgacacgcacgagaccggcgcggaactggttttccgccagttcgccgacgcaacgcacgcgacggttgccgaggtggtcgatgtcgtccacttcgcccttgccgttgcgcagttcgacgaggatcttgatcgtcgcgaggatgtcgtcgtcctgcagcgtcatcgggccggtgatctcgtcacggctgacgcggcggttgaacttcatgcggccgaccttcgacaggtcgtacgcttcttcgctgtagaacagacgattgaacagggcctcgaccgcttcttcggtcggcggctcgcccggacgcatcatgcggtagatcgcgatgcgcgcggccgtcttgtcggtcgtttcgtcgacacgcagcgtcgacgaaatgtacgggccctggtccaggtcgttcgtgtagagcgtctggatgtctttgatgcccgcttcgcgcagcttctcgagcacgctttccgtgacttcgtcgttcgcgctcgcgatcacttcgccggtgtcgccgtcgacgacgttcttcgccagcacgcggccgagcagatagtcttccggcaccgagatgaacttggtcttcgcggcttcaagatcgcgaatgtgcttcgcgttgatccgcttgtccttctggacgatgaccttgccatcacgatccgtgatgtcgaaacgcgcgacttcaccacgcaggcgctcgggcacgaactcgagttgtgcgccttcgtccatcagcgtgaagttgtcgaacacgaagaagttcgcgaggatctgttccggcgtcaggccgatggccttcagcaggatcgtgaccggcatcttgcggcgacggtcgacgcggaagtacaggatgtccttcggatcgaattcgaagtcgagccacgagccgcggtacggaatgatccgtgccgagaacagcagcttgcccgagctgtgcgtcttgcccttgtcgtgttcgaagaacacgcccggcgaacggtgcagctgcgagacgatgacacgctcggtgccgttgatgacgaacgagcccgtcggcgtcatgagcggaatttcgcccatgtacacttcctgctctttcacttccttgacgaccggcttgttcggcgattccttgtcgaggatgacaaggcggaccttcgcgcgcagcgcggagcagtacgtcaggccgcgctgctggcattccttgatgttgaatgccggcgcggacaacgcgtagctcacgaactcgaggcgcgcgaagccgttgtgcgaaacaatgggaaataccgatgtgaacgcggcctgcaaaccttcaggcttgcgttgcgtggccggcacatcggcttgcagaaacgtgctgaatgattcaagctgggtagccagcaagaaaggaacttggtgaacgatggggcgcttcgcgaaactcttgcgaatgcgcttcttctcggtgaaggaatattgcatacgatctccgaatcacggcgggtgctatcgaggcggaatacctggacgtttcaaacccgagtgttcaccgactgagacccgatggccgtccgacggcttgaacgagccgagaagcttggtggttggccgctaccaaccgctggctgacggcagcggatgcctgtgttgcccgctacccgaccaaacttgccttctgcagtcgcttcagaagacaaagagaaccgccattcgtgaccaatcacaacgatcaggcggttttctttggcttctggggccgattattcgggctcccgaatgagtgccagaataacgtccccacaaagcacaaaaaggccggcggtgaaaataccgccagccttcgcacagcgcgccgaaacttacttgacttcgaccttcgcgccagcttcttccagcttcttcttggcttcttcagcagcagccttgtcgacgccttccttgacagccttcggtgcgccgtcaacgacgtccttcgcttccttcaggcccaggcccgtcagttcgcgaactgccttgatgactgcaaccttgttgctgcctgcttcagccagaacgaccgtgaattcggtcttctcttctgcagcagcagcagcgccgccgcctgccgggccagcgactgccactgcagctgccgacacgccaaacttctcttcgaatgccttgaccagttcgttcagttccagaacggtcatcccttcgactgctgccaggatgtcttctttgcgattgccatttgaaatactcctaaattgaattcggatacagccagcgatcaatgacgctgatgcacgttcgattacgcagcttccgcttgcttcttctctgccagcgcggccagggcacgcgcgaagcccgaaacaggcgattgcataacgaacagcagcttcgagagcagttcttcgcggctcgggatgcttgccagcgcttgcacgccagccttgtccatcaccttgccatcgaacgaaccagccttgatgaccaacttgtcattgctcttgctgaagtcgttgacgaccttagcagcagcaattgcatcttccgagatgccgtagatcaacgggccagtcatctgctctgccagcggagcaaacggcgtaccttcaacggcgcggcgcgccagcgtgttcttcaacacgcgcaggtaaacctgttgctcacgcgcttgcgcgcgcagcttggtcagatcgccaaccgcaattccacgatactcagccagcacaacggtctgggccttcgcgacttgcgcggaaacctcagcgacgacggcttgcttgtcttctctattaagcggcacggttagcctccagaaacgatacgttcggcacgaaacctcacgtacctcgttcaacaacggcgtccgacctcgttaggagtatttccacctcatgccgcgaatcgcttcacggcctgcggcttcaccactgcaaaactttttcgggttcgccatctgcgttggcttgaattaagggatcacctgactgctgcgccccaccaacggtctttgataaccggttgcccgccctgcctgcacgaacaaccgcccaaagcccatgtaggccgcttcgcgaacgaagcggcccgaaatcttgcttactgtgctgccagcgtagcctggtcgacacgcacgccgacgcccatcgtgctcgacagtgcgatcttgcgcaggtagacgcccttgctcgttgccggctttgccttctgcagcgcttcgatcagcgccgacaggttcgaacgcagtgcggtcggctcgaacgatgcacggccgatggtcgcgtggatgataccggccttgtcgacacggaattgcacctgaccagccttcgcgttcttgacggcggttgccacgtccggcgtgaccgtaccgaccttcgggttcggcatcaggccgcgcgggccgaggatctgacccagcgtaccgacgatacgcatcgtgtccggcgaagcgatcacgatgtcgaagtccatctggccagccttgatctgctcagccaggtcttccataccgacgatttccgcgcctgctgcacgagcttgctcagccttctcgccttgcgcgaacactgcaacgcgaaccgacttgcccgtacctgccggcagaacgaccgaaccgcgaacgacctggtccgacttcttcgcatcgatgccgagctggactgcgacgtcgatcgactcgtcgaacttcgcgctcgcgcattccttcacgaggctcagtgcgtcttcgatcgcgtacagcttctgacgatcaaccttggcggcaaatgcctgacggcgcttggagatcttagccatttacacgccctccacagtgatgcccatcgagcgtgcgctaccagcgatggtgcgaacggctgcgtccagatcagctgccgtaaggtccggcatcttggtcttcgcgatttcttcggcttgagcgcgcgtgatcgaaccgaccttgtcggtgtgcggcttgctcgagcccttgtccaccttcgccgccttcttgatcaggacggtcgccggcggcgtcttcatcacgaacgtgaagctcttgtcagcgaatgccgtgatgaccaccggcaccggcagacccggctccatgccttgagtctgcgcgttgaacgccttgcagaactccatgatgttcaggccgcgctggcccagtgccggaccgaccggcggcgacgggttggctttacctgcagggatctgcagcttgataaagccgataatcttctttgccatttgtgaacctcattggaacgccggaagggcgttcggtgagtgataacgcgctttcgcctctggctactgacgctcctcaacggccatgacgcgggccgtagcgcgaaggtgggcagccgaggctgcccaccgaatcgggatcaaactttttcgacctggccgaactcgagttcgaccggagtggatcggccaaagatggtgaccgacacacgcacgcgcgatttttcgtagttgacttcttcgacggtgccgttgaagtccgtgaacgggccttccttgacacgcaccatctcgccgacttcgaacagggtcttcgggcgcggcttctcgacgccttcctgcatctgcgacatgatcttctcgacttccttcgggaaatcggggtcgggcggttacgtgcaccgccgacgaaaccggtaaccttcgcggtgttcttcacgaggtgccacgtttcgtccgtcatctccatctccaccagcacgtagccggggaaaaatcgacgctcggttactgccttgtggccgcctttgacttcgaccacttcttcggtcggaaccaggatctgaccgaatttgtcctgcatgccagcacgttcgatgcgctcctgaagcgcacgttgcacgctcttctccataccggagtaggcgtgcacgacgtaccaacgttttccgctcggggatgccggagtatcgctcatatcatttccaacccagaatcgccgagaaaatcacccattcgatcgatttgtcactcaaccagaggaaaatcgccatcacgagcacgaaaccgaacacgacgagtgtggtttgcgttgcttctttgcgggtgggccaaacgaccttccggacttccttgtacgaatccttggcaaaggcgatgaggctcttgccaggggcggacatcagcccgacggccacgccggcgatgatccctaccgccaacgcggcaccgcggacataccactgctgattggccagccagaagaagcccacgaatccggccaagaccaacaatacgcccagggccagcatcagcttatcgccggaggtatttacagtttcgacggatggattcgccataacaccttaaaacaaatgccacgtagaacacgtggctatttttggcaggggcagagggaatcgaaccccaaccttcggttttggagaccgacgctctgccagttgagctataccctaaaccatactggggctggctgttgccagccccaaaactgtcgatcaacgaataactggcttactcgatgatcttggcgacgacgccggcgccgaccgtacgaccaccttcgcggattgcgaagcgcagaccttcttccatcgcgatcggtgcaatcagcttcaccgtgatcgacacgttgtcgcccggcatcaccatttccttgtccttcggcagctcgatcgagcccgtcacgtccgtcgtacggaagtagaactgcggacggtagttgttgaagaacggcgtgtgacggccgccttcgtccttgctcagcacgtacacttcagccgtgaagtgcgtgtgcggcgtgatcgaacccggcttcgccagaacctggccacgctccacgtcttcacgcttcgtgccgcgcagcaggataccgacgttgtcgcctgcctgaccttggtccagcagcttgcggaacatttcaacgcccgtgcaggtcgtcttcaccgtcggcttgataccgacgatttcgatttcttcgccgaccttcacgatgccgcgctcgacacgacccgtcaccaccgtaccacggcccgagatcgagaacacgtcttccaccggcatcaggaacgcgccgtcaactgcacgctccggcgtcgggatgtacgtgtccagcgcgtctgccaggctcatgatcgccacttcgcccagctcgcccgtgtcgccttccagcgccagctttgccgaacccttcacgatcggcgtgtcgtcgcccgggaagtcgtacttcgacaggagttcgcgaacttccatctcgaccagctcgagcagttcagcgtcgtccaccatgtcgcacttgttcaggaacacgatgatgtacggaacgccaacctgacgcgccagcaggatgtgctcacgcgtttgcggcatcgggccgtctgctgccgagcaaaccaggatcgcgccgtccatctgcgctgcgcccgtgatcatgttcttcacatagtcagcgtggcccgggcagtcgacgtgtgcatagtggcggttagccgtttcgtactcgacgtgtgccgtgttgatcgtgatgccgcgcgccttttcttccggtgccgcgtcgatctggtcgtacgccttcgcttcgccgccgaacttcttcgtcagaaccgtcgtgatcgctgccgtcagcgtcgtcttgccgtggtcaacgtgaccaatcgtaccaacgttcacgtgcggcttggtccgctcaaacttttccttggccattttcaactcccaaaaggaatttcacaggttgcgccgcgcgcaaacaacaagacactgactttttactgctggtgcccatgggcaggatcgaactgccgacctctcccttaccaagggagtgctctaccactgagccacatgggcgctttacgcttcaacttcgcggtctggagcgggtgaagggaatcgaaccctcgtcgtaagcttggaaggcttctgctctaccattgagctacacccgcacgggccacaaacgattccttaccgctcactgcgctgatatcttggtggaggaggttggattcgaaccaacgtaggcgtaagccaacagatttacagtctgccccctttagccactcgggcacccctccgtagagaactgacgattatgggggtacatcgcacccctgtcaagcacatccggaagattattttcactctcttcccgatgcctgcctgaccactaatctcccgcccttgcccggctaaggcaagcatgggtgctaccgaccagtgtcacatcttcgtcagactccgctttcagcgtcgatctgcatctgcgccgaaaacgaaagaccgccatcatacgatctcttgagcactctgccaagcgggtagatgcaaaatttccgcaaatttcgtgccgggcggacaccatgatctgttttagatacctcctgggagtccatagctggtttctcgggttgcctggcccgacccgccagcgattgacgtgacacggctttctgacactttccagcaatcgcatcatgagtttgagcaacgcttccaacgagaaatcgcgatggcggcgctagactttgccaacgtcagcgacaggagcaatggcgtcccgggccacctgcccgccctgattcgtatcttcatgcgtctgcttgctctttttccggccttcatggttttgatcgcacatgccgccgggccggcagacgcccgtgtcgcccgagcacgatcacctggatccgtctggaggcgccagctgatagccacgcctcgggatgcccggcagcagccgcgccgctcgtcgcatatgagaggttgaagcccacgcacaataccggtgcctcggctcggtacacgtctggtcggccggggcaacctcgtggagtcagcatatgcatggctgatcaacgatgccgccatgtacgtcatcgccgccggcgctggtgatgacgcgtcgacaggcgaatcctgcagcccagcctgcgtcgacacattgcagccatttcttggcgacgacacacggccgcgccgggagctgccacgcaggtttgtccccgcaatctctgcgaacgttctacagtgcacggcccactgcacttcgccgccgcgcgaaccgaccaaagtcggcatctggccgacctatcgcggcgaatacacaaggcatccccatgcacgtacgatgttcgcctcgtgcagctgaacaccgatacctgcgcaggattcggcgcctgcgcgttttccgcatcgcactcatccgaagacgcgggaaagcaggcccacgacctccacacttccacgaccgctgcgagctgcccggcagtgctcgcgtcgaccagggatcaaggcctgaatacgacgcgccggtttacgccgggcaatgactccgcactctccgatccggataccgcatgcagggcgcgatcgactgacgtcgatgcgggggcacgctcttcacatcgataggtgaagggcgggactgctttggcggcgccgcctattcgctcattaaaagtgtacgtgtttcgggacgggcagccagcgctcatcaaaagaaccggcgcgaatttctgatggcatctggttgaggaatttgcgtacgtccggttcgcgctatgcgtcaacgacttccgcgtggcacgccggaagcgccaatttttgaacgggtcgatttgagagaagatgcgacgagtcgagaaacaaacaagccaagatcactacgagatgtcatcttgggcaaaatccgactttgtgcgctcgattggcagcagtcgcctggagctttcggcaaaggacgccaaacggcggatttgcgccactcgttgcccaggtcaccctgatggctcatgtcgggaaccgccaggcgcgaccctctgatacgaaatggcaacgacgattgtgggcggagaagtgctcaatacgccgaggaaccgcgcacaataaccggcattcgcgcagcaggccatgccactctaggtcgtaaccagcaacgcacgaatctgcggcgagaagtggtcaaaaatgcggcggagtcgcgactcgatccgatctcctctccgtgaacagcaagtggatggatgtttggatggtaggtcttggccggcgccagctagcggtgcaaggccaacccgatcggtcggtctgatcgcctttgcgtcagtctcgcagaggcaatcctggagaatcggcaccccggccccagctcgagcagcggccaggccaccgatcccgatcactcgcgcatttccgccgctggaatgcaaaaaccccgccttttgggcggggtttctggcttaggagcctgacgattacctactttcacacgggaatccgcactatcatcggcgtagagtcgtttcacggtcctgttcgggatgggaaggggtgggaccgactcgctatggtcatcaggcaaagagggttgttgcgctggcttcgcagcacaaccaatcttggaagaagcagtaattttgagttgtgtgtatcacacacgagaatccaacttgtcgcttggatcctgcggccggtgctgtcgcacggcgccgatctacaaggcagacttgttataggatcaagccttacgggcaattagtatcagttagctgaacgcattactgcgcttacacacctgacctatcaacgtcctggtctcgaacgacccttcaaggggatctagtccccagggatatctcatcttaaggcgagtttcccgcttagatgctttcagcggttatctcttccgaacatagctacccggcgatgccactggcgtgacaaccggtacaccagaggttcgtccactccggtcctctcgtactaggagcagccccttcaaatatccaacgcccacggcagatagggaccaaactgtctcacgacgttttaaacccagctcacgtacctctttaaatggcgaacagccatacccttgggaccggctacagccccaggatgagatgagccgacatcgaggtgccaaacaccgccgtcgatatgaactcttgggcggtatcagcctgttatccccagagtaccttttatccgttgagcgatggcccttccatacagaaccaccggatcactatgacctgctttcgcacctgctcgacttgtcggtctcgcagttaagcacgcttatgccattgcactatcagcacgatttccgaccgtacctagcgtaccttcgtactcctccgttacgctttgggaggagaccgccccagtcaaactgcctaccatgcactgtccccgacccggatcacgggccaaggttagaacctcaaacaaaccagggtggtatttcaaggacggctccaccgaaactagcgttccggtttcatagcctcccacctatcctacacagatcggttcaaagtccaatgcaaagctacagtaaaggttcatggggtctttccgtctagccgcgggtagattgcatcatcacaaacacttcaacttcgctgagtctcgggaggagacagtgtggccatcgttacgccattcgtgcaggtcggaacttacccgacaaggaatttcgctaccttaggaccgttatagttacggccgccgtttaccgggacttcaatcaagagcttgcaccccatcatttaatcttccggcaccgggcaggcgtcacaccctatacgtccactttcgtgtttgcagagtgctgtgtttttattaaacagtcgcagccaccagtttattgcaaccccttcaccctcctggcgcaggccagtcaagctacaagggcgtaccttatcccgaagttacggtaccaatttgccgagttccttctcccgagttctctcaagcgccttagaatactcatctcgcccacctgtgtcggtttgcggtacggtcatcgttagactgaagcttagaggcttttcttggaaccacttccaattgcttcgcttccgaagaagctcgcgccacacccttgaattacgcacccggatttgcctaagtgccttctccaatgcagcgaccgggacttccaacacccggacaaccttccgcgatccgtcccccatcgcatctaacaatggtgcaggaatattgacctgcttcccatcagctacgcatttctgcctcgccttaggggccgactcaccctacgccgatgaacgttgcgtaggaaaccttgggcttacggcgagggggcctttcacccctttatcgctactcatgtcagcattcgcacttccgatacctccagcaccctttacaaggcaccttcgcaggcttacggaacgctctcctaccatgcgtgcaagcacgcatccgcagcttcggtatatagcttagccccgttacatcttccgcgcaggacgactcgatcagtgagctattacgctttctttaaagggtggctgcttctaagccaacctcctgactgttttagccttcccacttcgtttcccacttagctatatttggggaccttagctggcggtctgggttgtttcctcttgacaccggacgttagcacccgatgtctgtctcccgtgattgcactcttcggtattcggagtttgctatggcggggtaatctgcaatagacccccaaccatgacagtgctctaccccgaaggtgagacacgaggcactacctaaatagttttcggagagaaccagctatttccaggtttgtttagcctttcacccctatccacagctcatcccctaacttttcaacgttagtgggttcggacctccagtacgtgttaccgcaccttcatcctggccatggatagatcacctggtttcgggtctacgcccagcaactgaacgccctattcggactcgctttcgctacgcctgccctatacggttaagcttgctactgaacgtaagtcgctgacccattatacaaaggtacgccgtcaccccttacgaggctccgactgtttgtatgcatgcggtttcaggatctatttcactcccctcccggggttcttttcgcctttccctcacggtactggttcactatcggtcgatcacgagtatttagccttggaggatggtcccccatcttcagacaggatttcacgtgtcccgccctacttgtcgcacacctagttctttcatactgttttcgcctacagggctatcacctgctatggccgcactttccagagcgttcggctaacaatacaaataaagagtgcaaggctcatcccatttcgctcgccactactttgggaatctcggttgatttcttttcctgcggttacttagatgtttcagttcaccgcgttcgcttcacatggcctatgtattcagccatggatactccaaaaggagtgggtttccccattcggacatctacggatcaaagctcgtttgccagctccccgtagcttttcgcaggctaccgcgtccttcatcgcctgtgatcgccaaggcatccaccacatgcacttgttcgcttgaccctataacgagtctgtctcatcgacagtcgctacaggttgagttctcgcgttgtgccgtattccaattgagtcaaacttagagttcgaatcatcttgagatacatcgatacaatcacaacccggatagttttcacgtccatctcaagacgcttccgctatccaaattacttacttcttccagattgttaaagaacgacagccgatactttcgtaccgctctgactggctcaatcgccaatgcaaaattctcggttcatcgtatgaaccaagcacttagcgttggtgattggtggaggcagacgggatcgaaccgacgacccctgcttgcaaagcaggtgctctcccagctgagctatgcccccattgagtacagataccctcaggtgttaccgccagacaatggtgggtctggttggattcgaaccaacgacccccgccttatcaagacggtgctctaaccgactgagctacagacccctgagtctgtctttaatttacagccgataagcgtgagcgctcaattttgcgagaagctctggaaaggaggtgatccagccgcaccttccgatacggctaccttgttacgacttcaccccagtcatgaatcctaccgtggtgaccgtcctccttgcggttagactagccacttctggtaaaacccactcccatggtgtgacgggcggtgtgtacaagacccgggaacgtattcaccgcggcatgctgatccgcgattactagcgattccagcttcatgcactcgagttgcagagtgcaatccggactacgatcggttttctgggattagctcccctcgcgggttggcaaccctctgttccgaccattgtatgacgtgtgaagccctacccataagggccatgaggacttgacgtcatccccaccttcctccggtttgtcaccggcagtctccttagagtgctcttgcgtagcaactaaggacaagggttgcgctcgttgcgggacttaacccaacatctcacgacacgagctgacgacagccatgcagcacctgtgcgccggttctctttcgagcactcccacctctcagcaggattccgaccatgtcaagggtaggtaaggtttttcgcgttgcatcgaattaatccacatcatccaccgcttgtgcgggtccccgtcaattcctttgagttttaatcttgcgaccgtactccccaggcggtcaacttcacgcgttagctacgttactaaggaaatgaatccccaacaactagttgacatcgtttagggcgtggactaccagggtatctaatcctgtttgctccccacgctttcgtgcatgagcgtcagtattggcccaggggctgccttcgccatcggtattcctccacatctctacgcatttcactgctacacgtggaattctaccccctctgccatactctagcctgccagtcaccaatgcagttcccaggttgagcccggggatttcacatcggtcttagcaaaccgcctgcgcacgctttacgcccagtaattccgattaacgcttgcaccctacgtattaccgcggctgctggcacgtagttagccggtgcttattcttccggtaccgtcatccccgactgtattagagccaaggatttctttccggacaaaagtgctttacaacccgaaggccttcttcacacacgcggcattgctggatcaggctttcgcccattgtccaaaattccccactgctgcctcccgtaggagtctgggccgtgtctcagtcccagtgtggctggtcgtcctctcagaccagctactgatcgtcgccttggtaggcctttaccccaccaactagctaatcagccatcggccaaccctatagcgcgaggcccgaaggtccccgctttcatccgtagatcgtatgcggtattaatccggctttcgccgggctatccccactacaggacatgttccgatgtattactcacccgttcgccactcgccaccaggtgcaagcacccgtgctgccgttcgacttgcatgtgtaaggcatgccgccagcgttcaatctgagccaggatcaaactcttcagtttaaacctgttactgttttcggttcggttaagaaccggtcgctcactcaaagctgacaggaatatgaatcacttcataaacctgacttactttagtgtgagactcttgatacttttgctatctgatccgaggatcagctcgcttccatcaagcgcccacacttatcggctgttaatttttaaagagcaatctgcgaggaacttcgtgtttcccggcagcgctgcgttttcagcagcagagaagcgagattatgaaccgtgtttcgcagctcgtcaacaactttttacactacatcgttgcgactgcggggttcaacttccaggccagccgcgtgcccgacactgcagcacaccaccagcttcgcttccctctcccgcgccgcgtttccgttagcgcgaaagaggcgtgattctaagcacccgcccccatctgcgcaagccctttgtgaaaatattttgagaaggccccgtgcgctggcgcgcacggggctggggctcggcgggccgccggtggccatcgaccacaaggggccggcaacacttcctctatatatagaagctcattacttgccacccaccgcggtctgcagttgctcaatcggcaccgcgtcggccatcgccgtgtatccagcgtcgctcggatgaatgccgtcgccactatcgaatcgacgctgcagcacgctcgggcgcgccggatcgcgcagcaccgcgtcgaagtccactacgccgtcgaacccgccaccgctccggatccaccggttcacctcgagccggagcgcctcgcgccccgccggcagcccggccggcgtcagcgtcgcgccgaagaccttcacgccctgacggtgcgccgcgtcgatcagtcggcggtagccgtcgatcagcgatgcagccgtgacctgcgtatgcgggtggtcgcaatcgagccccgcgcgcggcggcatcgccgcaaaattgatgtcgttgatcccgatcagcacgatcgccgcccttacgcccgcgcgcgacagcgcatcgcgctcgaaccgcgacgccagcgacgtgccatagcaagccgaatcgctgagcagccggtttccgctgatcccgagattcgcgacgccgatcgattccgcgcccgaggcagccagccgacgcgccagtgcgtccggccagcggcggttccggttcacgctcgagcgcagcccgtcggtgatcgaatcgccgatcgcggctacgctggcgcgcgcggaaccagtctcgaccgcgagctcggtcacccatgcaaattgggtaaagcgggtgcggaacgcggcagccccggatcactcacgtgctcgcccggcaccgacacataattaaactggttcgacacgcggtgccagaccgtcatccgctggttcggccccatctggaggctgatcgcatacggctgcccggccctgacgtcgatccccaccggatcgctttcgagttcctggcccggcgcaagcgtcaccgacaccttgccgccgaaccggaccggcgcggccgcatcgccggacagcgccgcgccttcgccagcgcgcgcgacgctcgccgcctcgacgacgaggggaaacgaccgtatgcattgctgacgcggatccgtgcggcgcgccccgacactgtcggatagacgatctggcgcaccgtgcgaccggcaacgtcgggcgcgcgataaagcggcggcggtgcggcaaggtcgggaatcggctgcaacgcggtcgcccacgcggcaacccatccgccggcgcggccgaagccgacgccacgagcggcgagacaaaagcggccgcacccagcacggccgcggcgatactgcttcggaatgacatcggcaaaatcctcgtcggaaagcgggcattgtgccgcagaaggcgcagctcccgcgtgccggccgccatcacgcagcaccatcgcgccccgatgtccctcgtttacccgagtctttccgcaaatccgcaagaaatttattaaccgaccggtcggttggtttatacttcgcacacattcaaccggacgagagcctcgccatgtacacgcaatccctcgacatccccggcaacgtcgcgccgctcgacgccgcagccgagtcgcccgagcaggcgcggttcgatgcggtcatggccgccgacggcaagatcgaaccgcaggactggatgcccgacgcctatcgcaagacgctggtccgccagatctcgcagcacgcgcactcggaagtcgtcggcatgctgccggaaggcaactggatctcccgcgcgccgagcctgaagcgcaaggcgatcctgctcgcgaaggtccaggacgaagccggccacggcctctatctttatagcgcggccgaaacgctcggcgtatcgcgcgattcgctgatcgacgcgctgcacgcaggcaaggcgaaatactcgagcatcttcaactacccgacgccgacctgggccgacgtcggcgtgatcggctggctggtcgacggcgccgcgatcatgaaccagatcccgctgtgccgctgcacgtacggcccgtacgcgcgcgcgatgatccgcgtgtgcaaggaagaatcgttccaccagcgccagggcttcgacgcgctgctgtcgatgatgaagggcagcgacgcgcaacgcgcgatggtccagcaggccgtgaaccgctggtggtggccggtgctgatgatgttcggcccgagcgatgccgattcggtccacagcaaccagtccgcgaaatggggcatcaagcggatcacgaacgacgacctccggcaaaaattcgtcgacgcgacggtcgaccaggcgaaggtgctcggcgtgacgctgcccgatcccgacctgaagtggaacgaagcacgtggccaccacgactacggcacgatcgactgggacgaattctggcgcgtggtcaacggcgacggcccgtgcaacaaggaacgcctcgcgacccgcgtgaaagcgcacgaggacggcgcatgggtgcgcgaagccgccctcgcccacgaagcaaagcgccgcgcgcgccgaacagcacgccgcctgagcggcacaccatcgaattcaggattcaggagaaagtgatgaacaaggaatggccgatctgggaagtgttcgtgcgcagcaagcaggggctcgaccacaagcattgcggcagcctgcatgccgccgacgcgtcgatggcgctgcgcatggcgcgcgacgtctacacgcgccgccaggaaggcgtgagcatctgggtggtgccgtcgtcggcgatcaccgcgtcggatccgagcgagaaggccgagctgttcgaaccggcgggcgacaagatctaccgtcacccgacgttctacacgctgcccgacgaagtcaaccacatgtaacgcccgcgccatgacgatcacgcccgaacacctctcctacgtgctgcgcctcgcggacaacacgctgatcctcggtcagcgcaatgccgaatggtgcggccacggcccgatcctcgaggaagacatcgcgctcaccaacatgagcctcgacctcatcggccaggcacgcatgctgtatacgcatgcggccgaactcgagcgccagctcaccggcgcgacgaagaccgaggacgactacgcgtacttccgcaccgagcgcgagttcgcgaacttcacgctcgccgaactgccgcattacggcccgctcgccggcaccgcgcacgccgacaaagattacgcggtgacgatcgtgcgcaacttcctgtactcggcgctgatgctgcacgtgtggagcgcgctggaaacgtcgaccgacacgcagctcgccgcgatcgccgcgaaatcggtgaaggaaacccgctatcacgtgcagcacgcacgcgagtggctcgtgcgcctcggcgacggcaccgacgaatcgcaccgtcgcgcgcaggacgcgctcgactacctgacgccgtacgcgcgaattcttcgccgccgatgcgatcgacgacgcagtcgcggccgaaggcatcgccccggcaccggccacgctcgaagcggcgtggcgcgcggacgcggacgacgcgctcgcggaggcgacgctcacgctgccggccccgtgcagcacgtgacgaccggcaagcagggcgagcattcggaacacatgggctacctgctcgcggaactgcaaagcctcgcacgccagcaccccggcgcgaactggtaaccccgacgccacggagcccgacgatgtccgtccagaccgcccccgccaacgccaacgccgtgcctgccgcgcgccgcgacgatccgctgctcgcccgcgcatgggacgtgctcgaagccgtgcctgatcccgagatcccggtcgtgtcgatccgcgagctcggcatcctgcgcgacgtccgccgcgcggacgacggccagctcgaggtcgtgatcacgccgacctactcgggctgcccggccatgtcgcagatcgccgaagacatcgccgccgcgctgcaggccgccgacctgccgccgcaccggatcgagacggtgctcgcgcccgcgtggacgaccgactggatcacgcaggaagcgcgcgacaagctgcgtgcgtacggcatcgcgccgccggtcggccaatgcggcaccgccgcgccgcggaaaacgtcgtgcgcttcgtgccgcggcccgtcgcggcgcccgcgtgcccgcgctgcggctcggcacgcaccgagcgtctcgcgcaattcgcgtccacggcctgcaaggcgctgtatcgctgcgtcgactgccgcgaacccttcgactacttcaaaccctactaatcgatatggcgaccccgcaatttcatccgctgcgtatccgcgacgtgcggcccgagaccgccgacgccgtgaccgtctccttcgacgtgccgcccgagctgcgcgacgcgtaccgcttcacgcagggccagttcgtcacgctgaagacccacatcgacggcgaggaaacgcgccgctcgtattcgatctgcgtcggcacgacggactacgaccgtgacggcgaactgcgcatcggcatcaagcgcgtacgcggcggccgcttctcgaacttcgccttcgatacgctgaagcccggccacacgatcgacgtgatgacgccggacggccgtttcttcacgcacctgaacgccgaccacggcaagcagtacgtcgcgttctccggcggctccgggatcacgccggtgctcgcgatcgtgaagacgacgctcgaactggagccccgcagcacgttcacgctgatctacggcaaccgcagcgtcgacgcgatcatgttcgcggaggagctcgaggacctgaagaaccggtacatgaaccgcttcgtcctctatcacgtgctgtcggacgaccagcaggacgtcgaactgttcaacggcgtgctcgaccaggcgaaatgcgcggaattcctcggcacgctgacgccggccgacgcgatcgacgaagcgttcatctgcggcccggcgccgatgatggacgcggcggaagccgcgctgaaggcagccggcgtgccgcaggcgaaggtgcacgtcgagcgcttcggcacgccgctgccgcaagccggtgcgccggtcgtcgaaatcaccgaccagacgccggccgccgacctcgaaatcgtgctcgacggcaagaagcgcaagctgcggctgccgtacgaaggcgtgagcctgctcgatatcggcctgcgggcgggcctcgcgctgccctacgcgtgcaagggcggcgtgtgctgcacgtgccgcgccaaggtgctcgagggcgaagtgcggatggagaagaactacacgctcgaggagcatgaagtgaaggacggcttcgtgctcacgtgccagtgccacccggtcagcgacaaggtcgtcgtgagcttcgacgagcgttgagcgacgtcgcgtcgcggcgccggacggtttctcgccgtcacacatctcgcttacactaggggccgccggccggctggacatcgcaacgtccgcccggccggcggttttctttgttgacgacaggccgatgagtaccattcatgtgattcagggcggcaccgccgccgcgtcgctgcgcgaggcactcgcgcaagccgggcgcgacgagcatgtcgtcggattgctcgacgatctcggcgtcgggccgctcaagggcgccgacgagacgcccgacacgcgcgcagccttctggcagcgcgtgctcggcgaccagattcccgactggaacgcagagatcgaagccgagttcgcacgcctcgaccagctggcgacggagacgggccaggtggtggtgtggcatgcgccgagcgtcggcgacaagctgctgctgcggcgcgtcgcctatcacctgcgcaatgtcccgcaacgcctgaacgaagtgcggctgtcggccgccgacctcgatccggcgcagcgcgcatcgctgtcgcgcactgatcaggcatgcgcgaccggcatgttctcgcccgccgaactggcgcgcaagcgtccggtggccgcgccgatctcggtgctgcgcatcggccgcctcgcgctcgaatggcaggaggcgaagcaccagaacgccgaactgcgctactgggtcagcaacacaatcaagagcggccactatgaagaactcgacgcgctgatcctcgcgcgcgcggaaaccgactggctgcccgcgcggcgcctcgtcggcagcatcatggccgacgccgatcgcggcgggctgttcgtcagcgactcgatcgcctggtggcgctgccgcgaactcgcggcggccggccggctcgagctgcaggacgacacgcccgacgccctctcctccacgcaggtgcgcgcggcccgcgcggccgccacgcaccgctaatcttccgcattcgaccatggcccgtacccgagcgcccgaccacgaatcccagcgcgagcagatcctcgatctggccgccgacaaattcgcgcagacgagctatccgagcacgtcgatgtccgatctcgcgaccgcgagcggcacgtcgaaagcacgcctctatcactattacgagagcaaggaagcgatcctgttcgacctgctcgaccgctacacgaaacggctgatgctgatcatcgccgaggtcgaaggggcgagccagcggcgcggcctcagcgagcgcgacgcgttcgcggagctcgtgcgcgcgttcctcgccgaatacgagacatcgcacagccgccacgtcgcgctgctcaacgacgtgaagtatctcgaggacgcgcagcgtgaaatcgtgctcgaccgccagcgcgacatcgtcgcggcattcacgcgacagctggcgcgcgcgtacccggaccgcatctcgaaggaaaaccagacttccgtgacgatgatggtgttcgggatgatcaactggacgttcacgtggctgaagcccggcggccgcctcggctaccgcgacttcgccgagcaggtgatcgacctgatcgaacgcgggctgtcgacggccgcctgattgccgcgcagcagcaagcgttgcgcgacgggcacactgcgaccgcccgccgcgcgtttcatatgatgaattttaaatccatttaaaatcaaatagatagccgattaactaagcggatttagaattcatcctccagctcaaacatcgttaaatacgggttttccccaatccgagggctgacggtcgggtaaaatgctgctgcattgcacaacccgctgtacggtcacacattgaggaacccacgatgaacacgcgattcaacggcactgccgatgtcgtcggcaccgccggtactgcgccggttctcgtcagggaactggcttccaaagaccgtgagcagatgctcacccactttctctcgctcgacgaagaggaccgcctgctgcgcttcggccagatggtgcccgaccacgtgctcgagaactatgtccgcacgatcgacttcggtcgcgacaccgtgttcggcgtgttcgaccacgacctcgaactgatcggcgtcggccacctggcctacctgccggccgagggcgacaagcgcacggccgaattcggcgtgtcggtgctcgaaagcgcacgcggccgcggtgtcggctcgaagctgttcgaacgcgcggcgatccgcagccgcaacacgcacgtgacgacgctgtacatgcactgcctgtcgcgtaacgcgacgatgatgcacatcgcgaagaaatccgggatgcggatcgagtatgcgtacggcgaagccgatgcgtacctgtcgctgccgccggccgaccactcgacgatcatcgccgagatgctgcaggagcaggccgcggtgttcgactacgcgatgaagcgccaggcgcgccgcaccacgaagttcatcgaatcgctgatgcccgccgccctgacggcgtaacgtcagccagccgggccgcgccttccgcgcgcccggccctccctccccgccgcgcaactagcgcaccgaccgaatcggcaacgccgtcgtctccttgaagcattcgagcgaaaagctcgtcttcacgtcgatcaccgacgggtgatgcagcaaatgctcctgcacgaagcgggagaaatgcgccatgtcctcgacctgcacgcgcagcaggtaatccatgtccccgtcatcgcgtggcacgcgaccacttccggccaggtctgcacggccgcgcgaaacagctccgcatgggtcgcgcccgcgcgcgccgacgtttcgtcgacccgcaccggcgccaggccgccgcgtttctcgagccgcacgctcacgtacgcgagcaggtcgagcccgagcttctgcggattcagcagcgcgacataaccggtgatcacgccgatctcctcgagccgcctgatccgccgcaggcacgggctcggcgacaggttcacgcgctcggcgatctcctggttcgacaggcgcccgttctcctgaagaattgcgagaatccgccggtcgatggcatccaattcggcgtgcgccatcttctgccctccaatgattatttcaagactggaaattgcgccatcgtaggttcgggcgatcaagttcgcaagtttacgctcgcgactgcccgctacactctgtcgcacgtaccgattcgtcgcgcacgctgccgcgtgtgccacgttcgacatcgaaccaggccggacaggcgcacgtcgccgcggccgatcgcccccacaggagacacgccatgcagatcccgaactgggacaaccccgtcggcaccgacggcttcgaattcatcgaatacacggcgccggacccgaaagcgctcggacagctgttcgaacggatgggtttcaccgcgatcgcgcgccaccgccacaaggacgtgacgctgtaccgccagggcgacatcaacttcatcatcaacgccgaacccgattcgttcgcccaacgcttcgcgcgcctgcacggcccgtcgatctgcgcgatcgcgttccgcgtgcaggacgccgcgaaggcgtacaagcgcgcgctcgaactcggcgcatggggcttcgacaacaagacgggcccgatggagctgaacatcccggcgatcaagggcatcggcgattcgctgatctactttgtcgaccgctggcgcggcaagaacggcgcgcagccgggcgcaatcggcgacatcagcatctacgacgtcgacttcgagccgatcgccggcgcgaacccgaacccggtcggccacggcctcacctatatcgaccacctgacgcacaacgtgcatcgcggccgcatgcaggaatgggccgagttctacgagcgcctgttcaacttccgcgaagtgcgctacttcgacatcgaaggcaaggtgacgggcgtgaagtcgaaggcgatgacgtcgccgtgcggcaagatccgcatcccgatcaacgaggaaggctcggatacggccggccagatccaggaatacctcgacgcataccacggcgaaggcatccagcacatcgcgctcggcgccagcgacatctaccgggcggtcgacggcctgcgcagcaaggaagtgaagctgctcgacacgatcgacacgtattacgaactggtcgaccgccgcgtgccgaaccacggcgaatcgctggatgaactgaagaagcgcaagatcctgatcgatggcgcgcgcgacgacctgctgctgcagatcttcaccgagaaccagatcggaccgatcttcttcgagatcatccagcgcaagggcaaccagggcttcggcgaaggcaacttcaaggcgctgttcgaatcgatcgaactcgaccagatccgtcgcggcgtcgtgcaggacaaggcctgacacatctggcgggcggctgcccggggcaacccggcaacccgcccgatccggcggcacaaagaaaagggcgggaatccgaggattcccgccctttcattccggcgcggcccgccggccgcgcgaacggatcaacgcgcgttcgccttcgacgcgacggcgcgctcggccgacggctgcgcgacggcgtcctgggccggcgcgatctgctgcatctgcgcgccggctgccgccagtgcgctcgcgcctcgcgcgtgcaccgggccggtcatcgagaaaacgcggcggacacgatcaggaaactctggatatgacgtgtgttcattgcacctcctgtaaaactgccggcgcctccccgatgcgtcgaaacagaccgacgcgaccgggcacctccggcaggccgacaagattaacggcatttgcgcgcagatgaacgcggccttacatgcttttacatgatgtaacgcatgattcagcccctttttacggtgcgccgccgcggttctccccgcattccaaccgatgggcggcgggtttgccccagtgctaccatcgcttaaaaccggcgaacatgccggccactgccgacgcatccaaaagatgccgacgcaaccgaagttttggtgatcccagaccgggtggaggagacagttaatgaatgccccgctagacgcagaccaacgcgcgtcgctagaagccgcgctgaagtccgtcacgcttgacgacaaatacacacttgagcgcggtcgcgcgtacatgagcggcatccaggccctcgtgcgcctgccgatgctccagcaggaacgcgaccgcgccgccggtctcaatacggccggcttcatctccggctaccgcggctcgccgctcggcggcctcgatctgtcgctctggaaagccaagcagcacctggcggcccaccagatcgtcttccagcccggcctcaatgaagatctcgccgccaccgccgtgtggggctcgcagcaggtgaacctgtaccccggcgcgaagcacgacggcgtgttcggcatgtggtacggcaagggcccgggcgtcgaccgcaccggcgacgtcttcaagcacgcgaactcggccggctcgtcgcagcacggcggcgtgctggtgctcgccggcgacgaccacgcggcgaaatcgtcgacgctcgcacaccagtccgaacacatcttcaaggcctgcgggctgcccgtgctgttcccgtccaacgtgcaggaatatctcgatttcggtctgcacggctgggcgatgagccgctactcgggcctgtgggtcgcgctcaagtgcgtgacggacgtcgtcgaatcgtcggcatcggtcgacatcgacccgcatcgcaccgagatcgtgctgccgaccgacttcatcctgccggaaggcggcctgaacatccgctggcccgacccgccgctcgtgcaggaagcgcggctgctcgactacaagtggtatgcggcgctcgcctatgtgcgcgcgaacaagctcgaccgcatcgaaatcgattcgccgaacgcgcgcttcgggatcatgaccggcggcaaggcctacctcgacgtgcgccaggcgctgaccgacctcggcctcgacgacgaaacctgcgcgcggatcggcatccggctctacaaggtcggctgcgtgtggccgctcgaagcgcagggcgcccaggcgttcgcgcgcggcctcgacgaaatcctcgtcgtcgaggaaaagcgccagatcctcgaatacgcgatcaaggaagagctgtacaactggcccgacggccagcggccgcgcgtgttcggcaagttcgacgaaaggacggcgccggcggcgaatggtcggtgccgatgggcaactggctgctgcccgcgcactacgagctgtcgcccgcgatcatcgcgaaggcgatcgcgacgcgcctcgagaagttcgagctgccgtccgacgtgcgcgcgcgcatcgccgcgcggctcgcggtgatcaacgcgaaggaaatggcgctcgcgaagccgcacgtgcagaccgagcgcaagccgtggttctgctcgggctgcccgcacaacacgtcgaccaacgtgccggaaggctcgcgtgcgatcgccggcatcggctgccactacatgaccgtgtggatggaccgcaacacgagcaccttcagccagatgggcggcgaaggcgtgccgtggatcggccaggcgccgttcacggacgagaagcacgtattcgcgaacctcggcgacggcacctatttccactcgggtctgctggcggtgcgcgcggcgatctcgtcgaaagcgaacatcacctacaagatcctctacaacgacgccgtcgcgatgacgggcggccagccggtcgacggcgtgctgacggtgccgcagatcacgcaccagctcgcgtcggaaggcgcgaagaagatcgtgatcgtcaccgacgagccggagaagtacgacagccagaaggcgctgctcgcgccgggcgtgccgatccatcatcgcgaccagctcgacgacgtgcagcgcgagctgcgcgagatcgaaggcacgacgatcctgatctacgaccagacctgcgcgaccgagaagcgccgccgccgcaagcgcggcacctatccggacccggcgaagcgtgtggtgatcaacgacgcggtgtgcgaaggctgcggcgactgctcggtgcagtcgaactgcctgtcggtcgagccgctggaaaccgaattcggcacgaagcgccagatcaaccagtcgagctgcaacaaggacttctcgtgcgtgaagggcttctgcccgagcttcgtcacggtcgagggcggccagttgaagaagccgaaagccgtgtcggtcgacggcaacgcactgccgcccattcccgaaccgacgctgccggacatcgaccgcgcatacggcgtgctcgtcacgggcgtcggcggcacgggcgtcgtcacgatcggcgcgctgctcgggatggccgcgcacctggagaacaagggcgtgaccgtgctcgacgtcaccggcctcgcgcagaagggcggcgccgtgatgagccacgtgcagatctcgcacgcgccgaccgacatccacgcgacgcggatcgcgatgggcgaagccgacctcgtgatcggctgcgacgcgatcgtcacggccggcgacgagtgcacgtcgcggatgcggcacgacgcgacgcgcgtggtcgtcaacagcgcgcagacgccgaccgccgagttcatcaagaacccgaactgggcgttcccgggcctgtccgccgagaacgacatccgcgcggcggccggcgaagcggtcgacttcatcgacgcgaaccgcttcgcggtcgcgctgctcggcgacgcgatctacacgaacccgttcgtgctcggctacgcatggcagaaaggctggctgccgctcacgctcgtgtcgctcgtccgcgcgatcgagctgaatgcggtatcggtcgagaagaaccgtgcggcattcgactggggccgccgcgccgcgtacgacctggcgagcgtgaagcaggccgcggccggcgacgcgcgcccgcgcaaggcgccacggtgatcgcgctgcacacgaagaaggcggtcgacgcactgatcgcgaagcgcgtggaattcctcaccgcgtaccagaacgccgcgtatgcggcgcgctatgcggcgttcgtcgacaaggtgcgcgccgccgagcgtgcactggcggacggcgacacggtgcaggagcagctgactgaagcagtcgcccgcaacctgttcaagctgatggcgtacaaggacgaatacgaggtcgcgcggctgcagtccgatcccgcgttcctcgcgcgcctgtccgcacagttcgaaggcgactggaagctgaaattccacctcgcgccgccgctgttcgcgaagacggactcacacggccatctggtgaagaaggcgtacggcccgtggatgatgacggccttccgctggctcgcgaaggcgaagttcctgcgcggcacggggctcgacccgttcggccgcaccgaggaacgccgctccgagcgcgcgctgatcggcgagtacgaagcgctgatcgacgaagtgctggccaggctgaacgcggccaaccgcccgctcgccctcgagctcgcggcgctgccggacggcattcgcggctacggccacgtgaaggagaacaacctgcgcgcggtacgccagaagtggagcacgctgctcgcgaagtggcgggcgccggcaggcggccagtcgcaccagcaggtcgcgtgacggtcagccgacgggcgcgggcattcgcggttcgaacgcccgccccggccggcgattcgcaataaaaacgccacggaacgcaggttccgtggcgtttttctgcgccgcgcctgaagcgcggcacacgcgggcgtggacttacttcgtgttcacgttcgcggcggcaacggccgtcatgttgatgatccggcgcacggtcgcagccggcgtcaggatgtggaccggcttcgccgcgccgagcaggaacggaccgaccgtcacgccttcgccgccgaccatcttcagcaggttgtacgcgatgttcgccgcttcgacgttcggcatgatcagcaggttcgcttcgcccgacagcgtcgtgccggggaacgcctgcttgcggatcatttccgacagcgccgcgtcgccgtgcatttcgccgtcgacttccaggttcggcgctcgttcgacgatcagcttgcgggcctcgcccatccggcgcgacgacgccgacggcgcgctgccgaagttcgagttcgacagcagcgcggccttcggcgcgatgccgaagcgctcgatctcggccgcggcctggatcgtcatgtcggcgagctgttcggcgctcggcagctcgttcacgtacgtgtcgcacacgaacaggttgcggcccggcagcatcagcaggttcatcgcggcgaagtgctcggcgcccttcgcgcggcccagcacctgctcgatgaacttcaggtggctgtggaacgtgtcgatcatcccgcagatcatcccgtccgcatcgcccaggtgcacgagcatcgtgccgatcagcgtgttgaacttgcgcatcgcggccttcgcgacttccggcgtcacgccgtcgcgcgcgccgatctcctgatacgcctgccagtagcggtggtagcgcgcatcgtcttccggatcgacgatttcgaaatcggtgccggccttgagcttcgagccgatcttctgcaggcgcatgtcgacgaccgacggacggccgatgatgatcggcttcgcgatctttcctgcagcacgaactgcgcggcgcgcagcacgcgctcgtcttcaccttcggcaaacacgatgcgcgcctgcttctgcttcgcggtcgcgaacaccgggcgcatcaccatgccggtgcggtagacggtcgcgccgagctgctcgcggtaggcgtccatgtcctggatcggacgcgtggcgacgcccgaatccatcgcggcttgcgcgacggccggcgcgatcttgatgatcaggcgcggatcgaacggcttcggaatcaggtagtccggcccgaattcgagcgagtggccttcatatgccttcgcgacttcttcgctctggtcggtttcttccgccagttcggcgatcgcgcgcacgcacgcgagcttcatttcttccgtgatcgtcgtcgcgccgacgtcgagcgcgccgcggaagatgaacgggaagcacagcacgttgttgacctggttcgggtagtccgaacggccggtcgcgacgatcgcgtccgggcgcacggccttcgcgtcttccgggcggatttccggttccgggttcgcgagcgccaggatcagcggcttgtcgcccatcgtcttgaccatgtcctgcttcagcacgcccgcgctcgagcagccgaggaacacgtccgcgccgacgatcgcgtcggcgagcgtgcgtgcgtcggtggtcgccgcatagcgctgcttcgacggatcgagattgccgcgcccttcgtagatcacgcccttcgaatcggcgacgaggatgttcgacttcgtcaggccgagattgaccagcaggtccaggcacgcgatcgctgcggcgcccgcgcccgagcacacgagcttcacttcggcgagcttcttgccgacgaccttcaggccgttcaggatcgcggccgacgcgatgatcgcggtgccgtgctgatcgtcgtggaagacggggatcttcatgcgctcgcgcagcttctgctcgatgtagaagcattccggcgccttgatgtcctcgaggttgatgccgccgagcgtcggctcgagcatcgcgatcgcctcgacgagcttgtcggggtcggattccgacagttcgatgtcgaacacgtcgatgcccgcgaatttcttgaagaggcagcccttgccttccatcaccggcttcgcggccagcgggccgatgttgccgaggcccagcacggccgtaccgttcgtgatgacgccgacgaggttgccgcgcgacgtgtacttctgcgcatcgagcggatcggcgtggatcgcttcgcacgcagcggcgacgcccggcgaatacgcgagcgacagatcgagctggttcgacagcggcttggtcggggtgaccgaaatcttgccgggtttcggattctggtgataggcgagtgccgcctgcttcagttgttcgtccatgattgacctgcgagagacatgcgaaatattgacggttcagtacacagcaccttgggccgcgtctgcttgaatcgaggggatggtcgactgcgagacggcacgcagcgcgccgggtcggcacgccatcgaaccttggcggatggcaagaggaaagtacaaagtactgaacgatttctaagggtcgcctagtgtacacccctaaatgacctccgttggtgcagcgccgcatcctccgcatcagcgcgagcggtcccgccccgtttgtttcgccggtggtgagccgagcggcgaacccgcgcgaattccgccgaaaaccggcctgaatcgggtaaaatagcgggctacgcgcgcagcgatgcgattggccctccgatcgcgccccggccccagggcaggttcccttgctgcgccaccgggcccgcgcccgctcttcgctcatcacccaaggaatgcccatgacaggctacgatcgtcagtcgatctcggatacgaccgccaaaatcctgctcgaagtgcaggcagtgcacttcaacgcagaaaaaccgttcatcttcacgtccggctgggcaagccccgtctatatcgactgccgcaagctgatttcgtatccgcgcgtgcgccgcgcgctgatggaaatggctgaaacgacgatcacgcgcgacatcggcttcgagcagatcgacgcggtggcgggcggcgagacggccggtatcccgttcgcggcatggatcgcggaccggatgatggtgccgatgcagtacgtgcgcaagaagccgaagggtttcggccgcaacgcgcagatcgaaggccatctggaagaaggctcgcgcgtgctgctcgtggaagacctgacgaccgacagccgcagcaagatcaacttcgtcaacgcgctgcgcaccgcgggcgcgaccgtgaaccactgcttcgtgctgttccactacgacatcttcaaggaaagcgtgtcggttctgaaggacatcgacgtcgacctgcacgcgctcgccacgtggtgggacgtgctgcgcgtcgcgaaggcttcgggctacttcgagacgaagacgctcgacgaagtcgagaaattcctgcacgcaccggccgagtggtcggcggcgcacggcggcgcgacggccccgaaggaatgacgccgcgccggcccgcaggccggcgtcctggctgaacaagccgcccgcttcatcgcgggcggtttttcgtccgccgattcgcgcagcaaacgatcgcgaccatgggtcgcggcgtgcatcgctcatcgaaccctaatgctagacttgatccatcgtcgccatcagctgcgcgggcaacgcacaacgccaacaacgccggaagcatcggtccggcccacgtgacgggagaagcgccatatgcgtgtggatcgccggatcactccgcctgcgccatcgggtcgcccgtcgccgttccttgccgccctcctcgctctcttcgcccacctcgtcctcctttatgccgccgcgttcgccgccgtgcccgcgcatgcagaaggcgcgttcaccgtgacgagcgacgacctgacgccgggcgggcgcgtccgtgccgcgaacgtgttcgaccgcggcgactgcaagggcggcaaccactcgccgcagctcgcctggcacaacccgccgcccggcacgcgcggctacgcggtcacgatcttcgatcccgacgcgccggggcacggctggtggcactgggccgtggcgggcattcccgcgacagtcacgagcctgcccgccgacgcgagcgcatccggcttcctgcggcgcatcggtgcaagcgaagcgcgcaacgacttcggaatcgacggttacggcggcccgtgcccgccgcccggcaagccgcaccgctacgtggtcaccgtctacgcgctgaagggcgacgacctgcgcgtcgcgcagggcgccccgcgccgatgttcgagcacgagatcggcacgctggcgatcggcaccgcgcaactcacggtcaactacgggcaataacgggtgacgggtgacgggcacccggcggcgggcatcgccccctgccgcgcgccgccgcgattgcctgccgccgcgcactggcgcactccgggcgtattccgcgcccgcgtgttttcgcgtcatttcggcttgctagactcgtcgtcaccggtcgcggcgccacgccgcgcatccgtcgcgccgccggccggcgacgcgtgacccggcgtgccgcagcggccgccgttcccgttcctttccggagaacgcctcatgtcgaacatcgtcatcgtctatcacagcggctacggtcacacgcagaaactggccgaggccgttcacgcgggcgcgcaggacgccggcgcgaccgtgcgcctgctcgcggtcggcgacgtcgacgacgcgggctgggccgcgctcgacgcggccgacgcgatcgtcttcggggcaccgacctacatgggcggcccgtcggcgcagttcaaacaattcgccgatgcaacgtcgaaagcgtggttcacgcagaaatggaaggacaagattgccgcgggcttcacgaactccgcgaccatgaacggcgacaagttctcgacgattcaatacttcgtcacgctgtcgatgcagcatgggatggtgtgggtcggcacgagcctgatgccggccaactcgaaggcggccacgcgcaacgacatcaactacctgggcggctcgacgggcctgctcgcgcagtcgccggccgatgcgacgcccgacgaaggcccgctgccgggcgacctcgaaaccgggaaggcattcggccggcgggtcgccgaagcgacggcccgctgggtcgccggccgcggctgagcacgcgccggtgggcgcgccgatgagcgcgccggtgtgcgtcaaagggacacaagacggcccgccggccgtctttttcgacccgcgcgatgcaggcccgccggatgacgtcttaaaatggcggattcagggcgcgggccccgtttcattcagtgagagcgaaatgagcaccaaagtttttgtcgacggccaggaaggcacgaccggcctcaagatcttcgaatacctgtcggcacgcagcgacatcgagatcctgcgcatcgatgaagcgaagcgcaaggacgtcgaagagcgccgccgcctgatcaacgcgtcggacgtcacgttcctgtgcctgccggatgtcgcgtcgcgcgaatcggcgtcgctcgtcgagaacccgaacacgacgctgatcgacgcgagcaccgcgttccgcaccagcgccgactgggcctacggcctgccggaactgacccgcgcgcagcgcgagaagattcgcacgtcgaagcgcatcgcggtgccgggctgccatgcatcggccttcgtgctcgcgatgcgtccgctcgtcgacgcgggcatcgtcgcaccgacgttcgccgcgcacagctactcgatcaccggctacagcggcggcggcaagtcgatgatcgccgactacgaaagcgcggcgccgggcggcaaactcgcgagcccgcgcccgtacgcgctcggcctcacgcacaagcacctgccggaaatggccgcgcacacgggcctcgcgaacccgccgatcttcacgccgatcgtcggcccgttcctgaagggcctcgcggtgacgacctacttcacgcccgggcagctcgcgaaacgcgcgacgccgcaggacgtgcagcgcgtgttcgccgagtactacgcggacgaagccttcgtgcgcgtcgcgccgttcgatgcggacgcgaacctcgacggcggcttcttcgacgtgcaggcgaacaacgacacgaaccgtgtcgacctgttcgtgttcggcaacgaagagcgcttcgtcacggtcgcgcgcctcgacaacctcggcaagggcgcatcgggcgccgcaatccagtgcatgaacctgaacatcggcgcggccgaggatgcgggtctcaaacgctgattcaacatcgcatgcaatgcaaagccggccactggccggctttttattaccggtatcacgcaatatataaaaattaccgatcgcgcatttacaaatatttacaagctttcgattgcgcgattaccagtgaattaattccacccctctttatccagtcaatcccgaatagggataaaccggataccgaccgctttaaacgctgccgttatacgcaggaaggctcttcgccggcctgtccggcgtcgcacattccccactccggcagcttcaggcagcctgtcgcacgttttaattcttactgaataccgtgtcagacaaggattcaaaacacgatgcccgtttcaatcgcctttttagacgggttcatcaattgacagcaaaaatccaggcagcgacattagctcgcacaattaaacgattggagacagcggcatgtcgcacgccttatcgaaggggtggcaacggcctttgccattgcccctttcctggttgcatgtggtggaggggacggcggcgcacccgcgccgatcaatgcgccccaatgttccggatcgagctgcggcacgcaagggccgccgccttcgcagcccgtcaacggcgcgctgtgcccggccaacgcggacatcgtgaagagcacgtacctcggcggcgccggtagcggcgagatcgtcagcgtcaacatcgacgccgtggcgatgacctacacgctcaagtggctcgaatcgccgattccgctcgcgaccggcacggtcacgccgagccgcgccggcacgacgatcaccggtgcggtcatgcacccgccgaccggcacgctgccgaccgccgagcagacgcgctgcgcgttcatcctcacgccgggcacgggcaaggcgccgggcggcgccacgtactcgacggccgccgacttcaaccgggcgaacccgccgatgctgctggtcggcatgggcgtcgcgggcggcggcattcccggcgcgacgatccagtacgacgggctgacgatcgccatcggcccgatcgtggtggcaaaggacgtcggcaaggtgccgaaccgtcacttcgacttctatccgttcctcggcttcgcgaacacgacgactgacctgtcgaagctgccgggcacgtacaacgcgctgatctaccacctagtgccgtcgggcgactacgcgacgaaaggcacgaactcgagcgagacgttcgatgcgaacggcgcgtgcacgtcgagcggctcgggcggctgccagacgaccggcgacccgtggaagacgagcgcgaacggcggctacttcgacagcacgaaggcgccgcagacgctgccgcagacgcaattgccgatcgtcggcgcgaccggcaagtcggccaccgcgcatatggtgatcggccagctcaacggcgcgacggtgccggtgatcgtgcgtacgggcaacgtgaacctcggcacgccgccgctgcataccgacgcgcaggtcgacgacgaatcgggcatcgcggtgctcggtgcggcaacggcgatccagtcgggcgcgatcgacggcggctacgcgggcgcggactcgaacttcaagtacacggcggccctgatccgcggcagcaacgcgtcgttcatcaacccgagcacgcaggtcgaggaagacggcttcacgctcgactacggccaggcgacgccgggcctgctgaacgcgacgacgacaccgaagccgccgcccggcacgaactacccgtccgcaactggcgtcgtgatcgcgacgggcgggctgtacgcggcgctgatccagggcacggtgaacggcggcgtcacgtcgacgtcggcaaattcgacgacttcgtcgacaccgtacttcggcgtgggcgcgcagatcagcaagtagcggacgaggacgcgacggcgggctggccgccgtcgcgtgacgcacgagcgcgcggcacggcgcaggcaggacgagcacaagcaacagaagcggccgacagggagctggccgccgcacaagacaaatctggaggagcaacatgaagcgcaacctcattctggcggcggcccttgcccccttctttctgcctgcggcggcagcggcagcggcggcgacaatccgcccccgctcgtcgaagaccggctctgccctgcctcgctcgactacaccaccgtgtttacgggcggcgcgggcagcggcgagctcgccaaggtccagctcgacacgaccaagatgacctggcaggtcacctatgtcgaatcgccggttccgcaaacgaccggcaccgtcgtgccgacccgcgcgggcaccgtcgacagcggcacgctcacgcaggaaacgctgctgccgaccaacaagctgaaccagtgcgcattccgcctgaacggcgcgagcctcgatccgtcgcgcccggcgcgcatcttcgtcggcatgggcgtcgcgggcggcacgattcccggcaaggagatccagttcaacggcgtgctcggccaggccgcggtgcccgacacgaaattcccgtactacccgttcatcggcttctcgtcgatcgaaaccgacatcacgaaggtggcgggcacgtacagtcacacgggcttcggtgaagtgccgtcgcagaacttcgcgccggcatcgatcgacgcgaaggtgacgatcaacgccgacggcacctggaccaagtgcgactcgaccggccagttcgccggcggcgcgtgcacgcagcgcggcacgaacttcgtgcagtcggcggacggcagcggcgcattccagtcgaacaactatgcgagccagctgaaaccgacgctgtcggcgacgccgcagggcaaggccttcatgatcgtcggcaagctgcgcaaccagctcgtgccgattctcgtgcgcaccggggtggcgaacccgaacccgacgcccgacagcaacggggtgccgggcctcaccgccgacgacgaatcgagcatctcgatcctcgcgccgcagacggccatcgcggccggttcgcagaacggtgaatacatcggcgtcgacagccagttcgattaccggaccaccgcgctgatcgacaagcaggccacgctgctcgatccgttccggccgtcgcaggcatcgctcgcgaccgcgctcgacctggactacacgcagaaggtgccgggcacggtcacgacaatccacacgggttcgggcagcacgtcgccgaccggcaagttcatcttctcgggcggcgtgttcggtttcctcgacaacgcgggatcgacgccgtatttcacgatcggcgcattcgtccagtaagcggagggaaatgccgtgatgaagagaaccctacgctgcgcggcggccggcgccgccgtgctggcgccgctcgcggcgcacgcgcagagcgccggcagcaacgtcgtcacgctgggctggttccacgtgatgccgcagcagagcagcacgccgatgacgaccaacgtcgcaccgacaccgatcaacacgccgctgcggctgccgccgtcgttcacgtcgccgggcaccgggctgcatacgagcggcgccgacaccgtcggcctgacggtcagccacttcctgaccgatcacatcgcggtcacgtcggtggccggcgtgccgccggtgttcaaggtgtcgggccagggcacgatcaggccgcccggcccggccggcgcgctcggcacgcagaacatcgggctcgcgtcggtcaacccgatcgtgaagagcgtgcggcagtggagcccggccgtgctgctgcagtactacttcgggcaggccaccgcgaaattccggccgttcctcggcctcggcgtgtcgtacaactggttcagcgaccttcagctcaacacgaacttcatcaagcagacccaggacaacctcggcgcgattctcgcggcgggcgcgggcaagccgggtacgacatcggtggaggcgaaggcgtcgtcgtcatggcagccggtgttcaacgccggcctgcagtacaacatgaccgagcatttcgggctgatcgcgtcggtgacgtacatcccgctgaagacgacgtcgacggtgacgatcaaggcggccgacggcacggtgctctcggaatcgaaatcggacctgaaggccgacccgatcatcagctacgtcgggatgacgtacaagttctgagcgccgcgacggacgacgcatggcatgccgcggcaaaatcgcaggcaaaaaagcccgcctaagaggcgggctgaatccatatcagaggagacatggaggagacaggtgcaattctagcgaatcggtttccgcaatgcaacatttccgtagagaaaatacggactttccctcgaatgccgactctagatcgccttcactgcatctgaccccaccctgttttcccggtcgagcacttcgcccagcgcatcgcgcagcagcgcgacgggccgcaccagccggcccggcagcgcgccgtgcacgatccacacgttgatccgcgtctccagtcccgccgtttccaccaccctcagcgcgtcgcggtgcgcgctgcgcgccagcgcgttcggcgcggcgatgccgatgcccgcgccgcgcgcgacgagcgacagctgcagctccgagccgaatgcctcgaccgcgacgtcgaacggcagcccggccgcgccgagcgtgcggctcagcgccgaacgcatcccgcagccgtcctggctcagcacccacggaaaacgcgacagcatgtcgatcgacaacgggccgtcgggcagcggaaagtcgcgcgcggcgacgagcaccgtcggctgggtgccgagcagcgtcgacgtgaacgtatcgggcagtaccgaactcgccggcaccatcacggccgcgacgtcgagcgtgccgcgctcgacgccctgcatcagcgccggcgaccagccggccgtcacgcgcagcgtgaggcgcccgaacgcatcgcgcagccggtcgatcggctgctcgagcgccagctcggacaggaacggcggcacgccgatgcgcagctcgccggacggctcgctgtccggcgcgcccgccgccatcagctcgtcgaccgcgcccagcacgttgcgcgcgagcgcgtagacgtcgcgcccggcggcagtcggcttcagcggcttgctttgccgttcgagcagcgacatgccgagcagcgtttcgagattctgcacgcgccgcgtcaggcccggctgcgtcaggtggagcttcgcggccgcggcgaccatcgacccgctatcgaccaccgcgacgaacgcctggagatcacgcgtattcaaaacaaactcgcataatcatgttagagatatttcaattgtcgcataaacatcaggcacctacgatggggactccttcgacccactcgccaggcttccgatgaactgccccgccaacccttgccccgccgccgtccgcacgcccgccggcacgccgcccgcgttgagcgcgggcatgacgctgttcttcgccgcgacggtcggcgtgatcgtgatggacctgttcgccgcgcaaccgctgacgggcccgatcagcgccgatctgcatctgccgcccggccttgccggcctcgtcgcgatgttgccgcagctcggctacgcggccgggctcgtgctgctcgtgccgctcgtcgacctgctcgagaaccgccgcctgatcgtcgcgacgctggccgcatgcgcggctgcactcgtgctgcccgcgttcacgcggtcgggcaccgtattcctgctcgccaccctcgtggccggtggcgcgtcgagcgtgatccagatgctcgtgccgatggccgcgtcgatggcgcccgaggcgcagcgcggccgcgcggtcggcaacgtgatgagcgggctgatgctcggcatcctgctgtcgcggccgctcgcgagcctgatcgcgggctcggccggctggcgcggcttctatctgctggccgcgcttgcgaacgctgcaatcgccgtcgtgctggccctgcgcctgccgtcgcgtacgccgtcgatcacggccggctaccgcgcgctgctcgcgtcgatggggcgcctgctggccgacgagccggtgctgcgccggcatgcgctgtcggccgcgctcgcgatggccgcgttcagcgcattctggaccgcggtcgggctgcggctcgcgcagccgccgttcggcctcgacctgcacgggatcgcatggttcgcgttcgccggcgcgagcggcgcgatcgtcacgccgctcgcgggccgcgccggcgaccgcggtcacgggccggccgcgcagcggatcgcgcacggcacgatgctcgtggcactcgccgtgctcgggatcgcgggtgcgggctggttcggcttcgacacgcacgcgcatcgcggcctcgcgctcgcgctgctggcgggcggcgcggcgctgctcgacgcgggcgtgatcgtcgaccagacgatcggccgccgcgcgatcaacctgctgaacccggccgcacgcggccgcctgaacgggctgttcgtcgggctgttcttcatcggcggcgcgctcggcgcggcgctcgcaggcagtgcgtgggcgtggggcgggtggagcgcggtgtgcggcgtcgggttcgcgttcgccggcgcggccgccgtcttcgggcgctcggccggacgcaaagccggcgcagcggcattgactcgcccgcgcgcgtgagacgagccccaaagccgaacgccccgccctctcgcgagggacggggcgttcggcgcaccggcgtcggatcgaaatcagtgacggaccagcgccatcatcgcaccgaagccgacgaacagcccgcccgtcagccggttgaagatcttcgcaacgctctggctcttcagcgtcgcgccgatgcgcgtgccgaacgatgcgtagacgagataccagctcacctcgatcaccgcgaacgtgacgacgagaatgccgaattgcggcagcgtcggctcggccgcgttgatgaactgcggcagcagcgcggccgcgaacaggatcgccttcgggttgctgcccgcgaccaggaaaccgttgcggaacagcactccgcgcgatgccggcgtggcctggcgcggcacggtttcgacgtcggcggcaggctgctcgtcgtccacgcgtgcgcgccacgccttcacgccgaggtagatcaggtaggccgcgcccgcgaagcgcaacgtgttgaacatcgccggccaagcctcgagcacggctccgaggcccgccgccgacaccgacagcatcagcaccagcgcggagaggcagcctgccatcgtccatgccgaacgccgcagcccgtggcgcgcgccgtgcgtcatcaccagcagcatgttcgggcccggaatcgccgacacgacgaacaccgtcgccacgaaaagccaccacgtatgcaagttcatgaacgcctctgcctcgatgcaaggaaaacgaaacgtcgattatgccggtgcgcccgacttctgtcgcggggccgatcagcggcccgcgcggcgcagcgcgacttcgccgagcaccgcgaaatcctgttcgccgccgccgtgcgcaagcgcgtcgagcaggttgtcgcgcacgacgctcgccaccggcagcggcaccgacacggcgtcgccggcttccagcgccaggcgaacgtccttcagcccgaggcgcgccttgaagcgcgcaggctcgtagcgccgctcggcgatcatcgagccgtaaccctcgtagacgggccccggaaacacgctgccggtgatcacgtcgaggaagtcgcgcatcgcgacgccgtgcgcgcccagcagcgcggatgcctcgccgagcgtctcgatcgccgacgcgagcgtgaagttcgcggcgatcttcgcgacgttcgcgtgctgcggcagcgaaccgaaccgccaggtcttctggccgatcgcgtcgaacagcggctgcacgcggtcgatcgcctcggccgggccgcccgccatgatcgtcaggcgcgcggcggccgcgacatcggggcgccccatcaccggcgcggcgacgtaatggatgccgcgcgacgcatgcgcgtgcgcgagcgattcggccagcgcgaccgacaccgtcgccatgttgacgtggatcaggccgcgcggcgcctgcgcgagcagcgcatcgtcgaagatctcgcgcgcggcggcatcgtcggccagcatcgagaacaccgcgtcgccgcgaaacgcgtcggccggcgtgtcgacgatctgcgcgccgaccgcggccagcggctcggcgcgctcgcgcgaccggttccagacccgcaccgtgtgtccggccttcagcaggttcgtcgcgattgcctgccccatttcgcccaacccgataaatccgagatccatttcccgctccttctctccgtgaagcgggagttaaacacagatgcggggtgcctgcagggcacgcggccggccatgcgcggtgccatactgcgcgcatggcgatcgcgaccttccgcttccacgacgaactgaacgcgtttctcccgcgcgcgcagcgcgaccgcgcgttcgggcacgcctgcgcgcgcgacgcgacggtgaagcacgcgatcgaggcgctcggcgtcccgcataccgaaatcggccggctgtgcatcaacgacgcgccggccgcgctcgaccggccgctcgacgacggcgaccgggtcgaagcctttccggagcgcgcgcaaccggcagcccgcggagtcgccgcgccgccaccggggccatggcgcttcgtcgccgacgcgcatctcggcggcctcgcacaactgctgcgcctcgcgggcttcgacacctgctacgacaaccactaccgcgacgacgaactggcggcgctcgccgcgcgcgagggccggatcgtgctgacccgcgaccgcgagctgctcaagcggcgtgcggtcgagcgcggctgctacctgcacgcgctgcagccggccgaccagctgcgcgaactgttcgagcggctcgatctcgcgccgcacatgcgcccgttccggctatgcctgcgctgcaacgccccgctgcatccgctcgacgcggccgccgccgcgccgcgcgtgccggccggcgtccggcagcggcaccggcgcttcgccgcgtgcgacgtgtgccggcgcgtgttctgggaaggctcgcactggcggcgcatgcgcacggtggtcgacgcgatgcgcgcgccgccgcccgtccggctcgacgaaccgggcgaatcgggcgaatcgggcgcctgaaaaacaaaaccccgcatgccggagcatgcggggttggccgaccgatgaccggcaacgccggccgtggcggcaagccgctcagttctgcgtgcctgcgtcgttcgtgccggcggccgatgcggctgcagccttcgcctggcccttcttcgaaccgtggtgcttcagctggtgcttcggcttgctgtgatccttcttggcgggtgcggcagccgacgtgtcgcctgccggtgccgatgctgcttcctgtgcgaatgccgaaaccgatgcgagcgcgaatgctgcagcgatgatcgaagcgagcgtcttcttcattgttcttcctttagcggagaaaaatcaaacgtaccggtaagtaaagatgcgaggcattcgcatcggagccccaggccgcgaggccggcttccgccgttccgtcgcgacaaaacctgacgcactggttccataacgcaccgcattcgcggcgagttgacacgttgcttgcacccttcgggtttcccggaggcgtacccgtatttccctgtccgtgaccggttcggccgccgccgccgcggcgccgcaaacgcgctcgcacgccgccggggcgacgcttatactggcgtccatccgtccctttccccggaaaccggatcgcggccggccccgataccgatacggggccgccgccgtctcgaggcgctcaaattgcccgatcacaatctggacaaactgaagatcgaccggcgtccgctcgcatcggcgccccgcccgcgccggtggccccgctatgcggccgccgccgcgatcgtcgtcgtcgcgatcgccgccggcctcgcgctgaccggccggccagccgtcgacaccaccaccgtcacgtccgcctacccgtaccagaacgatacgcagctcaatgcgaccggttacgtcgtgccgcagcgcaaggccgcggtcgcgtcgaagggccaggggcgggtcgaatggctcggcgtgctggaaggcacgcgcgtgaagaaggacgaaatcatcgcgcggctcgaaagccgcgacgtcgaggcatcgctctcgcaggcgctcgcccaggtgaaggtcgcccgcgcgaacctcggcgtgcagcaggccgagctgaaggacgccgaaatcgcgttccgccgcaccgcggcgctcgcgccgaagggcgccgtgccggccgcgcagctcgacatcgacacggcccgcgtgaacaaggcgcgcgcatcgctcagcagcgaccaggccgcgatcgcgtccgccgaggccaacgcgcaggccgcgcgggtcgcggtcgaccagacggtgatccgcgcgccgtttgacggcatcgtgctcgcaaaacacgcgaacgtcggcgacaacatcacgccgttctcgtccgcgtcggacagcaagggcgcggtcgtgacgatcgccgacatggacacgctcgaggtcgaggccgacgtcgccgaatcgaacatcgcgaagatccgcgccgagcagccgtgcgagatccagctcgacgcgctgcccgacatgcgcttcgcgggccgcgtgtcgcgcatcgtgccgaccgtcgaccgctcgaaggccaccgtgctcgtgaaggtgcgcttcgtcgaccgcgacgagcgcgtgctgcccgacatgagcgcgaagatcgcattcctgtcgaagccggtgtcggcgcaggaccggcagcccgtgacggccgtgcaggcgagcgcggtggtcgagcgcgacggccggccggtcgtgttcgtcgtgaaggacgacgtcgtgcatgcaacggccgtgaccgccggcatgcggatcggcgagctcgtcgcgatccgcggcgtgaagcccggcgacacggtcgtgctcgcgccgggcacgaagctgaaggacggcgcgaaagtggccgtcgcgaagaagtagcgcacgcgtgaacgacgccccgccgcccctcgtcgagctcagccacgtcgcgaagtcgtaccggcgcggcaaccagatcgtgcccgtgctgaccgacatcacgctcgacatcggcgaaggcgacttcgtcgcgctgatggggccgtccggctccggcaagagcacgctgctgaacctcgtggccggcatcgaccggcccgacagcggcgagctgcgcgtgggcgggctcgacatctcgctgctcgcggaggcgcaactggccgaatggcgcgcggcgaacgtcggcttcatcttccagttctacaacctgatgccggtgctcaccgcgttcgagaacgtcgagctgccgctgatgctcacgcacctgtcgcgccgcgagcggcgcgagcgcgtcgagctcgtgctcgacatggtgaacctcggcgaccgcacgagccactacccgtccgagctgtcgggcggccagcagcagcgcgtcgcgatcgcgcgcgcgctgatcaccgacccgtgctgatcgtcgccgacgagccgaccggcgacctcgaccgcgcgtcggccaccgacgtgctcgcgatgctgcagcggatgaacgccgagctcggcaagacgatcatcatggtgacccacgacgcgcacgcggccggcgccgcgcgctcgctcgtgcacctggaaaaagggagctgatcgatgggcacgccggctgaccggctgcgggagcgcgcgcgatgtacgtgctgaagctgatcgcgcgcaacgcgctgcggcaccggctgcgcacgctgctgaccgtgctcgggctcaccatcgcggtgctcgcgttcgggctgctgcatacggtggtcgacgcgtggtacgcgggcgcggccgccgcgtccagcgggcggctcgtcacgcgcaacgcgatctcgctcgtgtttccgctgcccgtgagctacgagaaccggatccgcggcgtcgaaggcgtgacggccgtggtccgctcgaactggttcggcggcatctaccgcgacccgaagaacttcttcgcgagcttcgcggtatcggacaactacctcgacctgtacccggaattcatcgtgcccgggcagcagcgcgccgactacaaccgcgaccggcgcggctgcctggtcgggcgccagctcgcggatcagttcggcttcaaggtcggcgacgtgatcccgctgaagggcacgatctatccgggtacgtgggacttcgtcgtgcgcgggattctcgacggccgcgacgattcgacgatcacgcgccagcggtgtttcactgggaatacctgaacgagacggtgcggcagcgcacgccgaagcaggccgaccaggtcggcgtattcgtgctcggcgtcgcgaaccccgacgacggcgcggcgatcgcacgcaacgtcgacgccgtgttcaggaactcgctcgccgagacgctgaccgaaaccgagcaggcgttccagctcggcttcgtcgcgatgtcgaaccagatcatcgcggcgatccgcctggtgtcgtacgtggtgatcctgatcatcatggccgtgatggccaacgcgatggcgatgagcgcgcgcgaacgcacggccgaatacgcgacgctgaaggcgctcggcttcggccccggattcctcgcgctgatcgtgttcggcgaatcggtcgtgatcgcggtggccggcggcgggctcgggatcctcgcgacaccgcccgccgcgagcctgttcaagcaggcggcaggcggcatcttcccggtgttcaaggtgtcgaccgggacggtcgtgctgcaggccgcgtgctcggtcgcggtcggcttcgcggccgcgatcgtgccggcgtggcaggcggcgcgcgtgcgtgtggtcgaaggcctgcgggcgatcgggtaacgacacgcatggccatcccgctcaactacatcgcgcgcaacctgtggacccggcggctcaccaccgcgctgaccgccggcgggatggcgctcgtgatcttcgtgttcgcgacggtgcagatgctcgacgcggggctcacgaagacgctcgtctcgaccggcgaacccgacaacgcagtggtgatccgcaagggcgccgaaaccgagatccagagttcgatcgaccatcagcaggccaatgcgctcgagatgcactcggccgtcgcgcccggccccgacggccggccgctcgtgtcgaaggaagcggtcgtgctgatctcgctggtgaagacgtcgaccggcaagccgtcgaacgtcgtgatccgcggcgtgtcgccggccggcctcgcgctgcgcccgcacgtgacactcgccgccggccgcatgttcgcgcccggttcgtcggaaatcatcgtcggcagcgcgatcgcgaaaggcttcagcggcacgcagctcggcgacagcctgcatttcgcgcagcgcgactggaccatcgtcggcatcttcgacgcgggcggcagcggcttcgattcggagatctggggcgacgtcgaccagctgatgcagtcgttccggcgcaccagctattcgtcgatggtgctgcgcatcccgagcgccgacggcttcgcgcgcttcaaggccgacatcgacgtcgacccgcggctgaccgacgaggcgaaacgcgagcagaccttctacggcgaccagtcgaaggcgctgtcgaagttcatcaacatcctcggcatcacgctgtcgacgatcttctcgatcgccgcgatgatcggcgcgatgatcacgatgtacgcatcggtcgcgaaccgcgtcgccgagatcggcacgctgcgcgcgctcggcttcaagcgcaggaacgtgctcgccgcgttcctgctcgaagcgctgctgctcggcttcgtcggcggcgtcgcggggctcgcgtgcgcgtcgctgatgcagttcgcgtcgttctcgacgaccaacttccagaccttcgcggacctgtcgttccgcttcgtgctgacgcccgcgatcgtcgtgaagacgctgctgttctcgctcgtgatggggctcgtcggcgggttcctgccggcgatgcgcgccgcgcggctgaagatcgtcgacgcgctgcgcgcgcagtgacgcgcgccgccgctcacgttcaacgctcgcgcggcacccacgcgccgtggaacccggccggcacgcggcgcggcaggtgcacggtcgcgaccggccccgcgtcgatcgcgcgcgcatcgaggatcacgacgtcgctggtatccatcgccgcgcggtagaccatcaccagcagccagccgtcgtcctcgtcgacgccgcccgggcgcggcacgaacaccggctcgctgttctggtcgccggccggcaccgcatagcgcgtcgtcgtgccgctcgcgtggtcgaagcgcatcacgccgcgcatttccgcattgttcggctgttccaccgcatacaggtagcggtagcggcgccccgtgcggctttcgttgatgcgcggcatctcgatgccgccgtcggcgagcggcccttcgtcgatcagcccgttcgccgtatcgatcacgtagcgccacagctcgccgaccgggttgtcggcgaagcggcccgtgcgcgcgtcgagccgcaggaaccacggataacgcaccgcatcgagcacgatgcacgacgcgtcgcagtcgtacgcgttcacgacgtgctggatgaagcacggctcgatgccgaaccagcgcaccgcgccgccgtggcgcgggatcacgccgatgcgcgcgggccggtcgtcgtgccagcgcaacggcatccggtggccctgcttcagcagcgagaagtcgtagccgacgttcaggtcgagcagcaggctgcgggtttcggtgatcgcgaggtcgtgcatcatcgacggcgcgttcaggtcgatttcgatctcgacgcgctgcacgccctgcgcgtcggccacgccgtagcgcagccacggcgcacgccagtccgcacgaaaggcaatcagctcgcccgttaccggatcgaccttcggatgcgcggtcatcccgccgccaaggcccgcgtgccgcgccgtcgcgccgagcgaatcgagcgcggccgtgatcgcgagcggcgcgccgccctcggccagcgcaagcaattcgcccgcatgctgcagcacgttcacgttcggattggtgtcgggaagatgcggcgcctgcccggtgcatgcaccgcggcccagcgctgcgtgcgtgcccagcggttgcggtagccggtcgcgcggccgccttcgaacgcgatcgcgtgcagcatcgcggcttccggccaccacgacagcatgtcgttcccttcgaagcggccgcctggcggattcgggccgttgcgcagcaacgtgccgtcgagatcgtgcgggacggcgccggtcacgcgcagatcgacgagatcggcctcgtcggccaccggcgcgatcgcgccacggttcaggtcgaatacggtcattgcgtcggaagctcctttcagcagtcgtcggtggacggcggcagatcgccgcgcgccagtgcgagcgcatggtcgcgcacgtcgtccggccagccggcgatcagcccggcgagccgcgccaggtcgttcgcatacagcgcgcgcgcgcctcctcgaaaccgggcaggtcgcccgccatcgccgacatgaagtggtaggcgcgcgcctgcgcgtcgcgcagacgatcggccgccgcatgcgtgcgccgcgcgtcctcgacgagcttgcgcaatgcgacggacgcgccgcccggctgcgcggcaagccattcccagtgacgcggcagcagcgtgacctcgcgcgacacgacgccgagcttcggccggccgcggccgcgcggttcgcccgcgccggccggctcgccgacggccgcggatgcgtcgtcgcccgacggcggcgcgaagcgcgcgcgaatctcgtccggcgtgccgcgcaggtcgaggtcgatcgagcggccggtcgcgtcgtcgaagatcaggatcgtgccggcggccgcgtcgccggcctcccgggccgcgagcgcgaccgacacgagcggccccgtcgcgagccgccggtggccgtcgaacaccgtgtacgaaggaagaagcgtggaggttgtcatcgtggtcgcctgcaggcaggaatcggaatggcgctattttcatccgggtataaattgaatgtcaatatcatccgggtaaaaatatcgccagtctcccgccgcgcggacgaccgcgtggcgcggtcagttcttcagcgccggcgtcgccgcgccgcgcacgctcgcgagcacgtcgtcgagcgacacatggccctcgaacgccgacgaagccggcagccttcctcgacggcgtgcgcgaatcgcacgccggcatcgtcggcgagccgcgcccgcagcgcggcgatgcgcggaacgcgtcgcggccgatcgatccaaagactgaatcgatcaagtcagtaattggcatgaaagcgcaaatatcgacatgacagaatgatccggacgccccgctccggcccgcacgggcctcggcgtccggcctccggccggcagcaccgtcacccagaaacgcgcgctttcgacgcgccagccgcacgacggcaccttccgcccttcggaggagacagtcatgaatccgcttcacgcgctgccggcgtccgcgtcggcaacggcccggcgcacccgcgtgcgctggctggtgctggccgtcctgttcgcggtcacgacgatcaactacgcggatcgcgccgcgatcgcgatcgccggcccgagcctcgcccgcgcgctgcacctgagccacgtgcagatcggcttcatcttctccgcattcggctggtcgtacgtggtcgcgcaactgccgggcggctggctgctggaccgctatggatcgcgcatcgtctatgcgttcagcatcttcttctggtcgctgttcacgctgctgcagggcacgatcggctttttcggcggcgcggccgcgttcgcgctgctgttcgggctgcgcttcctggtcggcgcggccgaagcgccgtcctttccggccaacagccggatcgtgtccgcgtggttcccggccgccgaacgcggcaccgcgtcggcgatcttcaatgccgcgcagtacgcggcgaccgtcgtgttcgcgccgctgatgggctggctcgtgcacgcgttcggctggcagtcggtgttcgcggtgatgggcgtgctcggcttcgcgttcgtgctggtgtggaaccgcacgatgtacgacccgaaggaccacccgaccatcaaccgcgcggaactcgactacctcgccgaaggcggtgcgctcgtcaacatcgaccaggcgacgggcggccgcgacggcggcccgtcgatgcgtcacgtgaaggcgctgctgaggaacaggatgctggtcggcgtgtacgtcgcgcagtactgcatcaacgcgctcacctatttcttcatcacgtggtttcccgtctatctcgtgcaggcgcgcgggatgtcgatcctcaacgcggggctcgtcgcgtcgatcccggccgtgtgcgggttcctcggcgggattctcggcggcatcgtgtccgatgcgctgctcaggcagggccgctcgctgtcggtcgcgcgcaaggtgccgatcgtgttcggcatgctgctgtcgatgtcgatgatcgtctgcaactacaccgattcgcacgtactcgtcgtgctgttcatggcgctgtcgttcttcggcaagggactcggcgcgctcggctgggccgtcaacgccgacaccgcgccgcgccagatcgcgggattgagcggcgcactgctcaacacgtgcggcaacctctccagcatcacgacgccgatcgcgatcggctacatcgtcgaccgcagcggctcgttcaacggcgcgctcgtctatgtggtcgcgcacgcgctcgtcgcggtgatctgctacgtgttcgtcgtcggcgagatccgccgcgtcgagcttcgatgaacggtgcgggccgcaccggcccagccggcggcccgtgcaccaccggaaccaggagcgaaccgatgtccgaatcccgccatgccggcaccccgcgcgtcacgcgcatgcgggtgattcccgttgccggccgcgacagcatgctgctcaacctgtgcggcgcgcacgcgccgtacttcacgcgcaacctcgtgatcctcgacgacagcagcgggcacacgggtgtcggcgaagtgccgggcggcgaaggcatccggcacgcgctcgagcgcatgacggatctcgtggtcggccagtcgatcggacgctatcaggccaccctcaacgcggtgcgcgcggcgctgtccggcacgggcccgggcgcgggccgcacgatccggcacgaggtgacgtcggccggcgaggcggccgtgctgcgccagccgcacgagatcaacctgcggctcgacaacgtgatcaccgcgatcgaggcggcgctgctcgacctgctcgggcagtttctcgacgtgcccgtcgctgcgctgctcggcgaagggcagcagcgcgacgcggtgccgatgctcgcttatctgttctatatcggtgatcgcggccgcaccgacctgccgtatcgcgacgaggcgcaggcgcacgccccgtggttccggctgcgcaacgaggaagcgctcacgccggccgcgatcgcgcggcaggcggaagccgccgtcgagcgttacggcttcgccgatttcaagctgaagggcggcgtgatggccggcgccgacgagatggaagcgatcgccgcgatcaaggcgcgcttcccgacgcacgcgcgacgctcgacccgaacggcgcgtggtcgctcgacgaggccgtcgcgctgtgccgcggccaaggccacctgctcgcgtatgcggaggacccgtgcgggccggaaggcggctattcgggccgcgaggtgatggccgaattccgccgtgcgaccgggattccgaccgcgaccaacatgatcgcgaccgactggcggcagatggatcacgcggtgcggctgcaggcggtcgacatcccgctcgccgatccgcatttctggacgatgcagggctcggtgcggctcgcgcagctgtgccgcgactggggctcacgtggggctcgcattcgaacaaccacttcgacgtgtcgctcgcgatgttcacgcatgcggcggcggccgcgcccggcacgatcaccgcgatcgacacgcactggatctggcaggaaggcgacgcgtggctcacgcgcgagccgctcgcgatcgtcggcggcaaggtggccgtgccggagcggccggggctcgggatcgagctcgacatggcgcaggtcgaggccgcgcatgcgttgtacaacgcggtaggcgggacggcgcgcgacgacgcggtcgcgatgcggtatctcgtgccggggtggacttacgatccgaagcggccgagtttcgggcggggtgagcctgacggtgggcggtggttgccaaacaccggaaacgcccgcatcctgccggctgcctgagccggcacgcttggcggacggttcggcgccctcccacccaacgtgaagcgcccgccatgacgtctcctgacccaacaccgcggcaaatcgtcgtcttcgtgctgtattcggtgctgtgcctgcccgcgagcatgaccgtcgctggttatgccgcgacccggatcacgcagaacgtatcgaatttcgaaggcggtgcaggctacgccgcgctctggtgggtcctcattctgacctgcgtgttctgcggactgtcgatcgccctcttcgcgctgctgcgcaagaggatcgcgatccttgcggccatcacggtggcgtttgccgtgctgtcggtgccggcgttcaggttcattcacggattgctgacctgacccgcccgtcgtcgcacgacgctgaccgcgttaccccacttgctcgcaatcgcgctcagtaccaatagccctggatgccgtagttcgtgccgtgacgtcgcccccaccacggcggataggcgtcgtcttccccgcggatctgcctcgcatcaagcagtcggttgcatctgagatttttacacggaacactggcctgcttggcgacgagtcagggaacgacttgattacgcagtcgtgtcgagcctcatccggcaccgacacgttcacggtcatatttcgttatgcgtggtgattcgatgattgccaatgtcgaacagatgtccccaacgctctacccgcgcccctcagcggagaggcacggatagaacgaagcagttgtgatactccggcagaaatcgggatacacccgcgcgcccggctcaggaacgtccggacgtaggcactgacgaaatgagtaccgcgccgcacgacgtcttgtgaccgtcgaacgacgcggatgcaccctccacgtcgaaaccggcatcaccgtcgatgatcacgacctcaccgtgcagcgggcacgtgcagcgatctcctgacgggcgactgcacgtcccatgacttcactgttcgcggcaccggtctccacacggccaccgtggctatggacgtctcctacgcgaatgatgccgcgcatggcttctccttaatacgaatagccctgaatgccgtagttcgtgtcgtgacgtcgcccccaccacggcagataggcgttgtcttcccgcgggcgcggaaccagtcgctatttggattgatcggcgtgagcttcgacggcggcaaaacgacaacggcagtcggatggcccgcatccgttgtgcccgcaaccagggcattgccgccgaagtgattgacccggccgatcgcgagcgcgacgtctgtcagcgccgtgcccgcgcccatgtcgccgagcagcgccggcgtattgaagacctgcttcttatagtcgaactccggcagcgtttccgtgagcgtctgcgacaacgaggccagacgcgccgaggccgtatcgctgcccttgcctgcgtcgtgcacgacgaactgaatgcttgcaggttcgacgttcgcgttatgggcggcctgcgcgatcgtcgccttccatgcctggactgcacgcgtggtcccggccttcgcctcgtagtcgctcaccttgcccgtcgcagccttaccgatccatgcgagcggctcacgttcagtcttcagatcagggcccgccagaaacagcacggtgaggttttcgttcatctgctcgtctttgggtgggaagctaggcgcgtcccagttcatcacccatacgctttcctgcgggtgcgcctgcagatagtcgagcgcggcgttcagcgacgtgaaaccagcattggcaccgccaacgtggagttgaatatccggaggcgtatccttactccacagatcggggaaggatttgctcccaattgaaaaggccgtgatcatttcatcgctaaggtgcgaacgcgcctcctgtggcgacagtcgtgagggaatcgcgaattcaatacggatgcccgccagctctcgccagtgccgcctctcggacggctggaccgtataaaaatactgtccattcatggcgtacttgctgtaaagcaatactagaaacgcgtcaatatacttctcatagaacccatcgaagctttcccttccattcgagccatacgcgataccggcgactgggcgaactgtactgaatcctttgggatccgttctgaccatatcgtcgttcctgttcggcttgaccagccccatcgtccacagcagttgccattccgtcggatagtcacggcgctgcagtggattgagccattccagcccaacgacctgggcgagaaacggtttctcctgcataggagccgacggtgccggtgcggaagcggtctgagcagcctcgactgttggtactgcccatgcagtgacaaaagcgaaaactgcaactcctgccaatgctggcagtcctatccatcgagtcatttcctctcccatacttcgcgtgtgcgcaccgtgattgaacgcctcaacggcaacgatactaatcactaggagtgctccgaacaatgccagtgccagccggcgtggtcgggacgcaaacagcgatctcataacgctccccgattccgagcatcgcaccaccctggcgcgtgtcatcgattgaagctggcagcgtcgcctcctggtcatttgcgatccaatccacaagcgatgtttttcatcgtgccaaacttaaagtactctgaataaggcctgttcgaattatttttatctaactgccgaccaaatcgccaatccgcttcgattctgaagtcgttcaactgttgctgggaaatgcgacaaatgccgatcgcgacatcgtaagccagcgccaacctggcgtgctttggattagtcatgatcgtcgagtggttcgtcgggttattcacagcctcgccgaggatatgcacgatctgcttgtttcgccatttttcatacccgtcgggcatttgggcgttgggcccagcctctccgatgaccacatcgttcctgacccactctgaattgtcgtcgtgacgggcctccatgcgcgcgattgcatggtcctcatagcgttgagatgcctcgctgtccgcgtcacccttgggtgccatctcggctgcatgcttgcctttggccttatatgtgtcatacggatcggccgtgttgatggttgtcttgttcttgtttcgcgcagccgccaccggatcgttatcctcattgaaatcactttcggcatcgccgtccttgacttgcacgaccgccccatagcggatcgcctgcgggaagaacggttccggcaggccaggtgcatcacacagtacgtgccagtccttcggaggatcggcgttggtgcgaaacatcccaagagccgagctcgccatcgtcgcgacaataaacaagggcgccacgcctatggagccaaccttcccataccaatgctcattgccgcgcagcgccttgaccaagttgtatttggcaggtggcgacgtgggatagaaaaacagcttcgacgagccctttttgtaacgccagtcatgctcccatgtccgatagatgacagggttctcctggccgacctgaaagttggtggcaaacacacgctgcgtgaacaagctcgagcccttcacgagttcgacctctttcggatgcaatcctcgccagcccataccctgaaccggggccgcggaaatcacctgatcgtgcgggcacgagtacaaggtcacgcgcccgtatgtgtagttctggacgccataccgctttctgtcgtcgtccgggtcgtacgcgggtttgccgtcttcgcccgggttcatgtttgccatcgtcatccggtaatcgagcgggtcgcgctggtcctcggcatccttgctctgtgcgatcagttcaaaaacgctttcagggtatttgcccgcgcctgcgaattaactcgaccgcggttgccctttgaatcgcggacgtcgcgctgtgaccagtcctccatgaatggtgaattgtcgccttcgatggatccgacgattccgtagggcggattggccagcacataggtgtcggccacgcatctcacgccggcgtctttcgacagccgatcgccgaggaacgccgaggcgatgcctaccatattgccctggctatggcacaccaccgtgataggaacatccttttgaaccttccggatcgacccgatgagtttcgccaaacgcagtgcgcccatcacgttataggcgcgcgccggcgtctcgtagatctgacgcgatgtaggattaatactctggatattgatgaacccgaagatgcgcggatcgacgcccgcactccacaggtcaggcaggctgccgcagccatttgcgaacggaccaccgccccagtagttctgctcgttcagaaagatcgacttcccgtaacgcttcaaatccgcggcgtttgctttgtagccccagcggaaatggatgacgggcgagtaggtattttcgtctggctgtagatacgtaccagcccaaagcttcgggttgatgaacccatcttcggtcaggcccttcatataacgcatcggccccatctgcccgcccttcggcccgcggtgcgtcaactgatcgtccagacgaccgagccgctgattcaggccggcgcacaatccctcttcgcccggctcgaaccactcgccctccgagttgaccccatgcacaaaaatcacgatgcccggcaacggcatctgcatcacgcacatgtagtcggattgactgagcgtcatcacgccattgccgtttgcgaccaaatagcgattctgcgaatcgtcctcgtcacccgacgacaccccgccggaaggcgtgcgcggatcgagaccgccaccgtcgttcgcttcggcctgcgccgatgaattgttttcagatgcaaccggactggccggtgctgtatcggctgtgtctgccatgattgttcttatccccggtcaggtcttgttcttgaagaaattcacgacgaacggttcgaactggttgctctggataggggcaagcttgcccgcggcgtcggatttcccttcaccacttcacccgatgctttcgtgatctctgcctgcatgccctctacggcctgcccatccgtcgcccgcacaagcttcggcacgcgcccaagcggcgcatgatcgaacttcggcatgtccgtgctcatgctcgccggcccctgccacgagtgccccgcggactttaccgtgaacgagcccgggcaccccagctcgatatcgctgccgtgcagtttcaggtaggcaccgccggatgtcgtgaagaccacctcgtcgctcgccatgccggcaagcttgccaccggccgccgtgaactgaatgttcttcgcggaatcgatctgcgtgtcgtcattctggctctgcagcgtcaccttgccctgattcgcgatcgccgagaccccatcgctgtgcgcgaacatcgcgaccccacggccgccgtgcagcgtgatgcgctggccgctggtcaactgcacatgttgctgcgcaacctgatcgatgttctcgccagcgtaggtcacgtgggtcttcggcgtcatcgcaaccgagccggcttgcgcgccgaacgccatcagcgcctgcgatccggtcgcatcaccggttccggtggtcgacgccccgctaccgctacccggcgtccatcccttgaacgccgcggcgactgcctgctggcccgccgtatcgctcgcctgcccgccatgctggccggcgtagtcgcccagtgacttgaacaactctgtgcactcgccgagcagccgcagcagctcgtcgcgatcgagctgaccaccgctcgcctgcgaacgggcgtaggtcgtcaggagaatcccttgcgcggcgcgcagcgcagcggccgcgtcggtgcgtaattcagcgccctctccgcgatcctggcctcggccgtcctgacgaggctgcgtcagatacccgaggttcagctgggaatgtgcatgctcactcgccaattggctggaaatctggcccggcgtatcgtcgagacgcagctggttataccggaacccctgatctccttggtcttgatacctgacacatagcggttgccaggagattgccgacgtgggtgaacgccgccggcggattcacgccattgctcagcacgttgatgatgaccagccggtccgggtcgccgccgaggctgccgatcaggacttccatgccgacacgcggcagaaagagcgccccaaagcttccgccggcaagactggcgccgacccggatcggcgcactgtcgccagcgttgtcgttcgtgccagctcctgcgcgtgcgcatggtccgccggatcgagaccgtggatccgcacgcggacgcggccgtcggcatcgcagaacacttcgtcaccctgttgaccgacgatcgtgccggtcaacaggtgcgcgggcggcagatcgaccttgggatcgtacgccggagtaagggcacgccgcgccgcacgcaggtgaaatggttctcgtagcgcgtgtcggattcggtctccgccgctggcagctgcgatggtgctggataagcgaggttccggctcgcggcaaacagcgcctgcacgcggtcggtcagtccctttggtaagttattccagacatcatggtcgatcgacgtgatcacgaactgccgatggtcggacgactgcatgtcccattcggggtcgccggccaacgtaatccacgcgcctacggccaggtcgcgcacgctgctcacgccgtcgtaacgctcggcttcgaactgatgcgcgagcatgcgggcgcgtgtcagacgctcgtgatcgttccacgaatcgcccgcatgcgggatgtcgatggcgacgtcggtaagcagttgtgccaggtcgttgccggactcgccctgattgagactcgtcgcgaccgtcgattcgtcgatacgtgccttcttgtagtcccacgacggacggccgacctgacccggggtcagccgctgatgcagtgcgaacagcgtaacggtgtcgcgctcctcggtggcagcatcgcgcggatgcaaccgaaccgtgccggccggtgcctcgagcagcaacatcggatcatcgcagcacacgagcgtatgcgcgggcgtgccatcgcggccgtcgacgccgcctttgaccggaccggccttggcgaacaccgtgatgccctcgcgccgtaacaggcggcgcacgaatttcgcatccgattcattgacctgtcgagtcagttcgcgcgccggataccggtcgcggctcaagccggacaagtcgaattcgaacgccgcggccagtgccgggctgcgccgacgccattcattaaacagcgtcgcgagaatgtcgacgacgctgctctggcggaatacgcgggaattcgtgcgcttgtccatcaacgacagcgcgtcgcacaccgtaagctggtacacgcacagctcgccgtcgctctggccgatctgcacgtcctgcacgattgcgttgacgaagtgcaactggcctcggtcggtaacgagccggatcgagacaggaacgccgaggaacagtcgcggagacaggtcgtggcgaggagacacgcaggtcagatgcccgtgaataccggtcatcaacccttcgtgcaggtgcgcgtgctgcagcgctagcaagtgtcccaacgcgccttgcgccttgccgaaattcaaggctaccggccgacgattccagtcgactacccccgacgcaaaactgcctattgtttcgcttatcgacacactcgctctctcaatattgttacaaacgtattggattcggctttgcggctcgcgtcacggcacggtcacactaccgatttgtgacagtgaggatatcaaatttgcaggagcgattcggtgcccgacgaacatctatgcagtttgtcgacacaatctgactaaaattgaccgaattccgccggtagcggataaggcgccggcatttcgtccgcgcggacgaccgccggccaagccacttcggcaggtgggcgcacggcaacagagtcacgtgcgtgctcgctgacgtcgagcagaaaagcaaaaagccggctcagggccggctctttgtcagcgaagccataaggccacgctttgtacacggaaggataactttggtgatgctaggaattccgttggtggagcggaggaggatcgaactcccgaccttcgcattgcgaacgcgacgctctcccagctgagctaccgccccaacagtcgaccatcatacacacgcatttctgcgcttggcaataggggttgagtcacccctgaagcattactttgacggcgcaccagccagtacccattcgaccaccgaacgcgcgtcggcgtcgctcatgcgcggatgcgccggcatcggaatcgcgccccagacgccggagccgccctccttcaccttcttcgacagctttgccacggcctgcggatcagccttgtagcgggcggcgacttccttgaacgacgggccgacgagcttgcgatcgaccgcgtggcagcccatgcacgcattgccgcgcgccaccttcaggccgtcgccgacatccgcgtgcgcggcgcccagcgtgcccgccacgagcgccgcggctgcagcgccctgcatcatccactgtttcaattgcttcatctgcgtgctcttcattgcgacggtgccttcgggttgcccgggtgcacgctcgacgaattcgagatcggcgcgggcggctgcagcggcgtggactgcaccgacgcgtcgggcacggcgcccaccgtcgcggtatccgccggcgcggcggcctgcgcaccggacgcgccgctcgcgggcgacgccgcctgcagcgcctgcgcgtcctgcggcttcacgtactggaacaccttcacgactttctcgacgccgggcacctggctggcggcttccgcgccgcgattgccctcgtcgaccgtcacgagccccatcaggtaaaggttgccgcgttcgctgaccaccttgtagtagttcgccgagatgcccttcgtcgcgatcagctcggacttcacgcgcccctcgaggtacgagtcgttggcgcgcgacgacagcgacgacgccggctcgaccgacagctcgttgacgatgccgttcacgttgttgatgccgcgcacgatttcctcggcgcgctgcttcgatgcatcgttcggcacctcgcccgtcagcagcacgcggcggttgaacaccgtgacgttcacgtgcgactggtcgggcagcccgttgttgatctgcgtgagcgacttgacctggatctcccggtcctccgtctgcgcgccgagcgtacggcggtcggtcgcgaccagcgcgccgccgccggccgctgcgccgacgatcccgagcacacaaccctgcagcgacacggcgagacccgccgtcagcgcggcgagcagcgtggttctgacgagcgtctgtttgacgcggctttgattcatcgacggctctccttcgttcaatcctcacccagcagcatcgcgtcgatgccgtcgcacaggcagtggatggtcagcagatggacttcgtggacgcgcgccgcacgaacggcgggcacgttgatcggaatatcggtgtcggacagcgcggccgcgactgcatggccgtcgccgcccgtcagcgcgacgacggtcatctcgcgctcgtgcgcttcgtcgatcgccgccagcacgcgcggcgacgcgccgcccggatcgagcaccagcaggatgtcgccggtctggccgagcacgcgcacctgctgggcgaacagttgctcggcggacaccgcacccgcgaggccgccctgcgacgcatcggtggccagcgcgatcgcgggcaggcccggacgctcgcgctcgaagccgccgacgagcgacacggcgaggtagtgcgcggcggcggccgacgggccgtcaccacacgcgacgatcttgttgccgttcgccagcgcggcgaacatcgcatcgaccgcggctgcgatcggcagcgacagtgcgtcggccgcttcggcgtgaagcgcggcgctgtcgcggaaatgttgctgaatacgttcgactgacatcgattcctggtgaactgggcgcgcggcacgcatcgcgcgacatcgtgggtgcggcgagtttaccgtactccggcacgctctccggggtccggcaagaactctttacatctcgtcacagctcgcggctacgcatcgtcggcacgaaatgcgtcgcgcagccactcgagccgcccggcctcgaacgcgacgacgtcgaagcggcacgcggcaccggcgccgtggcgcgcccagaactggagcgcggccgccaccaggcgccgccgcttgcgccagccgacgctcgcggccgcgccgccatgccggacgctgcgccgcgcgcgcacctcgacgaacacgagcatgccgtcgggctcgcgcatcacgagatcgagctcgccgccgcgcatcgtcacgttcgccgcgacgaacacgaggccgcggcgttcgagaaactgccgtgcacgctgctcgaacgccgcgccgaccggcctggatcgcgccgcgccggaaaagttgtcgcccgcgcgcggcaaaccgcgcccgtcgcccggccgcgccggcgccgcgtggcacaatgccgtccttgttccgcttgcgccgcgattgcgcgcattgcctgccatgactgccctcctcgaactcgcgcaaacgcagcactacccggaagccgcgctctacgtggtcgccacgccgatcggcaacaccgccgacatcacgctgcgcgcgctgcacgtgctcggcctcgccgaccgcatcgcggccgaagacacccgcaacacgggccagctgctcgcccgctacgggatgtcgaagccgctcctcgccgtgcacgagcacaacgaacgcgaagccgcgcagcgcgtgatcgaactgctgcgcggcggcgaacgcgtggcctacgtatcggacgccggcacgcccggcatctcggaccccggcgcgcggctcgtcgacgcggtgcgtgccgccggcttcgcggtgatcccgctgccgggcgcgagcgcggcggtgaccgcgctgagcgtggccggcgactgggccggcgcgttcacgttcgcgggcttcctgccgccgaaggccaggcagcgcgcgaccgcactgcaggcgctggtatcgcacccgtatgcgctggtgttctacgaagcgccgcaccggatcgccgaaaccgtcgccgcgctcgccgatgcgttcggccccgcgcgccggctgctgatcgcgcgcgagctcaccaagctacacgagcagctgttccagggcaccctggccgaaggacagacgtggctcgccggcgatgcgaaccggcagcgcggcgaattcgtgctggtcgtcgaaggcgcgccggcgacgagcggcgaagccgacgacaccgcgcacgacgcgctgctcaggctgctgctggaagaggtgccggtgaaaagcgcggcgaagctcgcggccgcgctgacgggcgcgtcgcgcaacacgctgtatgcgcgtgcgctcgcgctgaaggatgaaagctgacgtgccagccggccggtaccgggaaaccggtgccgacgtcgcgccgggcaggaaagacaaagggctgccctcgggcagccctttgcatgagcggtcgatccgccgcgttacttcgtcgagaccgacgcgagcatttcgtcgcgtgcctcgcgcgcttcctgcggcgacagcccttcgatcttcacgcggcccgtgccggcgtgcacgaggccgatcatcttggcagcggcatacgacaggtcgagcacacggccgcgcttgaacggcccgcgatcgttgaccttcacgacgacccacttgccggacgacgcgttcgtcaccttgatgtacgacgacagcggcagcgtgcggtgcgcggcggtgagcgcgttcatgttgaagcgttcgccgttcgcggtgcggcggccgtggaaatcccgcccgtaccacgatgcacggcccgtctggcggaagtcggacacatccttgccgtcgatcggctcggcgtccgccagcgacgacttcttcgcgtccttggcgtcggcagccggcatcgacgccagtgcggaatcgaaattcagttgctgcttgtcgttgtccgccttcgcggcactggcggtcttgtcgaccgcgttcttctggttcgcgcttccggtggtctggctgggtggcaccgcgcagcccgtcaacgcgaaaaataatgcaatggtcccgaaacgagtcggaaatcgtacgttcatcgacgtgtcgccttctggttcgggccgctccttcgtcacgccgcttcacagcgcggacacgcggcccggacggcaaatgcacgccccgctcggatgcgagcaggcggctagcatgggcgcggctttcgtctatgccgcaaccgtcctgattagctttcacgtctggcgcaacctgtccccaacagcctgaccagaccccacatgccgccatcgaacatggctttcacgttcgcgcgcgtcgaaacgaccaacgcacaggaacggcggcacaggcctcatccggcggcgcggcagcagggccgcaggcgggcgcgcagcacccggccggacaagacgtgagcaccgaatgctcggtgctggatacaccgccggactccccggcggctgatgcttgacggtgcttccgacacccctttaacggggccgaaacaccagcgaatggcgtgaaactcacgcgcaatggagcgcattatacataaatcaaaacgctgtcctgaaaagcaccgccggcggaccattgattctcactatggctgtaacaatcgacatgctccgggaatgcccggaggcgcgcaccgcgacgcacgtcgcgcggccggcaagcggcacgcgcgaccggtacaatcgctccttttagccgccggtgcctccatgaaagtcacgctcattccggtcacgccgttccagcagaactgctcgctgctcgtctgcgagaagacgggccgcgccgccgtcgtcgatccgggcggcgacctcgaccggatccagcaggaagtcgcgcggcagaacgtgcaggtcgagaaggtgctgctcacgcacgggcacatcgatcactgcgcgggcgcgaagacgctcgcgacgcactacggcgtgccgatcgaagggccgcaggaagaagagcgcttctggatcgagaagctgccgatgcagagcgagcgcttcggctttccggccgccgaaaccttcgagccggatcactggctgaacgacggcgacaccgtgcagttcggcgacgagacgctcgaggtctatcactgcccgggccacacgcccggccacgtcgtgttcttcagccgcgcgcatcgcgtcgcgatcgtcggcgacgtgctgttcgccggctcgatcggccgcaccgatttcccgcgcggcaatcacgaggatctcgtccgctcgatcaaggagaagctgtggccgctcggcgacgacgtgacgttcgtgccgggccacggcccggtgtcgacgttcggcgacgagcgccgcacgaacccgttcgtgtccgacaaggtgttcggatgaaccagaccgccatcccggaaatctacgtcagcaccgacgtcgaggccgacggcccgatccccggcccgcactcgatgctgagcttcgcgtcggccgcctataccgaggacaagcagctgatcgcgaccttctcggccaacctcgagacgctgccgggcgcgcaggcgcacccggtgcaggaagcgtggtggaagaccgagcccgaggcatgggccgcgtgccggcgcgacctgcaggcgcccgaggcggcgctcgtcgcgtacgtcgactgggtcgaggcgctgcccggcaagccggtattcgtcgcgatgccggccggcttcgatttcacgttcatgttctggtacatgatgcgcttcgccgggcgctgcccgttctcgtggtcggcgctcgacatcaagacgctcgcgttcgcgatgacgggcctgccgtaccgcaaggcgatcaagccgcgttttccgaagcactggttcgacgaccatccgcacacgcacgtcgcgctcgacgacgcgatcgagcaaggcgcgctgttctgcaacatgctcgccgacctgcgtcgccagcaggccgcgctcgcgggcctcgcggtatcggacaccgatcggtcggaaaacgcgggggcgggacaaaaccccacggatccgcgagcaaattagcgaatctcgctcagcaacgcgacgccagattgcctttcctttcccggccctctaacattcagcatgttgttgctgccgcatggaggcgcaggtgacgctcgattccttttcgcaaaaatccttcgcctgttgcagctcgacgcgcgccgttccgttcaggaaatttccgaccaggtcggcctgtcgagcacgccgtgctggcgccgcatcaaggacatggaacagtcgggcgtgatccagcgctacacggcgctgctcgatcgcgagaagctcggcctgcacgtctgcgcgctcgcgcacgtgcacctgacccgccacaacgaaggcggcgtcgagcagttcgagcgcgagatcgcgacctgcccggaagtcaccgagtgctacagcacgaccggcgaggccgattacatcctcaagatcgtcgcgccggacatcaaggcctacgacgtgttcctgcacgaacgcatcttcaagattcccgccgtgtcgcaagtgcgtacgagtgtcgtgctgcgcgagatcaagttcgacacgcagctgccgctgtaacggctgtcacgcgcacgccccgccggcggcaggtcacgcctgcgcgggcatcgtgcgcgtgaagccgatccggcgcgcgccgaactcgcgcttcagcgcgtcggcgtcgagccggccggccagcgccgcatcggtgtcgtgcggatcgcacgcaagcgtcacgtcgatctcgagccccgtgctcaggtaatgcaggttgatcgccgccgcatgcagcccgcgctgcgcgagcgcggcctcgagccgcgccgcgatctcgccgcgcggcggcagcgcgagcgccggacggcgcgccgcgtcgttctcggggtcgacgtggatcagcgcgtcgagcacgcgcgggtcgcgcagcacgcgtgcacgtgcggtttccgcgatgtaatgcccttcggagacggagatcatcggatcgacgaggatgtgcgcgtcgacgagcgccgcatcgcccatcttgcgcgtgcgcaggtcgtgcacgtcgcgcacgcccggcgtcgcggcgagcagcgcgcggatctcggccgtatcggtggtgtcgagcgcgcggtcggagagatcctgcaacgcgtcatagccgaacgtccagcccatgcgcgcgaccatgaagccgacgatcgccgccgcgatcggatcgagcagccgcacgccggccaggctgccgacgatgccgatcgcgacgacgagcgacgaagcggcatccgaacgcgcatgccacgcgttcgcgacgagcatcgccgagcgcacgcgccgcgcttcgcgcagcatgtagcgaaacagcgcctctttcgacacgagcaccgtcagcgcgacgaccagcgcggaaaaatgtaccgccggaatattttcgagattaacgagacggtcgccggcccgccacagcatgccgacgccgactgcaatcaggattgcgccgagaaacagcgacgcgacggtctcgtagcggctgtgcccgtaattgtggtcggcgtccggcgatgcgccgctatgccgattcgcaaccagcacgacaaaatccgagatcaaatcggaaatcgaatgcaccccgtcggcaatcaatgcttgcgaatgcgcaatcgtgccgacgacgatctgaaatgtcgcaagcacgacattcagcacaatactgacgaacgtgctcttgcgtgcaaccgcgtgcttatctgcgctctgcgcgtcgccggaaaacgtggacatgaaatatgagatatcggtatgcggtacccaattctatcaagggcgccccgcgaatcccgccaatacccgtaaatttcttattcaaatcaatcgcttatgcgaacaggtcgtattcccattcgcaccctcaattattacatttccatgacaacgtcatgcgcgcggcggccgctgaaaacaaaaagccgcgctcctgaacgggcacgcggctcttttgaagcgcaggtgacttaaacagacgtttaaatcgcaaactgttcgcggttcttgcccgcgatccagcgcggcggcttgccgcggcccgaccacgtcgcgcccgtttccggatcgcggtatttcgcggcgacgccagcgcgcggacggccaaccttgcctgccttcgcgcggctgagaccgagttcggcgagcgaaaagccgtagtcggcaattttctgcttcacgtcattcagcacttcagcgtattcacgcgacttcgcttcttcgatttgcttctccagcttctcccgctgggccagcaggtccttgtaagaagacatagtttccctttctatctgactaatggcgccggtctgcagccagctcaccattcatgaaatatatgtgcctcggattttcgaaggcagagattagcacaaaaagatttgatagaagcgagattcatgaaaataccgagatcaattgaaattcactcgtgtcattttgaccggccgcggccttttctcaaatttttacgttcctacacagagattaggacattagccattggctattaggtctatcaacatacgcaattaccctgcattcggaaaaatagaagctttcatcggacgacagttttacgaaaatcggacggcgccgcacgctaaacggacaaaccgcggacaagccggcaccgcggcgtcacgtcacatcccgcgcgcacgcaatcagccgctcgcgcaacgcgcccgcgtcggccgatggcgtatcgaacggcgtgcgcacgcggcggccgtcgtgtcgccagtcggcgccgtgacgatcgacgccgagcaattcgagcccgtcgcggcgcgccgcgccgccgtcgtacgcgtcccataacgcctgttcctcgtcgaaggcgagcggcggcagcgcatcgagatgcgtgccgtcgacccagcccatgcgcccgaaaccgccgatatagcgcagccgctcgacgtcgagcgcccagaacgtgaaatcgccgagcgccagatagcgcgcggcgtccggctcgtagcgcaggtagcgcgcggtgacgtgcggatcgtcgccgagcggcacgaaccggccgagcagcgtcgcgcgctcggcgttcagcacgtcgccgccggacgagtcgacgacgaggaagcccgcgcgcggatcggcggccaggttgcgcgtgtgctccgcgaggccgctcacgaggatcaccggacgatggcttgcatcgggtgcaaacggaacgaccgtcggatacgggaagccctgcggatcgcgcgcatgggtggcgagcgtgccgagcgcgcagcggtgcagcagatgcagggcgagagcgggatcgatgttcaagaggactcctgcggtcgaagggcggcgcgccgggcacgccatgcgcttcgatgttacccgcgggcgcgctacgccgcgcatcggccgaacggccaatgcggcgaataccgggcaccaagaccgcccgatcatcggccaagcggccatcgcccggcaggatcgtaagcggttcgatagaatcggacgggtccgacgggcgccgcgtgcgtccgcgcatttcctttgacgagcctttccgtgtccgaatcctcctctcccgaatcgtcgtccccgttcgccgcgccgcccgacgcgcatcgcgtgctgccgctgccggcccgccagcgcgcgcacggcgtcgatggcgctgttcttcgtcgccggcatgatgtacgcgtcctggggcgtgcacgtgccgaccgtgcgcgacaagttcgcgctgagccccggcctgctgtcgatcgcgctgttcgcggtcgccggcggctcgatcgccgcgatgctgaccatcgcgcgctggatcacccgtgtcggctcgcgcaccgcgtgcctcgccggcgggctcgtgatgtccgcgtgcgcggcgctgatcctcgtcgtgcccgactactggatgctgctcgcggtgctcgcgctgttcggtttctcgatggccacgctcgacgtcgcgatgaacgccgaggccagcgccgtcgagatcgcgctcggcaagccgatcatgtcgtcgctgcacgggatgttcagcatcggcgggatggcgggcgcggccgccggcggcgcgctgctgtcggccggcatggcgccggtcatgcacctcacgctcgcggcagccgtgagcgccgcagtgctcgtggccgccagcccggccgtgttgccgcacgtgccgcaccacgaacacgcgcatggcggcggcaaccgctggcgctcgcccgcgttgtggatgctcggcggcatcgcgctgatcgcactggtcgccgaaggcgcgatgtacgactgggcgacggtctacatgcgcgacgtcgtcgcggcgagccccgcgctcgcgagcgccgcgtatgcggcattctcgggcgggatggccatcgcgcgcttcgcgggcgacgccgtgcgcgcgcgcttcggcgcgccgcagctcgtattcgcgagcgcgtcgctcgcatgcgcggggatgatcggcgcgctgctgctgccgaacccggtcgcggtgctgaccggcttcacgctgatgggcctcggcctcgcgaacatgatgcccgtgctgttcgcggccgccgcgcgcgtgaagggcatccacgcggccgaagggctcgcgcacgtggcggggctcgcgtatttcgggctgttgttcggcccggtcgtgatcggtgcggtcgcgcaggccgcgaacctgacgatcggcctgtcggtcgtcgcgctgtgcgcggcgctcgtcgcgctggtcgcgccgaaggtgctcgcacacctgaagatctgacggtgcggcgctcgccgcgccgaacggccaaaggaaacaaagaaaacgcgcatgcgttgccgcatgcgcgttttcaccccttctgttgaccgcctgttgcgttacatcttcacttcgtcgagcagcgacttcttgccgcccttgtagttgtacagcgagatcacgccgtgctgcaggtcgcccttcgagtcgaaggtcgtcgtgccgatcacgcccgagtagttcgtcgccggcatcgccgcgaggatcttcgccggatccgtcgagttcgcgcgcttcatcgcgtcgacgatgatgtacacggcgtcatacgtgaacggtgcgtagatctggatcggctggccgaaacgcttctcgtacttcgccttgaacgccgcgccgcccgccatcttctcgagcgaggcaccggcttccgagcacaccacgttgtcggtcgcgtcgccggccaggtcggccagcttttccgtgcacacgccgtcgcccgcgaagatcttcgcgcgcaggccgagctgcttcgcctgtttcgcgaacgggccgccggtggcgtccatgccgccgtacatgatcgcgtccgggttctcgcccttgatcttggtcagaatcgcgcggaagtcgaccgccttgtcgttcgtcgcgtcatgcgacatcaccttcaggccgagcgccttggccttcttctcgaactcgttcgcgagaccctggccgtaggcggtcgaatcgtcgaccaccgccacgctcttgatgcccttcgagtgcgcgtagttcgcgagtgccgggccctgctgcgcatcggtggccaccacgcggtacgtggtcttgaagccctgctgcgtgtaggccgggttcgtggccgacggcgagatctgcacgatgcccgcatcgctgtagatcttcgaggccgggatcgacgtgcccgagttcaggtggccgaccaccgcgacgaccttgtcgtcgacgagcttctgcgcaacctgcgtggcctgccgcgggtcggccgcgtcatcctgcgggtcgagttgcagcgtgatcttctggccgccgaccgtaagacccttcgcgttgatttcctcgacggcgagacgcgcgccgttttcgttgtccttgcccaggtgtgcaatgccgcccgtcaacggcgcgacgtggccgatcttgacgacttgatcggctgacgcgttgcttgcagctgcagcgcacagcatcgctgcggcggtgatcggcaacagcttttgcatcttgatattcatgtaagtctccagttcggtcccaaaaacgccatcgcccggtgccccgctgccatccctgtgtttgcaatcactggacgattcgccggatgcatcgttcatgcacttggcctcaagcacgtgaaaaccgccgcttttagcggccgcccgtccgtacttgcgcgcaagtgtaggtgatcaaattaatttgtgggactttttggggtagtggtaacactaccgatatgcgcactttggaacgactactcgaatatcgctgcaagccccgccggataagggtttccgctaattcccgaggcttcgccgaaaggtcgcttcaacgcattcccggggcatttcgattcggtattttgtgcccgggatcattgaatgaaacgcgcgtgacagcgcgcgtttcgtcgtccggcatgaacgattcaggcagccgccgcacgccattctgcatcgagcgcggcgacgagctgcgacgtcgtcagcgcatcgccgcgccgccgcgcgagcggcgcgccctgcccggcccacagcgacaggtagtcgccgtcgttcgcgcgcgcggcggcctggcgcagcggctgcgtcagcgcgttctgcaccggatacggcgcgacgtcggccacgcgttcgccgagccgcgccatcagcgtattgcgcagcccgcgcgcgtggcggccggtgatcgcgcgcgtgacctgcgtcgacgtatcggtgctcgcgagcaggcgcgccttccagtccgccgcgatcgcgctttccgtgcaggtgaggaacgcggttccgagctgcgcgccctgcgcgccgagcgcaagcgcggccgcgatcccgcgaccgtccatgatgccgcccgcggcgagcacgggcaggcccgtcgcgtcgaccagttgcggcacgagcgcgaacgtgccgatcagcgcgtcgtcggcggaaccgatgaacgtgccgcgatggccgcccgcctcggcgccctgcgcggacaacgcgtcggcgccggccgcctgccatgcgagcccctcggccacgtgcgtcgccgtgccgatcacgtaggtgccggcggccttcaggcgtgcgacgtcggccgcgtcgagcacgccgaacgtgaagcttgcaacgggcacgcgcagcgccaccagcgcatcgagttgcgcacggaaatccggcgcgtagcgcgcgggcgcggtgcccggcggcaatccgagcgccgcgttcagcgggtcgatcgcggccagcgcgcgcgcgacggtcgccgcgtcgggcgtcgcgtccggcagcacgaacaggttgatcgcgaacgggcgggcggtcgccgcgcggatggcttcgacttcggccgcgatgcgctcgggcgcgaacgcggcggcgccgagactgccgagcgcgccggcattcgatgcggcggcgaccatcgcggccgtggtcgcgccgaccatcggcgcctgcacgagcggcacgcgcaggccgaagcgttcggaaaagggcgtggaaaacaggcgggcagacatggcgaatccttcgatgacgatgcgcgaaagcgctttgtaaaggctggcacatcgactctatcgaagcggcgccgcgccgaaaaatgaataatcgagatcgaaacgatcgctgcgcgagaagcaggcacgtgtcctgcgccgatacacgatcggcggcacatgaagccgcctccctcgccccgggtgcgtgtcctgcaccgtcacacgatcggtggcacactaggccgcctctctcaccccggggcgcgcatcgcgcaccccgttcgccaggagttcagaacgtgactgcccaatggatcgacatcccgaccggtaacgacagcttcggcggctatctcgcgctgcccaagcgcggcactggccctgccgtcatcatcatccaggagatcttcggcgtgaactcgcacatccgcgcggtcgccgaccagtacgcgtccgacggcttcgtcgcgctcgcgccggacgtgttctggcgcacgcagccgcgcgtcgagctgacctatgaaggcgcggatcgcgacaagggcatcgagctgatgaaaaagaccgacgtgggcctcgcggtcgcggacatcggcgcggccgccgatgcgttgcgcgcgcgccccgaagtggccggcaagatcgccgcgatcggctactgcttcggcggccagctcgcgtaccgcgcggccgcgaccggcaagatcgacgcggccgtggcctactacggcggcggcatccagaacgcgctcgacctcgccggcaaggtcacgcagccgatcctgttccactacgccgaaaacgaccacggcattccgctcacggccgtcgaccaggtgaaggccgcgttcgccggccacggccatgcgtcgttccacgtctatccgggcgccgagcacggcttcaactgcacggatcgcgcgtcgtacaaccagcgcgcatcggcgctcgcgcacggccgcacgctgaccttcctcgccgagcacctctaaaaacgagcggcagcggggccctcgcagcgggcccgcgttatgctgccgacatcgccacgcgtcacaacgggggtgactgcgatgcactcggactatctcgcgcacgacgcgatcggcctcgccgcactggtacgcgaacgcaaggcgagcccgcgcgaactgctcgacgccgcgatcggccaggccgaagcggtcaacagcgcgatcaacgcgatcgtgctgcaggactacgaagccgcacgccagcgtgcggtcgccgcgccggacggcggcgccgacgcgccgttcgccggcgtgccgtatctggtcaaggatctcggcgcggcggtggccgggctgccgctgtcgatgggcagccggcactaccggtatttcgtgcctgacgacgattcgccggtgatcgcgcgcagccgcgcggccgggctcaacgtgttcggcaagaccaatacgtcggaaatcggccagatgccgtacacggaacccgagctgttcggcgcgtgccgcaatccgtggaatctcgaccacacgcccggcggctcgagcggcggcgcggccgcggccgtcgcggccggcatcgtgccgctcgcgcatgcgtccgacggcggcggctcgatccgcattccggcgtcgtgctgcgggctgtttggcctgaagccgacccgcaacccggtcctcgtcgaccggccgtcgaacggcgagctggtcgtccagcatgcggtcacgcgcagcgtgcgcgacagcgcgctgctgctcgacgtgacgaccggccagaccttgccggccggcgcgcccggcacgttcctcggcgagctcgacacgccgcccggcccgctgcggatcggcctcgtgctcgacccgatgctcgcgccggcgctcgccgacgacacccgcgcggcgctcgacgacgcggccgcgctgctcgaatcgctcggccaccacgtcgagccggcgacgctgaacgtcaactacgcacgcacggccgaaaccttcctcacgctgtgggcgacgatcgccgaggagatggtgctcggcgcacgcgcgctgaccggccgcacgccgaagcgcggcgaattcgaagccgcgacgtgggcgatggccgtggtcggccggcgcctcgcgcgcacccgcctgccggacgtgctcgaatggcagcgccagctcaccgtgcaggtcgccggcatcgtgtcgcgctacgacgcgatcctgtgcgcgtcgctcgccgggccgccggtgaagatcggcgaattgcagccgacgccgttcgaatcggcgcagatgaaggtgctcgccgcgctgccggtgaagccgctgctgaaggaaatgctcgcgaggtcgtcggaaaaggcgttcacgtgggccggctgcaccgagctgttcaacctgaccggccagccggcgatgtcggtgccgctctactggaacgcgcgcgggctgccgatcggcgtgcagttcgccgcgcgccacaccgacgacgcgttgctgctcaggctggcacggcagctcgaacaggcgcggccgtggttcgaccgccgcccgccgctgatgcaggcgcagcgctgacgcgcgcggccccgctccgcaaccctcgaaagccccgccggcagaaaccggcggggctttcgcacactttcacgcatgcagtcgcgtgaccgcgcctacacgtcgagccgttcacagatcgtccgcgtcgcggccgccgtgttcagcgtgtagaaatgcagccctggcacgcccgcgtcgaccagacgctggcacaggcccgtgacgacgtccgcgccgaacgcgcggatcgactcgcgatcgtcaccgaagctctcgagccggcgcgccacccagcgcggcacttcggcaccgcacatctcggagaagcgcatcagctgcgagaagttcgtgatcggcatgatgcccggcacgatcggcacgtccacgcccagcttgcgcgcatcgtcgacgaagcggaaatacgcgtcggcgttgaagaagtactgcgtgatcgcggaattcgcgccggctttcaccttgcgcgcgaaattctcgagatcggccttcggcgagcgcgattgcgggtggtactccgggtagccggcgacctcgatgtggaaccagtcgccatgctcggcgcggatgaagctgacgagctcggacgcgtagcgcagctcgccgaccgcgcccatcccggacggcaggtcgccgcgcagcgcgacgatgtggcggatgccgtacgagcggtactggtcgaggatcgcgcgcaggctgtcgcgcgacgagccgatgcacgacaggtgcggcgcggcctcgaggccgtccttctgcatgtcgagcacggtatcgagcgtgccctgctgcgtcgagccgccggcgccgaacgtcacggagacgaatttcggcttcagcggcatcagttgcgcacgcgtggcgcgcagcttctcgacgccttccgccgtcttcggcgggaagaattcaaacgagagttcgatcggtttcatgattcggtgggaacaggctcaggcctcagccgatgtcgcgctgaccgaagatcagtgcggacagcagccacgacacgatgctgtacaggatcgaaccgaagaacgcggaccagaaccccgacacctcgaagcccttcagcagcgacgacgcgaaccagaagcacaacgcgttcacgacgaggatgaacaccccgagcgtgacgatcgtgacgggcagcgtcagcaggatcagcaccgggcggatcaccgtgttgatcaggccgagcacgaccgcgatgatcagcgccgtgccgaagctcttgatgtggatcgacggcacgaggtacgtgatgatcagcagcgcgagcgcgttgatgacccaggtgaggatgacgctcatggagtgctccggttcggttgtcgatcggtacgatcagtggccgccgccggccgccgcgggtgcccgaaggcgcgccgcggcagccggcgatcccgcgccgtgccgccgtaccgggtgcgcgtcggcgacgcgcgcacggcaccgcggcggcggcgcatcggatcagtagcggtagtggttcggcttgaacgggccgtccttctgcacgccgatgtacgaagcctgctcgtcggacagcacggacaggttcgcgccgatgcgcgcgaggtgcaggcgcgcgaccttttcatcgaggtgcttcggcagcacgtacaccttgttctcgtactcgttgccgcgcacgaacagctcgatctgcgcgagcgtctggttcgcgaacgagttcgacatcacgaacgacgggtggccggtcgcgcagccgaggttcacgaggcgcccttccgccagcaggatcacgcgcttgccgtccgggaagatgatgtggtcgacctgcggcttgatgttttcccactggtactggcgggtcgacgcgacgtcgatttccgagtcgaagtggccgatgttgcagacgatcgcgttgtggcgcatcgccttcatgtggtcgtggttgatcacgtggaagttgccggtggccgtcacgaagatgtcggccttgtcggccgcgtattccatcgtcacgacgcggtagccttccatcgccgcctgcagcgcgcagatcggatcgatttcggtgacccacacggtcgcgcccaggccgcgcagcgactgcgcgcagcccttgcccacgtcgccgtagcccgcgacgaccgcgaccttgcccgcgatcatcacgtcggtcgcgcgcttgatgccgtcgaccagcgattcacggcagccgtacaggttgtcgaacttcgacttcgtgaccgagtcgttcacgttgaacgccgggaacggcaggcggccgtccttttccatctggtacaggcggtgcacgccggtcgtggtttcttcggtcacgcccttgatgtgcgcgaggcgcgtcgagtaccaggtcgggtccgcgtcgaggtgcttcgcgatcgacttgtacagcgcgacttcttcctcgttggtcggcttcgcgatcaccgaacggtccttctcggccttcgcgccgaggatcagcagcagcgttgcgtcgccgccgtcgtccaggatcatgttcgcgaattcgccgttcggccattcgaagatgcggtgcgagaactcccagtattcgtcgagcgattcgcccttgaacgcgaacaccggcgtgccggcttcgacgatcgcggcagccgcgtggtcctgcgtcgagaagatgttgcacgacgcccagcggacgtcggcgccgagcgccttcagcgtctcgatcagcacgccggtctggatcgtcatgtgcagcgaacccgcgatgcgcgcgcccttcagcggctgctgcgccttgtattcgtcacggatctgcacgaggcccggcatttcggtctcggcgatgttcagttccttgcggccccagccggccagcgccatgtcggcgacgacgaaatcgttggaagccttggaatcgataatggcgttcatcacgccctcctttctaaaaagtttctagattggtgacgtgagcgccgttcaggaagcggggccggtgcgacggtcgcgatacgcgcgccgcacggctgcttggtgaagctttccgagcctggcggacgcagaggtccgtcgcaacgctcctcggaaaacggagaggattgtagcaaatcggcgcgcggaatgcgcacacggatgcagatgccgaacgcgcggcgtcgacgcgcgcggccgtcaggaacggtaaagggtcaggattccgcgccgacccacgcctgttcgcgcagccgcgcgcgcaggcgcgcgacggcctggctgtgcagctggcatacgcgcgattcgctcacttcgagcaccgcgccgatctcgcgcagattcagaccccgttcgtagtacagcgacatcagcagcttctcgcgctccggcagccgctcgatcgcctcgacgagcgcttcgcgcaggtgctcgtcgagcagtgccgacagcgggtccgcgtggtcgacgcggtagcggtcgaggaacggctcgtcgtcggccgcgcggtcgaaatcctcgtagtagatcagctggctgccgtgcaggtcctgcagcatcccctggtactcgtcgagcggcatgttcaggtgctgcgcgatctcggtctcgctcgccgagcggccgagatgctgctcgacctggtgcaccgcgtgctcgacctcgcgcgacgtcttgcgcaggctgcgcggcagccagtcgttgctgcgcagctcgtcgagcatcgcgccgcggatgcgctgcgtcgcgtaggtctcgaactgcgcgccctggtcctccttgtagcggccggccgcgtccatcaggccgatcatgccggcctggatcaggtcgtcgaggtcgacgctcgccggcatcttcgcgacgagctgcagcccgaggcgacgcacgagcggcgcatattgcgcgagcacgtcggcctgggacatctttccttgagcgttgtacatcatggctctctccttccggtggcactcacgcggcgtgtgccgcgcccgcctcatacgacggcttgccgcccgcgtgcacggcgcggcccgcacccgaacgcgggcgcatcggccagtacagcaggtcggcggcaatctgccggtagtcgcgcgcggcggccgacgacgggaacgcgtcgaccgcggcgcgcgtcagctcacgcgcatgctcgacgagcggatcggcgctcacgcagcccgcgtcggcgatcgacaccgtcaggtagcggctcgcgacgcccgcgaggttgtcgaacgcgaccttcgcatccgcgtggctgccgacgtgattggtcagcacgcggaactgcgcgaacgcatgcgcgaaatgcagccgcttcatgcacgcatatgcctcggtgatcgcctgcgccgcgacccgcgtcacgaccagcacgtcgtgcgcttcgcgggcgagcgccgagaacgaaccgtcggcgccgagctgcgcgtcgacgaggacgatgtcggccggcccgtcgatgaaatcgctgagctgcgcgtcggtgtagccggcgcgcgcgagccgcgcggcggcgcacaggccgaagccggccgcgacccgcgtgcgttcgccgtcacgcagccacgcgcccgcgagcgtcgcgctggccgaatgcacgtcggcgcgctcgtcgacgacgagcacatccttgccgagcgacgcgagcgccgccgcgaggttcacgacggtggacgtgcagccgacacctgccggcccgcccgtcaccgcgacgatgcgcgacgcgcgcccggccagcaggcgccgcagcccttcggcctggtcgatgatttgtttatccaaatcgcacctcgtgcagctcggcggtggaacgtgcggtcagtgcggagagcagcgtcggcatgtcctcgtcttgcggcacgaagggcgagccgtcgcgcggcacacagaacgcgctcttcagcaggaatcgggtcgatgcgacgtacaggttctccggcaccttctggccggtcgacacgtagtggatcggcagcttgtagcggatcaccgtgtcgagcacgccgccgaggtgggtcgcctcgtcgagcttcgtgaggatgcagccggccaggtcgggatgctcgcccgcgctgcggtacgcctgcacgacttcgttgagcgtgtcgccatggctcgtcgcgttgagcagcagcaggcgctgcaccggcgcgttcgcgccgtgcagcatcgcgatctggtcggataccgcgcggtcgcgctggctcatgccgatcgtgtcgatcagcacgatgtgcttgttgcgcagctcggacagcgcgagcgcgagatcgcccgcatccttcaccgcgtgcacgggcacgccgaggatcttgccgaagatgcgtagttgttcgtggccgccgatccggtagctgtcggtggtcagcagcgcgaccttgctcgcgccgaagcgcatcacgcagcgcgcggccagcttcgcggtggtggtggtcttgccgacgcccgtcggccccatcagcgcgaacacgccgccgcgctccatcagcgcgtcctcgctgtcgagcaccggcaggttcgccgcgagcaccgactgcgcccattcggccgcctgctcgaagctctgcgcgccgtcgccggacggcatgttgtcgaccagcatccgcacgagctgcgcggagaaaccggccgagaacaggtgcttcgtcagcgcgccatgcacggcgctgcgacgctggcggtcgtgccacatcaggctgtcgaactgctcttccatcatcccgcgcagctcgccgagctcctgcatcaccgtgtcgttgacgatgcgctcgatgcgcgacttcaccgcatcggccaccgcggcggcggcgtcggcggacaggcgcgtgcgctcggccgccttcgcggcctgcgcggcgcccgggtccggcgcgcgggtcgcggcggccggcatccggcgttcggcgtcgcgcacgatgtcgcgcgcccagccgggcggcgtcgcgctcgcggcggcctgcggagccggcgggctcggctgcggcgcggcgggcgccgcctgcgtgcgcgccatcagcgcatcgcgctgctgcgtcaggcgcttcgcgtgctcgaccagccacggtgcgggttcggaagtcgcggccggcgcaccggcggcgggagcggctgccgacggcatgccggccagcgcgtccgcatcgatcgtcgaagctggcgcggccgtgtcgtccgagtccgcgtccgcatcggcgcttgcgccgaacaccgacgagaacacgtccggcaacccgccttcgcccgccgcatacggattgacggccgggcgggcgagcgccgcgcccgggcgcgacacgatgcccggcaccgcggcggcgggcaccgattccggcacgcgcggcgcggccatgcgtgcgcgcgccgcagccggcggcgtcacggcggccaggtccgaatcggcgagggcgacgatttccacgctgccgtcatcgagcgtgcggttcgacagcacgaccgcgtcggcgccgagcgcctcgcgcacgagacgaagtgcgtcgcggctcgttgcgccggtgaatttgcgaatgttcaagcggaaccccgatgacgttaacgactttgatcgtgcgtgtgtccggcacttcggcgtacgacagcactttcaattgcggcaggctgcggcgcaggaaacgcgcgagcatcgcgcgcagcgcgtgctgcacgagcagcacgggcggcagcccgagattctgttgacgcagcatcgcctgctgcgtgccggtcagaaggttgtgcgcgaggccgggttcgaggcccgggttcgcgccggtggcgagcgcctgcgacagcacgcgttcgagattcgcgtcgaggcccatcacctgcatctcgcccgcgcccggataccactgctgcgtgatcgcgcggccgagcgcgagccgcaccgcggccgtgatctcgaacgcgtcgccgcggcccgcgtgttcggacacggcctcgaggatcgtgcgcatgtcgcggatcggcacgccttcctcgagcaggttctgcagcaccttctgcagcgtcgtcagcgagatcgtcttcggcacgaggtcctcgacgagcgacggcgcgtcctgccggtgcgctcgacgagcgcctgcacttcctggcggccgagcagctcggccgcgtgctggacgaccagatggttcaggtgcgtcgcgacgaccgtgctcgcgtcgaccaccgtgtagccgtacacctgcgcctgttcgcgcatcgcgacgtcgatccacacggccggcagcccgaacgcgggatcctgcgtgacggcgcccggcagcgcggccgtcacctggccggggttgatcgcgagccactggcccgggaacacttcgccgatgccgatctcgacgcccttcagcgcgatccggtacgcgttcggccgcagttcgaggttgtcgcggatatggatcacgggcggcaggaagccgatttcctgcgcgaatttcttgcggatgctcttgatgcgcttgagcagttcgccgtcgctgttcttgtcgacgagcgggatcagccggtagccgacttcgaggccgagcgggtcgatcagctgcacgtcgtcccaggtcgcctcgtggctgtcggacggcagcacggcgggcggcgcgatgtcggtcaggtcgccggccgccttgcgggccgccgcgcgcttcgtctgcgtgcgggccagccagatcgcgccgccgccgagcgcgaggaacgcgaagtgcggcatgcccgggatcagccccatcagcacgatgatcgcgccggtgatgttcagcacgcgcgggttcgtgaacagctggccggtgatctgcgtgccgatgtcctcgtcggtcgcgacgcgcgacacgatcacgccggccgcggtcgagatcacgagcgacgggatctgcgcgacgaggccgtcgccgatcgtcagcagcgtgtagttcgtgccggccgcggcgaacgtcatgtcgtgctggaccatcccgacgatcagcccgccgatcacgttgatcgccatgatgatcaggccggcgatcgcgtcgccgcgcacgaacttcgacgcgccgtccatcgacccgtagaactcggcttcctgcgagacggccaggcggcgcttgcgcgcttgctcttcgttgatgaggcccgcgttcaggtcggcgtcgatcgccatctgcttgccgggcatcgcgtcgagcgtgaagcgcgcggacacttcggcgatccgccccgcgcccttcgtgatcaccatgaagttgatgatcatcaggatcacgaacacgacaatgccgaccgcgaagttgccgccgacgaggaagtggccgaacgcctcgatcacctggccggccgcgtccggcccggtgtggccctcgagcagcacgacacgcgtcgacgcgacgttcagcgacaggcgcaggagcgtcgagaacagcagcacgctcgggaacgccgcgaaatcgagcggcttcatcgtgtacatgctgacgagcagcaccatcacggacagcgcgatgttgaacgtgaacagcagatccagcagcatcggcggcagcggcaggatcatcatccccaaaatcatgcagatgaggatcgggcccgcgagcgcgcgcaggttggtgcccgcgaacggattctggcgcttcgcgaacaggccggtcggggtgctcatgccgcgcctccgttaccgagcgtgtcttcggcttcctcgcgttcgtcgtcggcggagaccgacgcgcccttgtcgagatcggccggcacgtccaggtcgaccggcaccgccgggaacgcgccgccttccgaacggaagcgcttgagctggtagacccacgcgagcacttcggcgacggccgagtacagcgagccgggaatctcgcgttcgagttcgacgttgtgatacagcgcacgcgcgagcggcggcgcttcgagcagcggcacgttgtgttcggccgcgagttcgcggatgcgcgcggcgacgaggttcacgcccttcgcgacgaccttcggcgcgcgcatctcgccgtccgtgtattgcagcgcgacggcgaagtgcgtcgggttcgtcacgaccacgtcggccttcggcacggccgccatcatccggcgccgcgcaatcgcgcgctgctgctggcggatccgccccttcacgtgcggatcgccttcgttctcgcgatgctcgcgcttcacttcttccttcgtcatgcgcaacttcttgttgtactgccagatttggtaaggcacgtcgagcgcggcgaccaccagcatcccggcgaccgtcgtgccgcagcacaccgcgaccaggtgcagcgcatcgggcagcgccacgccgagcggctgcgtcgcgagaccgagcagctcgtccttgctgcgccagatcgcgatgccgccgatcccgccgacgacgagcgtcttcgcgatcgacatcccgagctggatcggcccctggatcgagaagatccggccgaggccggagatcgggttcaggcggtcgaacttcagttcgaacgttttctgcgagatcagccagccgccgagcgccatcggcgcgagcagcgcggcgacaccggtgagcgcgagcagcggcagcagcgcggcgaagccttcgaggctcgcgctgccggccgccgacagcatccggttcgtgtcgaacgcggtggcgcgatcgaacatgaacgcgccgcgcagcatcgcctgcagatgcccgcccgacgggcccgcgagcagccaggcaccgtagaacccggccgcgagcagcgcgaacgaagccagttcgcgcgaacgcgcgacctgcccctcctcgcgcgccttctcgcggcgcctgggagtggcggcttcggtcttgtcgagatcgctctcgtctgccacggggcctccagtcgggtacggcggaatgccgctttccagtgacaccgattattcatggaggcgtcaaacaccgatcggtcgagcaaagccgggaaagggggtatttcgggaatcgggcgagccggtgcaaacgcggccggacggggccggaaggggacggaacggggtgcggcgaggcggcgaagcggggcggccggtgcgatggcgggggtgggcgcggggcttggggcttggggccgagcgacgacggcgcgaagctgggaaatggtgaagcggttggtgaaacggtgaagcgggtacggcgcgaaaccaggccccgacgcgacagcgtcgcgcgccggggcaggcgtcggtcaggccgccgcgatcgggtccgcgccgaagcggttcgggccttcggtgccgcgcgagcacatccacacgagcagcaggatgccgccgacgatcgggatcagcgccagcagcaggaaccagcccgagcggcccgtatcgtgcagccggcgcacgctgaccgcgatgctcggaatgatcagcgcgagcgaaatcaggccgagcacgacgagcagcagcagcgtgatcaggcccgcgtcgtggctccccgcgccgacgacctgcgcgacgatcgacagcacgcaggtgagcagcgcgaaataccagtattcggcacggcgcgcggccttcgaatgtcgcgtatttattgagtacggaacgaacggcttctgaaaaattcatcttattaccctcctgttttatattgacgaccccggaaacaacgccggcattatatgtttgaatttcggcaggctccaatctattttcacatggcgggtaatgcgcacgcccggctgcagcgcccgccggcacggcgcgggaacggctgccgcagcggaatgcggcgccgcaggcttgcatgccgcgtcattttaataatcttgaacacctgacataaacgacagccccggataatccagaacctgattacatccgaatgaaaccggggcgatcgataatcgccgcgagtaccgcattcgattaaccgccggtattacgccggcgcgcaaagcgcgctacgcttcgtcatttccgattcctgtcgaaccgcaccatgctccgtcatccgttcgttccgtcgctgtcgctcgcctgcgcgctggcagccggctgcgcgggcacgccggccctgccgcccggcgcgcaggcgcctgacgcaccgcaccccggcacgatcgccctgcaccatgcgtggaacgggtcgacgcaaaccctgcgcgcgcaggatgtccccgcgagcgtcgctttccgctgcgccaacgcgcgcggcgaaccgtcggaacgcgcccgcgcggcctggtgcgtgccggtcgtcgagatcgaatcggtgtcggtcgatgccgccgggcgcccggtcgcgccggccgatgccgtccggatcgaaagcaccgcgtacgggcccggccaccgcttcctcgaccatacgcagctgatgcgtaccggccggccgccggtctagcgcccgtatgcggcgatcacgggcttcccggcccgtgccggccatggggcgccggcgaggccccgttcacgccgataacgggccggcgcacgcgcctagcccgccgccgcccgctgcagcgcggcgagatcgagcttcttcatcgtcatcacctgcgccatcacgcgctcggcgcgcgcgggatcgcccgccatcagttccggcagctgcaccggcacgacctgccacgacacgccgaaccggtcgcgcagccagccgcactgttgcgcgcgctcgtcgccgccttcggacaggcgcgcccaatagcggtcgatttcgtcctggtcccggcagttgacgacgaacgacacggccggcgtgatctggaacacggggccgccgttcagcgcgatgaacgcctgcccgtcgagctcgaacgcgacggtcatcaccgcgccctccgcgctgccggatgcgtgcgcgccggccttgccgtagcgcgcgacgtgcacgatgcgcgcgttgtcgaacaccgacacgtagaaaccggcggccgcctcggcgtcgcggtcgaaccaaaggaacggggtgatgcgttgtatgcgcgggctcatggcgctgcctcctcgatgtcgtgccggcacggccgccggtattacatcgtaggcgctgtgcccgcacgcggcggcgctccggcccggccggtcgtgccgtgccgtgcgcggccgccggataaaaaggggcgatctctcgcccccgttcccttcggcgtgcggccctgccgcgtcagaacgcgacgaaaggcgccgcgccgccggtcgaggtcttgtccatcccgaagtagatcgtcctgccgtagaagtgcggcatgccgatgtcgagccagctggacgaaccgaacgggcccgcgatgtcgttgaacgcgtacgtcgacgggttcgagaacagcgaatccgcgttcgcgatggacatcgacacggtcgcggccacgccgttctggccgctcagcgtcgccgagtagctggccggcggcgatgacgggcagtagaactgcgtgttcttcgagcaaaccgtctgccccgaatcgttgaagaaatacgcgttcgagcccgtatcgaagaacgcggtcacgttgcgcccgaggaacgtcgcgctgacgtcgcccgtcgtggtcgacgtcatcacggtcttcccggtcaggtcgggcaggccgaacgtcagcgtcccggtggagctggcctgcccgctgttcgagatgcccggcatcgtcacgctcaccccgctgctgtcggcgaaatgatgaaccgggttggccacctgctgcgccaccggcacgagcgcgaccgcgcagttcgcgttgtcgccgttcgggcacgcgtagtagttgttgctcgacgacgtcgacgtcgcgcaggtcgtgccgcagtcgaccggcgccggcccgatgccgagaatcccgttcgcgccgagcgcgctcgccgagttggccgacgcaccgccgttcgtgcacgaggccggcacgttcgtcgtgccgaggtcgccgatgatctgcacgggcagcgagcgcgcctgctcggcgccgatcgacaggtcgaccgtgcgcaccgaaccccacgtatagctcgacacgaacttgccgcactcggcgaccggcgcgccgccgctcgtcacctgcgggaggctgccgagcacgcccgacaccgcgctgccgacgagccgcagcccgtaggacgcggtatcgacgagcacgttgctgaccacctggcagttcgacgtgccgggcgcgcagaccttcacgctgatggtcgggatgttgatcacgttcgccacgccggcgttgacgttgacgacggccgtgttcccggagtttccgtccgagccgcccgaaccgttgttgccgttgttgcccgagttgctgctgccgccgccgtcgccgccgccaccgcatgcggtcacgaggatggccgttgccgccgcgaggcccagcacgccgagccagcgcttgaatgtacgaggaatgctcaagatcgctctcccgctgtcactggatgtcggtgccggccaggccggcaggcagcgccgccggcagccaggcctggcccgagaaggcgcccatgtggccgcccgtccggatcacgaggccgctcgtgtcgacggacacgggtgcgcgccagccgcgcgccttgtgcgccgcctgaacgccggcggtgtactgcgggaaatagctgccgagcagcgacgcgagatccggcatcgtcggcccttgccatgcgaggccgaacacgctgccggcggccgacgtgtactcgtgaatgacggtgcccgaccctagcgtgatttcgcggacggtataggcggcggtactcgcctgcacgccgtccgccgaacgcatcgcgcgctgcagcgcgcgcacgcttgcggcctgatcgtccgccggcggcgacatcggtgcgccgcccagttcggcgtgcgcgtggacggcccacagcacaccgttgcagccgtcgcgtgcgcgacggcgcggcccaagcgtttcagcttcacattccctcccacgggactggcttcgtggcggcgtgcgcggcgatcgtgcccgcgccgcctgccgacgtatgagtcgtatgaatgacgcttcgttgctgctgacgcgtagtatgcctgctgagtgtgtcgaagtgtcaattcgacgcaggccgaccggcgcgtgcgcaggcggcgagcccggtaaacgtggtggacgttgtggaaacggcgcgacgcatgcatcgcgcggccccgcgaaacggaggcgcgccgatgcacgcggcagggtcagaagcccaggctggcaagcaggtcgtcgacctgcccctggtcctggaccacgtcggatttgccttccggcgcgatctgcgggccgttcagcagcgactcggggctgccggtcgagctcatctgctcggcggcgagcgcggccgcggtggccgcgaactgctcgcgccgctccggcgcgatgttctcgacgagcaccgtgaggagctgctgctcgatcaggtagaccatgtccatgatcttcttgatcacctggccggtcaggtcctggaaatcctgcgcaagcatgatctcgagcagttgcgcgctggtcgccgacgtcgattcgggcagcgtgcgcaggaacgtgcgcgtatcgtccatcagctcgcgcacttccgcgtgctcgatcggcgccgcataccactgcgcccagcgcgcgtcgagcgcttcggcttcgttctggaggcgcgcctgcatcggcttggccacctcgatcgcattcagcacgcgctcggcggcctgctcggtcatcgtcgcgacgtagcgcagccggtcgcgcgcatcgggcaccgcttcggccgcccgctcgacatgcttgtcgagcccgagctcgcgcatcgaatcgcgcagcgtgcgcgtgacatggccgatgcgcgcgaggatgcggtcgctcgcgtaatcggcaccttcggcctggccgtctgcgctgaacccggcgcccgtcagcgcggcatggatcggctcgttcacgtcagctcccggccttcgccatcttgtcgatgatcttgttcagcttctcgtcgagcgtcgcggccgtaaacggtttcacgacgtagccgctcgcgccggcctgcgccgccgcgatgatgttctccttcttcgactcggccgtgaccatcagcaccggcaggtgcgtgagcgtcgcgtccgcgcggatttccttcagcatcgcgaggccgtcgaggttcggcatgttccagtccgagatcacgaagtcgtagccgccgccgcgcagccgcgcgaggccggcgaggccgtcctcggcctcgtcgacgttcgagtagcccagctccttgagcaggttgcggacgatccggcgcatcgtcgggaaatcgtccaccaccaggattttcatgctcttgtccatcgtcgttcctttccagattcgtttccgtcgggacgcgtatcgtggcacgcgccccgtgacattccattcaaacgcgctgcacgcgatcgcccatcgtcgccaggcgcgccatcacgcggcggctcatgtcggcgagcggcgcgatctcgtccgcgccgccgagcgcgatcgcctcgcgcggcatcccgaacacgatgcagcttgcttcgtcctgcgcgaacgtgtgggcgcccgcgcgtttcatttccagcaggccggccgcgccgtcgcggcccatcccggtcaggatcaccccgatcgcgttcttgcccgcgtgcgtcgccgccgagcggaacagcacgtcgaccgacggacggtgccggttgaccggcggctcgtccgacagttgcgcaatatagttcgccccgctcctcgcaagcaacaggtgcgcgtggcccggcgcgatatacgcgtggcccggcagcacgcgctcgccgtgctcggcttccttcaccgcgatccggcacaggccgttcagccgctgtgcgaacgatttcgtgaagcccggcggcatgtgctgcgcgatcagcacggccggcgcgtccggcggcagcggcgtcagcacttcgcggatcgcctcggtgccgcccgtcgatgcgccgatgatgatcagcttctcggtactgacgagcgggttgttgatcatcggcgcggccgcgtggctgtccgccgcgcgcgcgacggcctgcggctgcggcgcctggcgcacgcgcgcacgcgacgccgcgcggatcttgtcggcgagcttttccgcgtagtcgagcatcccgtcgcgaatcccgacgcgcggcttcgtgacgaaatccaccgcaccgagctcgagcgcgcgcagcgtgatttccgagccgcgctcggtcagcgacgacaccatcacgaccggcatcggccgcaggcgcatcagcttctcgaggaagtcgagcccgtccatgcgcggcatttcgacgtcgagcgtgagcacgtcggggttgtgctgcttgatgagctcgcgcgcgacgagcggatcgggcgcggtcgcgaccaccgtcatgtcgggctggctgttgatgatctcggtcatcaggctgcggatcagcgccgaatcgtcgacgcacaatactttgatcttctgcactgcggtcatgcctcctgctttcttgataggttcgccgcatacgggctgccggctggcgggttcgctgcccgtgagccgctggagccgctggagccgctggagccgccggcaccgcccggcgccgcgccgcgcgcgccgaacagctcgatacgcgggcgcgccggctgcggcgcggccggccgtttcgccgcaaacagctcgacgtgggggcgcggccgcgcggcgcgcaggcggtcggcctcgcgcgcgagcgcggcttcgcgctcggtcacgcccggcacctgcagccgcagcttcttcaccatcgcgcggcccgtgcgcggcatgaatgcgaccttgcgcggatggacgtcctgcaagtcctccgcggtgatacggatgcgttcgagcgccaggtagcggcgcacgaaatcggcgttgcgatcgccgatgttgatcgtcgtcatgccggccagcacggccgcgccgccgaacaccttcgcctcgaagcgctcgcggcgcccgccggccttgatcagctcgttgatcagcacttccatcgcgtacgcgccgtagcgcatcgagtcggacgcggccgcgcccgcatcggcgccgtcgtcgggcagcatgaagtggttcatcccgccgatgcccgcgtacggatcgtgaatgcacgcggcgacgcacgagccgagcacggtcatcagcaccatgtcctcggaggtcgtgtagaactcgttcggcagcaacttcacgccgggcaggccgaagtggctgtcgaagtagcgattggtcgcgatcggcagtgcgctcatccgcgctctccaaaggcgggcgcggtgcccgcggcccgcgcacgcaccggcgacgccgtcgcggccgccgcgggcgcctgcgcgccacgcggccgcgcgccctgtgcggcgtcgcgagtcagttcgtacaccgtctgcccgcgcagccggaacgcctgcgtgacgtacgtgaagttttccgaatggccggcgaacagcagcccgcccggcttcacgagcggctcgaagcgcgacagcacctgcccctgcgtcggcttgtcgaaatagatcatcacgttgcggcagaagatcgcgtcgaacggcttcgcgatcccgtagtccgcatcggtcaggttcagctgctcgaagcggatcatcgcgcgcagctcggggcgcaccttcacgcggccggcctgcgcgcccgtgcccttcaggaagaagcgcttcagccgctccggcgccaggtgcttgacctggtcatacgtgtagatgccggcttccgccttcgcgagcacctgcgtgtcgaggtcggtcgcgaggatcgacgcgccgcgcgcggccgattcgccgagcgcctcgatcagcgtgatcgcgatcgagtaaggctcctcgccggtcgacgccgccgaacaccagaccgatacgggcgccggtcgccccttcacgaaatccgacaggatcgggaaatggtgcgactcgcggaagaacgcggtcaggttcgtcgtcagcgcattggtgaacgcttcccactcgagcggatcgtcttcctgctcgagcaggtcgaggtagtcgcggaacgtgtcgaggccgcgtgcccgcaagcggcgcgcgagacggctgtacgccatgtcgcgcttgtgctcggacagcgagatccccgcgcgttgatggatcagcgcgcggatgcgtgcgaaatccgcgcccgtgaacgcgaagtcgcgccccggctcgcccgcgcgaggcgaggcatccggtgcatcgggtcgaaacggcgcgcgcgtgcgacatgatttagaaggtctcccaatcgtcatcggacgtgccggacgtgccggacgtggccggcgctggcttctcgccgttcagcgccgggcgcacgagcgcgggcttcgcggccggcttgtcggccggcgcggcggatttcgcgagacgcggcccgtagccgcccgcggcggcgccgcgggaagccggcgcgtccttctgcgcatgcgcagcggcatcggccgcgcgcttcggttcgtgaccggcgcccgacgcggccgcggcacgcggcgccggcgcggcacgccgtgccggttgggcggcggcctgcggggccggcagcgcggcgaccggcgccgcgtcgaaacgcggctccgacgtcagcgccggcgcatgcgccggttcatgcgcgaccggccgcgcgacaccgcgcgacggcgcgagcacgatgccgcccgcgacgcgccagcctgcgacgaccgtcttcatctggcgcgtctgctcctcgagcgacgcggccgcggcggccgcctgctcgacgagcgccgcgttctgctgcgtgaccgaatccatctggccgaccgcgcggttgacctgctcgataccggtcgactgctcgtccgacgcggcgctgatctcgcccatgatgtcggtcacgcggcgcacggcctgcacgatctcgtccatcgtcgaaccggcgcgcgacacgagcgccgacccgctttcgaccttctcggccgaatcgccgatcagctgcttgatttccttcgcggcgctcgcgctgcgctgcgcgagcgagcgcacctcgcccgcgaccaccgcgaagccgcggccctgttcgcccgcgcgcgcttcgaccgccgcgttcagcgcgaggatgttggtctggaacgcgatgccttcgatcgtgccgatgatgtcgacgaccttgcccgagctcgccgcgatgtcctgcatcgtcgacacgacctggccgaccacgtcgccgccctgcgtcgcgatgtcggacgcgttcaccgcgagctggctggcctgccgcgcgttctccgcgttctggcgcacggtgcccgtcagttgctccatgctcgacgcggtttcctgcagcgacgcggcctgctcctcggtacgctgcgacaggtcggtgttgccggtcgagatctcgcgcgcgccgacgtcgatcgactcggtgccgcgatgcacggcctgcaccatcgtcgtgacggcgtcctgcatccgcttgatgccgccgaacaggcggccgatctcgttggtgctgaacacgttcaccggctcggtgagatcgccgccggcgatgcgctcgaagtgcgcgatcgcgtcctcgagcggctgcacgatcagcccgcgcagcgcgaagcggatcgcgatcacgacgacgaaggcgatcgcgatgcccgccgcgatcagcccgatcatcagcgagatctgcgattgcgtcgcggcctggcgatcttccgcgcgcttctgcagcgaagcgaccacggccgctgccgcctggtcgtacgcgacgaacatcgggctgatcttggtatcggcgatcgcgtggtacgcggccatgtcgcccgcgcgcgcggccgcgaattcgggctcgacgccttccttcacgatcgtcgcatagcgtgcggcgagttcgtcgacgagcgcctgctcgacgccgagcttcggcgtggcctggaacgcctgccagttctggttcgacttcgcgtacagctcctgcgcgcggtcgagcaccttggccgcgtcggccgtgttgccggcttcggtcagggtgcggaagcggtcgagcgccacgcgcgcgcgcagcaactgcgccgacgtgtcgtcgagcgcatggatcgccggcaagtcgacgtgcgcgatctcgtcgagcgagcggctcgcttgattcagcgcgtacaggccgagcccgccgacggctgcggccagcgccacgaggatgagtccgaccgccgtgagcgtcgtgcggatcgaccagttatgcaacattgcagattctcccgaaattcctgcgcgcgcggcgcttacccgccgagcgtctcgatcagcgccatttcacggctcgacatcagcttctcgatgtccatcaggatcagcatccggccgtcgaccgtgccgaggcccgtcaggtactcggtcgtcagcgtcgcgccgaattccggcgccggcatgatctggtcggtctgcagcgtcagcacgtccgacacgccgtcgaccaccatcccgaccacgcgatgcgcgacgttcaggatgatcacgaccgtctggtggtcgtactcgacgcggccgagatggaacttgatccgcatgtcgacgatcggcacgatgatcccgcgcaggttgatcacgcccttgatgaaatccggcgcgttcgcgatgcgcgtgacgctgtcgtagccgcggatttcctgcaccttcaggatgtcgatcccgtattcctcgtcgccgagcgtgaacaccaggaattcctggcccgtcgcgtcgccttgttccgcgtcgcggcggctcgttgccgcgttcgccgcggccggattgatcatttggacttcagcagacacgtttgcccccaatcggttgaatggcgagagacatcagaacatcgcgagctcggcgccggcacgggcgccgtgcgtcgcacgggtttcgcggttcagcgccgcgacgtcgacgatcagcgcgacgctgccgtcgccgaggatggtcgccgccgagatgccgtgcaccttgcggtagttggtttcgaggttcttcacgaccacctgctgctggccgaccagttcgtcgatcagcatcgcgaagcggcgccctcggtttccatgatcgtgacgatcccctgcgtcgggtcggtgcgcgcgtcatcgaccgagaacacctcgtgcagcgcgacgagcggcaggtattcgccgcgcacgcgcaccacgcgctcgccgttgccgaccgtgtagatgtcgtcgttcgacggctgcagcgactccatcacgaagttcagcggcaggatgaagatctcgttgccgaccttcaccgacatcccgtcgaggatcgcgagcgtgagcggcagcacgatccgcgtggtcgtaccgcggccggcctgcgacgtgatctcgacgtggccgcccatcgactggatgttgcgcttcacgacgtccatcccgacgccgcggcccgacacgtcggtcaccgtctcggcggtcgagaagcccggcgcgaagatcagttgccagacttcgtcgtcgctgatgttgtcggacacctgcatgccctgcttcgcggccttcgcgagaatgcgttcgcggttcaggcccgcgccgtcgtcgctcacctcgatcacgatgttgccgccgtgatgcgcggccgacagcacgagctggccgaccgcgtccttgccggcggcgacgcgcttgtcgaccgtctcgatcccgtggtcgaggctgttgcgcacgaggtgggtgagcggatcgatgatccgttcgatcaggctcttgtcgagctcggtcgcctggccgaacgtgacgagctcgacctgcttgccgagcttgccggcgaggtcgcgcacgagccgcgggaagcggctgaacacgtagtccatcggcatcatccggatcgacatcaccgcttcctgcaggtcgcgcgcgttgcgctcgagctgcgccatcccgttgaacaggcggtcgtgcagcgccggatcgaacgcgctcgcggtttccgcgagcatcgcctgcgtgatcacgagttcgccgacgaggttgatcagctggtcgaccttctcgacgccgacgcggatcgagctgccttcggcgcccgatgcggccgcggcggccgggcgcgcgcgcttgtcgtcgtgatgcgcggcagcctgcggcgcgtggtctgcgtgcgcttgctgggccggctgcggcgcgggcgcggcggcggccggcgcggcgggcgcgggcggcggcgccgatgccggtgcggccggttgcgcggcggcctgcggcgcgaagacctcggcgcgcaccggctgcgcggcggcggccggttctgcagcgggagccggtgccgcaacgggtgccgcggcttcatgagcggcggccggcgcggccggcgccgtgccgtgcgcgacgcggatctggctttcgtcgatcacgaagcagcacacggcgacgatgtcgtcggacggcacgtccgattcgacccacagcgtcaggtcggcgcccgcttgctcgcggcccacgatccggccgaggttgccgagttcttcggtcagcagctcctggtccttcgcgtcgacgcccacgagcgtgatcttcaggtgcgggccgccttcgtccgcgccggcatcggctgccggatgcgcagccgcgacggcctgctcgaccacgtggtcgggcgcacgagcgtcgccggcggccgtctctgcggccggcgcgaccggcgcgaccggcgcgaccggttcggcgacagcggcgaccggcgcggcagcggctgccggcgcatccgccccgctctcggccttcagccgctcgagcttcgcgcagatcgtcgcggcggcggctgcgtccggttcggcgctcgcgcggtagtcgacgagctggtcggacagcacgtccttggtctcgaggaacgcgtcgaccatttccttggtcagcgtcagctcatggttgcgtgcgcggtcgagcagcgattcgaggatgtgcgtcgtatcggtcagcgcggaaaagccgaacgtcgcggcgccgcccttgatcgaatgcgcggcacggaagatcgcggccagatcctcggggtcgggcgaaccgacgtcgagattcagcagcaactgctccatctgcgcgagcagctcgtccgcttcgtcgaaaaatgtctggtagaactgagtgatgtcgagagtcatgcccggtcccgggttgaatgcgtcgcgtgaatgtcaggaggcggccggttcggacagcgtcgcgaccaggtcgaccagcacggcggggtcgatcggcttctcgatccagccggtcgcgcccgcgtcgcgcgcggcgtccttgaatgcgtcgctgccttcggtcgtcagcacgaggatcggcgtttccgtataggcggtcagcttgcgcagcgcggcgatcacttcgagcccgctcttgcgcggcatgttctggtcggtcagcaccaggtcgtacggcacggtggccgccaggtcgaagccggcctcgccgtccggcgccaccgtcacgtcgtagccggcctgcgccagcgtcgcctggagcagcgcacgcatggtcgcggagtcgtcgatggcgagaatggttcggatcatgtctgtctcggaatcttttaagcgtcagggtttcggcacggcgacggcggacgccgcgagcgccggccgcgcggccggcgccgggccggccagctgctgcgcgagctgctgcgagccggccgcatcggccgacagcgtcgtggtcgtcgcatcgtcgcgcatcagcgcctcttcggatttgcggttcagcacgatcacgctgatccggcgattctccggatcgagcgggtcggccttgttcaggttctgcgtcgacgcgaggccgagcacccgcagcaccttcgcctcgtccatgccgccggagatcagctcgcggcgcgacgcgttcgcgcgatcggccgacagttcccagttgctgtagccgccctcgccgcccgcgtaaggcacggcgtcggtatggccctggacgatgatccggttcggcacgtcgttcagcgtcttgccgatctcgcgcaggatgtcgcgcatgtacggctcgacgttgtcgctcgacatcgcgaacatcggccgcttctgcgaatcgacgatctcgatgcgcagccccatcagcgtcgaatcgatgcggatctgctgcttgaactggcgcagcgtcgggttggcctcgatcgcggccatcagcttgatctgcaggtcgtgcaggcgcgcctgctcgagccggtcctgcgcaccctgcgcctgcgaccgggaattctcgtcgcccgctttcgcgaggcgctcggcgagctgcgtcatgccgtcggtgcggcgcagcgtgccggcgtcgacgctcgacaggtcgcggccgccgccgttgatgatgctggaatcctgcgagctgcggtcgccgctgccgaacagcgcggccttcagcggcgtgttgaagtattcggcgatccccttcagctgcaccggcgtgaccgagctcagcagccacatcagcaggaagaacgccatcatcgcggtcatgaagtccgcgtacgcgagcttccatgcgccgccgtggtggcccttctttgccggggccacccgcttgacgacgattgcgcgatccttgctcttgctcatcgggggctccgcgtcacttcgccttcacgcggcgcacgtgctcttcgagctcggaaaacgacgggcgctcggtcgagaacagcaccttgcggccgaactcgaccgcgatcgccggcgcatagccgttcagcgtcgcgaggatcgtcaccttgatgcactggaacatcttggtcgactcggcgacgcgctgctccgcgaggctcgcgagcggcccgatcagcccgtacgacagcaggatcccgaggaacgtgccgaccagcgcctgcgcgatcatcgcgccgagcaccgcgggcggcttgtcggcggacgccatcgtgtgcacgacgcccatcacggccgcgacgatgccgaacgccggcatcgcgtcgccgactcgcatcaacgcatgcgcggggccttcgccttccgcgtggtgcgtctcgatctcctcgtccatcaggctctcgatctcgaacgcgttcatgttgccgcccaccatcaggcgcaggtagtcggtcaggaattcgacgatgtggtgatcggcgaggatcttcgggtattgcgtgaagatcgggctcttttccggatcgtcgatgtcggcctcgagcgtgagcgtgccttccttgcgtgccttcgcgagcagcacgtaaagaagcgccatcagctccatgtagacatccttcgtgtatttcgagcccttgaagagcgtcggcagcacgcgcagcgtcgccttgatggtcttgccgccgttgccgaggatgaatgcgccgacgccggcacccacgatcatcaggatctcgacgggctggatcaacgcgcccagatgcccgcctgccagcgcataaccgccgaagacggacaacagcgtcacgagtgttcccacgataatcagcactgcctgtccctcacgaatgaccggcggggagaccgccgttaaacaggtttacggcagtcggcaggaaaactttcgcggccgcccggcggcggcccgacggtgtttaccagcacagacgattcgcgggcgatttgcgggcgatttgcgccgcccggcgcggccgttcgcgcccgctcggccttgcccgcccggcgctcaggccgcggcggcggccagttcggcgcgcgcggcggcggccttgcgggtcttgcccgcgcgcgacggcggctggcaaaggccgcagacgaaaccttgatgtggatcatgcgcatgcgcgacgaagtggccgccgcagcgcgtgcagggcgtcatctgcagcatccccgaatcgaagaaacgcacgagcgtccacgcgcgggtgaggctcagcgcggcctcgtcgccggacaggttcacgtgctcctggtagagccggtacgccttcacgatcgactggatcggctcgcagcggccgtggtcctgcatgaaccggtagatgttgtagaacagcgacgagtggatgttcggctgccacgtcatgaaccagtcggtcgagaacggcagcatccccttcggcggcgacacgcccttcagttccttgtacagcttgatcagacgatcccgcgacaggctcgtctccgcttccagcaactgcagccgggcgcccagttcgatcagttcgatggcgagggtgatttccttcacctcgatcacgacgcttttgcttgccatggtgataaccgtccgcttgacgtgattcggatgggtagccaatacgctgtccgccggcgcgacacgccgggactcaacgcaaggcggggtgatggatcagcggacgccttcgacctgctgcccggccatcaggatggccgagtgggcgtgcgcgacgacatcgctgcggcccttgtcggcgagcgacgacagcagcgcgtgatcatcgaagcggaagcggcacagcatctggttggacgcggcgagtttcacggtctgtgcgagcgtgaggttcccgagcacgtcggccagttcctgggaaattcccatgcggaacatgcccatcgccttgtcttcccgcagcaggcgttgcgcgaggaggaggtacgacaggttgacctctttgatctcactgagcatttcgctggtagcgctcatgattccccgttaaagagctttctttggccattcgtgttatgaaaacgtttgctcgatcagggcgctctgggcgcgcagtcggctcgtttatagtcttacagggcgaattttggccaaacggcatttatgccggtatcagcgaagtggcgtatgccatgcaggatttgtctgtaaaccgtgtaggaatttttccgacaaggcgaattgaaagcttcagtcgggaaagcaagtgccggcgcgggttcggctgtgatggatccaatggcctcggtgcaataacgaaaggctttccgggcaaggctgccggcaatcgaatcggtaaaaattatagtgctttttcacgatgacgcaacaatagttgcatctgtctccattcctgattccgcgccctttttctcggggttttgcgtatttcatcgtgtaacaagccttaagtgtttgaaaaacactcgaacccctcagggcgatatcgataatggactccaatgggcggcggcgcgagccgtgccggcccgccccgcagcttgccgtccggcgccccgcgcacccgcccagggcacggccacgtaccgccaaccgcgtgcgtcggcgagttccgcaaccttgcacgggatccgcatcggcaccctcgtgcccccggatcaaacaggagaacacccatgcgaattgcccagatcgcgccgctttacgaagccgttccgccgaaactctacggcggcaccgagcgtgtcgtgtcctacctcaccgaggcgctcgtcgaactcggccacgacgtgacgctgttcgccagcggcgactccgtcacgtcggcgcgcctcgaggcggcctggccgcgcgcgctgcggctcgatccgtcgatccgcgattcgatggcgccccatatgcgcctcctcgagcaggtcgcccgggtcgcgcacgaattcgacgtgctgcacttccacctcgactacctgccgttcccgctgatgtcgcgcctcgacacgccgtacgtgacgacgctgcacggtcgcctcgacctgccggaattgcagccggtgttcgacgcgttccccgacgcgccggtcgtgtcgatctcgaacaaccagcgcaagccgctgccgcaggccgcgtgggccggcaccgtgtatcacgggctgcccgacacgctgctcacgccgcagccgggcgtgaagcccgaatacctcgcgttcctcggccggatctgccccgaaaagcgcgtcgacaccgcgatccggatcgccgcgcaaagcgggctgccgctgaagatcgccgcgaaggtcgacaaggcggacgccgactatttcaaggaagtgatcgagccgctgctcggcgaggcgcacgtcgaattcatcggcgagatcaacgaggcgcagaagcccgcgttcctgtccggcgcgaaggcgctgctgttcccgatcgactggccggagccgttcggcctcgtgatgatcgaggcgatggcctgcggcacgccggtcgtcgcattcaaccgcggctcggtgccggaagtgatcgaggacggcgtcacgggcttcatcgtcgaggacgtacagggtgcggtcggcgcgctgcaccggatcgacagcctgtcgcgcactgcgatccgcgaacgtttcgatacgcgcttcagttcgaaggcaatggcgcagcgttatgtcgaaacttacgaatcgctttgcacgggagcgcgccaaccggcattgcgccgcgtcgccggcgcctgatacggaaatccgcgaagaaatatttcgtaatccaatccgcgccgcaatcggcgcgccaaacaaagagccgcatctcgatgcggctctttgtttgggttttcggtcattcggtcattcgatcaggaaacgatcgcggtttttaccgacgatccaattcggcggcttgccgcgcccgctccaggtcgcgcccgacttcggatcgcggtatttcggcggcagcggcgccttcttcggcgggcgcccgcgcttcgctcgctccgcgaagcccagatcctgggcagtcagtccatattcggcaatcttttgctggacttcggcaatcactgccgccacttcctggcggcgcacatcatccgcctgggcctgcagatccgcgatctgcgccttgagtttcgcgtattgagacatttttcgactccccttttgatgatgcggccccggcgaatccggccgggacaccaacatccgttacgccatccgcactgccgccctgcccttcgaaattaatgctgccatctttaaccgattcgactatatcgagaatgcggacttattctaataagggcattcgtcagccattaaaatttaacaatcgttgaccctccccacccgattcatttcctataatccagaccaattccggatgacggtttaaatccgtcgcatcgtccggtcgccttcaatccacttgaacttgaacgaggtccttacatgaatctttctcagcgtctcgctgcagaggcattcggcacgttctggctggtgctcggcgggtgcggaagcgccgtgctggcagccgcctttccgggcctcggcatcggctttgccggcgtcgcacttgccttcggcctgaccgtgctgacgatggcattcgcaattggccatatttcgggctgccacctgaatcccgcggtaagcgtcggcctgacggtcgccggccgcttcccgcacgcgatctcgtgccgtacatcgtcgcgcaggttgtcggcgcgacgctcggcgcattcgtgctgtacctgatcgcgaccggcaagccgggcttcgacgtcgtcggcagcggcttcgcgacgaacggcttcggcgagcgctcgcccggccactacgcactcggcgcggcgttcatttgcgaagtcgtgatgacgggcttcttcctgttcgtgatcctgggcgccaccgacaagcgcgcaccggccggcttcgcgccgatcgcgattggcctttgcctgacgctgattcacctgatctcgattccggtcaccaacacgtcggtgaacccggcccgctcgaccggccccgcgctgttcgtgggcggcgaagcaatcggccagctctggctgttctgggtggcgccgatcatcggcgcggcactcgccgggatcatctacccgctggtcgccgggcgtgacaacgccgtcgacctgctgccggcatccgctcgcacaagcgaataaatcactacggggtcaagcgagcagagcagcgagcctcacgctgtccaagaatatcgaggcaggtaatttcgacgggcgccgctggcgcccatttccgcccggggcggacgctcaggacgcggcggcgttgccttcgagcgagaacagcgtgcgcaggtgacgggcgacgcccgcgtcgaagttgttgccgatccgcgggatgtgcggcaaccgcgcgaccaggtcggggttcgcgttgttcatcatgaacgcgtggccggcggtctcgagcaggtcgatgtcgttcatgttgtcgccgaacgcgatgcagtgtccggtgtcgacgccgagccgcgcgagcaccgagcgcagcgcgcggcccttcgacacgttcgcggtcatcacttccaggcagtcgggcagcgagtacgtgacgtacagcgcatcgccgaagcgcacgcgcatctgctcggcgacgaccgccagatcggccggatcaccgatgtacagcaccttcgcgatatccgtgccgtcgtgcgcggccatgtcgatcacgtcgtagcggaagcccgaatcctggtggaattcgagcaggtgcggcgcgtcacggtcgatcagccagccctggtcggtgaacaggttgacgatcacgcgaccgtgcgcaccgacgatatccggctgcacgagaccgcggacgattgccggatcgatgtcctgcgcgtggatcgtcgtgtcgtccggcgcatgcacgcgcgcgccgttcgacgtgatcaggtacggccggatgccgagcacgtcgcgaatgccggcgacgtccgcgtagtggcgcccggtggcgatcacgaactgcaggccgtcgcggtcgagccggcggacggtgtcgatcgtgtacggatcgagctggtggtcgctgttcagcaaggtaccgtcgagatcggtggcgatgactttgtacatgggacggaagaatggcgctcagggctctgcggaacggccattctaacgtcgtgcccggttgcccgccggacggttcccggccgatcgccgccgtcggcccggtttcggtacgcgttcagctgtcctcaaatgccttcagttgctcagttgccttccgcctcgcgcagcgcctgcagcgcgagccgcagcgcgccgtgcgccgaatcgtcgagcggcgcgcgcagccgcgcggcatggcgcgccggcacggccggagccagtgcgtccgccaggccgccgcacagcgcgaccggcagcgcctgctgcggatcgagcgcgtcgatcatcttgccgatctcgtcgcccgcctgcgcgatcagcgcgcccgcgaccggatgcgaacggtgcgcgaacacgatcggcgcaagccgcgcgtagatcgtctggttcgcatcgcacgaccactggacgagcgcgtcgcgatcctgcgcgcccgtttccgcgagcaacgcgttcgcgaacgcatcgcgcggcacgcggccgtcgagcgcctgctgcgcatacgcgagcgcgcgcacgccgagccacgcaccgctcgcctcgtcgccggacggaaagccgaagccgcccgcgatccggcaggcgccggccgcatcgagcgccgccgcgatgctgccggtgccgagcgcgacgatgagccccggcgcgccgccgtgtgcgccgacgacggtcgtatatgcgtcgctctcgaccgcgagcgcgccgagcggcgcctgcgcgcggaacgcggcgagccacgcggcattgttgacgcccgcgagcccgcagccgagcgcgcactgcggccagtcgaatgcgaggccggctcgcgtgaacgcgtccgcgcaggccgcgccgatcgatgcccacgcgcgctcgatgccgagcccgagccccgacgggccgccgcgccctgcgcgagctcgcgcccgtgccggtcggccagcaccgcgcgcgtgcccgtgccgccaccgtcgatcccgatcgcaaaagtaatgccgccatgccttcatcccgctgattcgaacaggcgccaagcttaaccggatcggcgccgcgcgcccatctgccgttcggccggctgttccgtgaaaagggcttccgctatgctggcacgatcgaatcgacactgaaaacgaggcagacgatgtcgcagcggtgcaactgggtgaagactgaagcggatgctcactatcacgataccgagtggggcgtgccgtcgcacgacgatcgccacctgttcgaaatgctgatcctggaaggggcgcaggccgggctgtcgtggtcgacgatcctgaacaagcgcgcgggctatcgcgacgcctttgcggatttcgacgtcgatgccgtcgcgcgcttcacgccgaagcgcatcgaaaagctgctcgagaatcccggcatcgcgcgcaatcgcgccaaggtcgaatcggcggtcaccaatgcgcgtgccgtgcagcgcatccgggaagagcacgggtcgctcgccgcgttcctgtggtcgttcgtcggtggcacgccggtccagaacgcgtggcagtcgtaccgcgacgcgcccgcgtcgacggagcagtccgacgcgctcagcaaggcgctgaaggcgtacggctgcaagttcgtcggttcgacgatctgctatgcgctgatgcaggccaccggcatggtcaacgatcacgaggtcggctgcccgtgccacgcgcaatgcgcggcgctcggcggcaagcagccggcacgccggcgcaaggcgggctgacggcgcgggcatccgccggccgcccgtcgttcgccgcggccctgcggcggttatgccggttgtgccggcaattccggccaggccgccagccgccctcacgaaacgatgcgcaacgcgcaaccgctcacctcgcggcgcgcgacggcaccggcgcaaccgcccgcgcactgcgtgcggcccgcacgcagtgcgctgcgcttcttcacccagatgcagatgcccgtcacgctcagcatcgcgatgacgatcccgagcacgctcaccgcggcgcggcccgcgacgccggcgatccgccccgagtgcagcggaaactgcgcctgcatgaacaggtcgccggccgagccgcggcccggcacctgggcggcgacgggcttgccggtcacggcgtcccagtagagccacgcgttgccgagcccgacgtcgccgtgatcgttgccgggcgtgaagaacccgactgcgtaggcattcatcgccggcgcgaacagcagcgcgccgggcggcgcggcgatcccggcgtcgcgcccggccgcccgcgcgatctcgacgatccgctcgcgcggcagcatcgtgctgcccggcggcgcgggcgggaagtgttcggggttcgtgtacggcgtctcggcgagcggcgacaccagcgataccagcggccgcacgacgggcacggcgagattcatcgagatcgacgtgaccgcgacgaccagcagcagcccccacacccacacgccgcccgagcggtgcaggtcgaacaccagcggatagccgccgcgccgcacgcggaacgcgaacgacttgcgccagcttttcaggttcggaaacgcgagcacgagcgcgatcaggctgtcgatcgcccacacgatgccgacgacgcccatcacccagaacccgaagttgatcccgccgtacaccggcaggaacagcgagtagtgcagccggtagatgaacggcatcaggtcgagccgcgcgagcgacggcgcgccccattcgcggcgcccctgcaccgcgccggtcgcgggatcgacggcgatctggctgaagtcgagcgcgtacggctggccggtcgccggatcggtgcgcggcatcacgccggcctgcagcgtatggcccggttcgattgcgagcggcagataggtcacctgcacgcgcgggtcggcggcctcgatgcgcgccgcgagcgcgagcggatcaagcggcgccgcagcgctgcgtgcggtgtagaagtccgggttcagtagcgcgtcgagctcgtggtcccacgcgatcagtgcgccggtcagccccgcgacgaacaggaacagcgcgatcgcgaggccgaaccagcgatgcaggcggacgagaaacggtcgcaggaacgcattcatcgcgcccccggcaagggaaagcgggccggcacgaacggccccggatcaacggaatgcaggtcatttgaggtcacgcgccgcgcgcgagcggtgccggccgtcgctggcgaggccggatgcccttgcacgcggcatggaattgttgcgcgttcgacgggttttggtacgatgcgcggcattttatcgcaatgcgaatgattcttacttgcatttttacttatccacgatgaccgccagcctcgcccgccctcccgtccgtccacgtcgcatggccgccgcccttgcctgcgttgccgcgtcgctcgcgcacgcggacgattctcccggcggcgccacggtgctgcctgccgtcaacgtcacggccgcgcacgactcgccgcagcacctgaccgacacggtctccaccggcgcgctcggcacgcgccgccagctcgacacgccgttctcgacgacgatcgtcacgtcggaggaactcgaggcacgccagccgtacaagctcggcgacgtgttcgcgaacgacgcgtcggtgtccgacaacagcggcgcgtacagcgcgtgggccagctacatgaccgtgcgcggcatgcagctcgactggcagaacggctacaagatcgacgggctgccgttcgtcacgtacgggatcacgatgccgtacgagcagctcgatcgcgtcgagctgctgaaggggctcggcggtttcctgtacggcttcgtgacgcccggcggcgtcgtcaactacgtgacgaagcagcctggcgccgaacccgtgcgcagcgtcgacgtcggctaccggagcaccaatgtgtggaccgagcacgtcgatctcggccagcgcttcgggccggacggcaggttcggcgcgcggctgaacgcgacgcacgaggaaggcaggacgtacaacgacggcaacatccgccgcgacagcgtatcgctcgcgctgcaggcgaacctgacgcgcgacctgtcggtgaatgtcggcgcgctgtaccaggatcgccgcacgacgggccagacgccgtcgatcttcaccggcagctatccaggcggcgtgctgcccgcgacgatcagcggcggcacgacgaacctcggcggcagggaccagtacctgaacacgaacctgcagctctatacggccgggctgcagtaccagttcgcgcccgactggcagctcgacgtcgcgtacagctacagcaaggcgacgcgccgccgcaacgaaagcacgctgtacctgcaggatgcagccggcaactacaccgacagccgctacgtcgggatggaggatcaccgcttcagccagtggcgcgcgatggtcgagggcaaggtacgcacgggagcgttcagccaccagatcgtgatcggcgcgtcgtggcagaagcaggcgaacgactattcggcgaacagcgtgttcgtgccgctcggcgccggcaacctgtatgcgccgaatccgtaccgctacgacagcccgcacggcttcgtccagtaccgcacgagcgagatcgtgcagaaatcgctgttcgcgagcgacaccgtgcagctcacggcgcgctggtcggtgctcgccggcgtgcgctacatgaactacgagcagcgctcgttccaggcgagcggcgccgaggatcccggctatcgccagaacggcgtggtgacgccgacgttcgcggtgatgttcaagctcgcgccgacgaccaccgcgtacgcgagctacgccgaatcgctcgagcccggcagccgcgtgaacgacgtctacgcgaacgccggccaggtgctcgccgctgcgcagcaaacagtacgaactggggatcaagagcgagcacgcgcgctggagcgcgacggccgcgttgttccgcatcgagcgcagcgccgaatatgcgaacgcggcgaacgtctatgtgcaggacggcgaatcggtcattcagggatcgagttcggtgcgcgcgcgaaaatcggcgcgcgctggaacgcgggcgtcgacgcgatgctgctcgacgcgtggtacgcgaacgggatcggcaacaacggcaaccgcgtcgcgggcgcgccgcgtttcgtgctcgccggcgacatcggctatgcggtgcccggcgtgccggggctgacgctcggcgtcgatgcgaaattcaccggcgcgacgccgctgcgcgcggccggcggcctcgacgccccgggctttctcgtcgtcaatgcgggggcgcgttacctgacgcggatcggccgccacgacgtgacgctgcgcgcgtcgatcgacaacgtgctgaaccgccgttactgggaataccagtacgcggactacgtgaagccgggcgacccgcgcacggtgagcctgagcgcgaagatcgacttctgaacgccgcgccggcggccgcaagccgtcggctgccggccggcatggccgcaccgcggcggcctcgggattttcccgagccgcaaagcgaaacggcggagcggcttctttcgaagctcactccgccgtttcgcggcgaaccgtcagacgctcttagtggagcttcttcggcagcatctggctgcgcaggcgcttgtgcaggcgcttgacggctgctgccttcttgcgcttgcggactgcggtcggcttttcgtaggactggcgctcgcgcagttcagcgatcaggccatttttcgatagcacggcgaaagcggcgaatcgccacttcgaacggctcgttttctttcagaagaatcgtcgtcatgtcgttcctaaattgcttaaacggtcaaaaacgtagcggccaagcgccacgcaccggccatccgagcgtccccacaaacaggcgaaacgagcggaaatacggcctcggaggccggaaaagagaggcggaaagcaccgcgagtacgcttcacaagccgcgtgcagcgccgcgtttgactgccagcagacacgccgaaaacggcagaggcttgacagaaatctcaattcagcccgccatcatagcagggaatcacagacaaaaccacccttttgtcgattgcgtgtgcacaggcgaacgactgcgtggcgagaccgctctcaagccccgtccatccggcatcgcgccgaatcggtccgaaatgacaaagaaggataaaaatcgggccgaatctcaacgcgcccctcaagttttgttttggtgcgccgaaatcctgctctgaggcggccagcaatgaacgagtgcttccgccgacgccaaaacggctttccagggctttcggcttacacaggagatttttccatgctcggaattaacagcaacatcaactcgctggttgcacagcagaacctcaacggctcgcaaaacgccctgtcccaggccatcacgcgcctgtcgtcgggcaagcgcatcaacagcgcggcagacgacgcagcaggcctcgcgatctcgacccggatgcagacccagatcaacggtctgaaccagggcgtgtcgaacgcgaacgacggcgtgtcgatgattcaaacggcatcgagcgcactgtcgtcgctgacgaacagcctgcaacgtatccgccagctggccgtccaggcatcgacgggcacgatgtcctcgaccgaccaggcagcactgcaacaggaagttgcgcaacagatccaggaagtgaaccgtatcgcgtcgcaaacgacgtacaacggcacgaacatccttgacggctcggcaggcatcgtgtcgttccaggtcggcgcgaacgtcggccagacgatttcgctggacctgagccaaagcatgtcggctgccaagatcggcggcggcctggtgcagaagggtcagacggtcggtacggtgacgggcctgaacctcgatgcagccggcgcgtatcgtcggctaccgcgacgatctccgcgatcaacgtgatttccgatggcaagggcggctactcgttcaccgaccagaacggccaaggcatcgcggcgacggtcgcacaggcggtgttcggcgccagtgctacgaccggtacgggcacccaggtcggcaatttgtcgctgcaagccgccgcaaccggcgcgaacacgactgctgcacagctcaccgcaatcaccaactcgatcaaccagatcaacgcggtcaacaatccgaagaccgtgtcgggcctcgacatcagcaccgtcagcggtgcgaacgttgcgatggtgtcgatcgacaacgcgctccagacggtgaacaacgtgcaggcgcaactcggtgcggcacaaaaccgcttcacggcaatcgccacggcgcagcaggcagaatcgaccgacctgtcgtcggcacagtcgcagatcaccgacgcgaacttcgcgcaggaaaccgcgaacatgtcgaagaaccaggtgctgcaacaagctggcatctcggtgctcgcacaggcaaactcgctgccgcagcaggtcctgaagctcctgcagtaatcgcgtagcaacccacggccgggccccgcgtaacgcgcggcccggccgtcgtcactggcgcgcggggcgttgccccgccgccaggtccttatccagaatttcacggactacccgccgcacggagcactacgatgtcgacgatcaatcccgccgtcaccgccgccaacagctcggccaacagcgcgctgcaacaggctgcccaatcgatcatcagcggttcgaccggcaactcgtcgatggacgtcagctcgctcgtgacggcactcgtcaatgcgaagaccgccggccagaccgccgcgctcaacgcgcagcaggccagcgacaacacccagatttccgcgtacggcgccctttcggccgcgctgagcgcactccaggccggcgtcacgacactgtcgaacggctcgctgcaaaacaccttcaccgccaccgcgagcggcaccggcctgaccgcgaccgcgggcgccggcgccgtcgccggcagctattcggtcggcgtcacgcagatcgcgacgtcgcagtcgctgtcgtcggccgcgttcggtgcgtcgacgacgctcggcaccggcacgatgacgctgtcgctcggcagcaagtcgttcacggtcaacgtgggcagcagcaacaacacgctgtccggcatcgccgccgcgatcaacaccacgaccggcaacccgggcatcgtcgcgtccgtcgtcaacggcagcgatggcgcgcacctcgtgctcagctcgacgccgaccggcgcggcgaatgcgatcagcgtcgcggtcagcaacgtgaccggcgacaacggcctgtcgagcctcggcgtcacgtcgacggccagcacgacgggcggccagtcgtccattgcgtccgccaacagcagcgccgcctggaagcaaagcaccgccgcgcaggacgctgccttcacgatcaacggcatcgccgcgacgagcgcgagcaacaccgtgacgggcgcgatcaccggcgtcacgctgaacctgacctcggccgccgtcagcggcacgcagccgcagacgctgacggtcgccaccgacacgaagacgcaagcgtcggcgatcaacaacttcgtgacgctctacaacacgctcgtcacgacgatgggctcgctgtcgagcttcacggccggcgcgtcgtcgcaaggcccgctgctcggcgactcgacgctgaacacgatccgcaacgcactcgcgtcggtcgtcgcgggcggcgtgagcagcaacggctcgacggtcaacctcgcgtcgatcggcgtcacgctgcaggccgacggcacgctgcaggtcgacagcaccgcgctcaactccgcactgcagaacaacccgaccggcgtcgcgtcgctgttcaactcgacgaacgggatcggccagcagctgacgaaggacatcacgaactacacgcagacgggcgggctgatcgccgcacgcacgaccgcgctcaacaacgacctgaaaagcgtcgccacgcagcagacgaacctgtcgaactacgtcgcgcagctgaccagccagtaccaggcgcaattcaccgcgctcaacacgctgatggcgacgatgaacaccaactcgcagtacctgacgcagctgttcggcggcacgaacagtgccggcgcgctgtcgagcaacaagagctgaccgccggccggacaggagagccacgatggaacagaccgaactgatcgcccagctcgacgcgctcaccgacgcgatcgaacatgcggccgcgatggccgactggatcgaggcggcgcgcctcgtcgacctgcgcgagccgctcgttgcgtcgctcgcggccgatcagccgccggccggcatcgccgcgatccgccggattcaggccagcaacgcgcgcatcttcgccgacgcgcaacgcgcgcagcaggagctgaccaacgaataccaggcggcgatgggccgcgtgcaggccgtcggccagtaccagagcatcgcgagccgctgacgcgcgcctggcgccgcatcactggcggcgcaccaacctgacaacaagaactacgcgctgatgtgagggcgtgctcgttcgcctccgcccgccttgtgcgggcgtttttgcccatccggcgcgccgtcgcccaaccgcgccgcgcttgcccaatcggcggaattgaccgcgcttttggcaccacctcgcgcgttcagcgtgatcgcccgttgccgataatggcgcacatcgaataaccgcgcctcccgccatgcttccactcgactcgtccgatcgcgccacgctcagcccggagcagcagttcgagcaagatatcgcgctcgtcatgcaaaatgccatcgcgcgccatcacgacggcgccttcgacgatgcgaaagcactgtacgaagccatactcgatgccatacccgcacacgcggaagcgaactacaacctcgcggtgctgctggtcgacgccggccgcgcgaccgaatcgattccttacttcgagactgcgctcggcgccaatccgggcaacggccaatgctgggtcggctacatcaacgcgctgtaccgcgcgaaccagatgcccgctgcatgggttgccgtcgaaatggctcagcaacgcggcgtacacggccccgcactggacggcctgatctcgcaaatggccacgcccgacgtcacgctccccacggcacccgccgcgagcccggtcagccaggccagcatcactctgaatatttcgtcccaacctcggctccagcccgatgaaaacgtcaaagggagggacccgtcgaacccgtgcgcaaggcgccgctgcacaaacttcagaagcacgccgcacttttcgataagaatcgatccgcggaagcgctggcactcgcgcgccagctcgtcgccgactatccgaacgacggtgcgagcctgcgtgccctggcgatctcgttgtatcgaaaccggcaatatgatgagatgatcgatattgcctatcgcgcgctcgagagcctgcctgacgactatctgctccggacattgctcgcagatacgctgcggctcatgacccggctccaggaagcagaaattcagtgccgcgccatcattgccacccaaccgacgaatgtggaggcgcaccgagtgctcggcaccgcgctgcacgggttgcggcgccagcaagaagccgttgccgcctgccggcgcgccgtggaactggcaccacatgcggcatcggccaatggtgctctcgggttcgtgctgctggaccagggcgccgcgcaagaggcagttccgtggctacgacgagccatcgaaattgatccgaatgactgcgtgtcgcacagctcgctgctgttcagcctgattcacgacgacaccaactcgccggagatgctgctcaaggaacatcgcgcgttcggcaaacggcacgaacggcatgcactcccgagaaaatttacgaattcacgcgatcccgaacgcccgctgcgaatcggcttcgtgtccggtgacctgttgaatcacgcagtcgcccactatctgctgcccatcatcgaacacctgagccgcgatccgaatctatcgctgcacttctactacaactacgtggtcgaagatcacgtcaccgccaagctccacgcgcatgccaccacgtggcacgccgtgatgacgctgggagacgccgcgcttgccgaacagattcgcaacgattgtatcgacgtactgattgacctttccggccacaccggtcgcaaccgcctagtcgcactcgcgcgcaaacccgcgccattgcaggcatcgtggatcggctacccgggcacgaccggcatgaacacaatcgactactacctgagcgacggtatcgtcacgccggccggcgaactggacgaccagttcgtcgagaagatcgtacgcatgcccgcgctggcgccgtatgcgccgcccgcgaactgcccgccagtcaatggcttgcccgcgttgcacaacggccatatcacctatggcagcttcaatcggctcaataagctgcgtcaagacgtgatcgcgctttgggccgtgatcctgcgcgccaagcccgacgcccgaatggtgatcggtgcgatcgagcaggatcgcgaccgcgagacgatcgccggctggttcgcggccgagggcatcgatcccgctcgcctgacgttccagccgcgcacatccgtccccgtctatctgcagcaacatcaccgcgtcgacatctgcctcgacacgttcccgtacgcgggctcgacgacgacgctcaacgcactgtggatgggcgtgccgaccgtaacgctcgccggaatgtcgctcccgacccgcggctccgccagctggctgaagcgggtcgatctcgaggacttcatcgcgcacgacaaggacgagttcgtccgcaaggccatcacgctcaccgacgatctcgacacgctgcagacgatacgcaacggcctgcgcgaacgctgtctcgcgtcggcaccgttccatccggacgtcgtagcgcaggggctgtcggtcgcgttgcggatgatgtggcgccgttggtgcgcaggcgaggcaccagtctcgttcgatgcgatcttgcctgaccagtcgacctcgacgccagcagaacagacggccggttagccggcaggggccagcttcgtgcgtcacagccggcccggcgagcaaatcgcggcatttccacgaattgactcgcaaaccgccccctgctcgatcgatcgtgcgggcatcgcgcccgctagagtgctctcacgatcaccagtgtgcgcattggcgctcgaaacgtacgacctcgggacaggatcatggacaagctcatacccgtcacacagccctacatgcctccgctggacgagtttctcccgtatctgaaccagatctgggagagcaaggtcgtcaccaacggcggccgcttccatgcagagctcgaacgatcactctgcgaattcctgggcgtcgagcacatttcgctgttttccaacgcgacgctcgcgctgatcaccgcattgcaggcgatgaagatcaccggcgaagtcattacgacgccgttcagcttcgtcgccaccacgcatgcgctgcactggaacggcattcggcccgtgttcgtcgatatcgatccggtgacgatgaacctcgatcccgcacgcatcgaagcggcgatcacgccgcagacgaccgcgatcctgcccgtacatgtctacggctacccgtgcgacgtcggcgcgatcgagcggatcgccgacacctacggcctgcgtgtgctctacgatgccgcacacgcgttcggcgtgcgccaccacggccgctcggtactcgaattcggcgacatgtccgtgctcagttttcacggcaccaagatcttcaacacgttcgagggcggcgcgctcatctgtcgcgacgcgaagacgaagcgccgcatcgaccatctgaagaacttcggcttcgtcgacgaagtgacggtgatcggccccggcatcaatggcaagatgaacgaagtacaggcggcgttcggcctgctgcagctcgaacacatggaccggatcgcggccggccgcgcacgcgtggacgagcgctatcgggtagccttgcagaacgtgccgggcctgctgctccccggttcccgagcacagcacccgcaaccactcgtatttcccggtgcgcatcacccgcgacttcccggtgacgcgcgacgcggtctacgatgcgctgcgcgcgcaaaacgtcgcggcgcgccggtatttctacccgctgatcagcgagtttccgacctatcgcggcctgccgtccgcagcgcgctcgaacctgcccgtcgccagcgacatctcgcatcaggtgctgtgcctgccgatctacccggcgctcaccgcacgcgaccaggaccgcatcatcgacatcgtgctggccgaggccggcctgaggcagcatgcaagctgaatgccgcctggccgtcatgcagccgtacttctttccgtacgtcggctatttccagttgatggccagcgtcgacacgttcgtcgtgttcgacgacgtgaacttcatcaatcgcggctggatcaatcgcaatcgcatcaacgtcaacggcgcgccgcacatgatcaccatgccgctcaggcaggcgagccagaaccggcggatctgcgacatcgacgtcgcggacgacgcgacatggcgacctcggatcctgcgcacgatccatcagagctacgcgcgctcgccgcagttcgcgcgcgtattcccgctcgtcgaacgtatcgtgatgcacgatgcgtccaacctcgccgactacctgctgcacgggctgatcgcactgcgcgactacctgcgtctcgacacgaagatcgtcgcgacgtcgcgacgctacgaaaatgcggatctgaaggcccaggcacgcatcatcgacatcggccgacaagagcacgcgaacatctacgtgaacccggccggcgggcaagagctgtatgacccgcacgcattcgccgccgccggcctgcagctgaagttcctgacaccgggcctcgagccctatacgcccgttcgcggcgcattcgttcccgcgttgtcgatcatcgacgtgctgatgtgcaacgacgacacatcgattgaccatctgcttgccggcgccaccctgtcatgaaagacgatctccacgccacgctcatccgtcactacgaggcgtgcctcgagcgtcacggcgatacgcatcgcggcgtcgactggcccaacgccgaagacgccgccacgcgctatcgcgtgatgctcgacctcgtgaggcccggcccggcgcccgccacgctgctcgatttcggctgcggggcgtcgcatctgtaccagtacatgttggatcgcggcatcgacgggctgagctatgccgggctcgatgcatcccaggcgttctgcgacctgtccggacgcaagtttccgggcaacgactaccagtgtgtcgacgtgctcgcggagcccgaccggctcggcgaatacgactacatcgtgatgaatggcgtcttcaccgaaaagcgcgaactcggctacgacgagatgttcgactatttctcgcgcgtgttgcgcgtcgtgtttccgaaggcgcgcaagggcatcgcgttcaacgtgatgtcgaaggaagtcgactgggagcgcgacgacctgttccacgtgccggtcacgcagctgacgcacttcctgtcacgcgagctgtcgcgccactatgtggtgcggcacgactacgggctttacgagtacacgacgtacgtgtacagggagcacaactgatggcaaacgtcattctgttcggtctgcaggactacgcggaacttgcgcactactacctcgaacacgattcgccacacacggtcgccgcgttctgcgtcaaccgccagtatctgccggaaagcggcacgttcaagggcctgcccgtggttgcgttcgaagacgtcgtcgaatcccatccgcccggcgacttcagcttcttcgcgccgatgtcgccgaagcggatgaaccgcgagcgcgagaaaatcttcaacgagctcaaggcgtgcggctatccgctgatcagctatgtcagttcacgcgcgaccgtgtgccacaacacgatcggcgagaactgcttcatcctcgaagacaacacgctgcagccgttcacgaccatcggcaacaacgtcgtcctgtggagcggcaaccacatcgggcatcacgggcgggtcggcgaccacgtgacgatgacctcacatgtcgtcatgtccggccattgtgatatcggcgcgtacagcttcgtgggcgtgaacgccacgctgcgtgacggcgtgacgatcggcgaaggtacgtttgtcacgatggccgccgcgatcacgaaatcgaccgagccatggtcggtgtacaagggcaacccggcggtcaagctcgcgatggccagcaccgacctgaagatctaggggcacccgtggcaggcatacagtgggacaagcaggggctgatctatgcgcccgacgcacgactgccatgggcaagatcgcacgcgcagattccgacggtcgccggcgtcaacggcgatacgctgcaactgctgttcagcagccgcgacgcaggcaaccgcagcgcgatcgcaagcatggccgtccgcgcgagcgcaccggacgacatcatcgccatcgatccggatccggtcctgccccgggcgtgctcggcacattcgacgattgcggcacgatgccgtcgtcggtcgtcgagcacggcggcgttcgctacctgtattacatcggctggaacgtgcgcaacacgattccgtatcacaacgcagtgggcctcgcgatcagcgaggacggcggccgccattaccggcgcctgttcgacgggccagtgatggaccgtacggccgacgagccgtatttttgcggcacgacctgcgtgcgcatcgagaacggaatctggcgcaactggtatctgtcgtgcaccggctggaccctggtcgacggcaagcccgaggcacgctaccacctgaagtacgcggaatcgcgcgatggcattcactgggcgcgcggcggccgcgtcgcgatcgactacctcgatgaccacgaaggcgggctggcgcgcgcgtcggtgcatttcgacggcagcctttaccggatgtggttctgcaagcgcagccacgacggctaccgcgagcgctcgtcggtcagctaccggctcggctatgccgaatcgaccgatggcatcgtctggcgtcggcgcgacgacgatgccgggctcgatgtgtcgcccggcggctgggatgcgttcatggttgcgtatccggaagtcgtacaggtaggcgatcgcctttacatgttctacaacggcgacggcttcggcgcgagcgggttcggctacgcccaggcacgggccaccaatggaattcagggtgacgcgacatggacgtgatcgcaggagattttcgggaactcggttacgcgatcgtcgcaaacgatgcgttgcaatcgctgatcaaggatgtgcgcgcgaagttcgagcggcatttcattcccgcttcggagacgacacgacgcgcaaccgcaacatcatcaagctgctcgccgaagacgtcgacgtgaagcgcttcttctgttcacccgacctgacggccgcgctcgaccgccacctcggcatcgcaatgccagtgcagacgggcccgatcgtcacccactacacggcaaacgatcgcatcggaaacaactacgggctaccgtatcaccaggactggccgagcatggggacgtcctctcgcgcggtgatcgcatggacgtcgatcgccgacgttcgcaaagggcacccgggctcagcatcgtcccgggcagccatctgcgtggcctgtggccgggcaagcagaccgaccgcggctacgtgctcgatgaccaggcaatcgacggggcctgcgacctggagatcgacgcagggcatgtactcttcatgtcgccctatctcgtgcatcggacgctcaccagcgaagtcaccgactggaagctgtcgctgtcatgccgcttcgacgatttctcgtgcgatcaatggagccgccgcgggttcgtcagcgcgtaccgaaccgccgtcgaccggcaggtttacctgtcgggattctgagcgaggcccgcgttgccgcgggcctcggcgatcagcgtacgaagatgcagttccacaatcccgcgtagttctgcaccgggtgcttgcttgcgatcgtcagaccgagctcgccgagacggtgggtgagcaggtccatcttcgcgtcctcgatctcgatcagtagttgcctgcacgcgcccaggccctgcgccgcaccgtcgatgagcggaacctcatgcccgtcgacgtcgatcttgacgtactcggcctgcggcaggccgaactgctcgcgccagcgatcgaaatggacgacctggatcgcatgcacgtggttcggtgcgaacgtttcgcccgagacgagcgacggctggccgacaatcttctcgtgcgcaccaagctccatcttgcgaatgaacagccggtcgaccgcgaaccggtcggacgccgcgacgttgaacgcctggaggtcgaggccgtcctgtgcgttgaggtacgcgttccacgacagcaggaagtagttcgacggatcgggctcgatcgcgatcaccttcaggccgcgctttgccgcatacaacgcgaagattccgttgctcgcgccgaaatcgtagtagacggatccgggcggcagccggtcgatccagtccagaagttccggttcgatgtactcgagcccagccgccatccagagtagtcgcttgctcggcgcgagccagcggaacgtgagcccgcgcaccgtcgtctcgacgacgtgccgatcgagatcgaacgcttgcgcgcgggtcaacgcgtcctcgctcacgagactttcaacggggacgaacttccagttattcatggcggccttggtcgatttcatgcttgacgggaacgcgtgcccgccgctgccgatcggacctcgccccgaaaacgcgttgattctagcgacgcgctgtcgattcaaaacgttgaacagattcggcaaacccgggcaattcgtgctgttcgcgcgagtgggcggccagtgagctcgggtcaacgcgccccgctgcgcgcgacagcccctgatcgccacatgacatgccgtcgactcgaccgacacgtccggaatgcgatggatcgaatcgatcggcccggagctcgcgaaccggggccgatcgggcggatccgttacccgcgtgttcaggtcgtagatcaagatgcgaacacagcctaaattcggcatcagacctgccgttaacgtgagcgcaaggaagacgtcacgcaaaaagcgggcattcgtaaatcacgacggcctgcgtattacgccgggtcttgcgtaatggaacgcggcgcgctgcgaggaacgaagcggctccacgtccgcttccgcccgtcctcgcccggaacatatgcctgcggttcaccctgcccgtcgtgtcttcgtctcaatgcacgatgcacgcaggggtaccccaacgcgtttgcggcagcaccgggcacatatcaatcaacaaacactgagagaactcaactgatgcgcaataaactgatcactgcggcacttgcggccatggtccccttgatgtgcgacgcggcgacgagcgtcgtgatcgacgcgagagccaactgtctttccagctatgtcggaacggtgtccggcggcacgccggtcaagctcgcactcgcgccgggccgatataccgtttcgcttatcgcgaattcgatgagctgcggcggcggcgcgctggagcatggctgcaacatcgacactgcgatcatccagggtggcttcggcagcattcggtggggcggtgcagtcacggcgcgtccaaccgtcatcgagatggccggtagcggcacgaatgtcttcgcctatgtgagcgacgactactgcctcgacaacacgggacaagctgcgttgttgtttcaacccacgaactgagcgccgtttgcacgaaccgcgcaggattgcatcctgttcctcgtgttacctgcgcgggatgactcaacctgtcgagtcgtgacatgaatcgaccgttgtcggtcaccattgcgcccgatgcaccgcatcgggcgttttgtatttatgcacacgcaggctgctcgtgtccggcgatggaccgggtgatccatcgatcgttccggtcatcgtgtcagacgacctgcgccgtctcgttcgccgtcacgcgacccgctgcaaaatgcgcggcaaacgccgcccgcaagcgctcggccaaccggatccagctctcgtcgcgcccgcgccggaacagccgcaccgtgcccggataccacggcgaatcgtcgcggccgtgcatccagcgccagtccacgtcctgattcggcagcagcacccagcaaggcttgccgagcgacgcggccagatgcgcggtggacgtgtcgacgcacaccacgagatcgagttgcgcgacgaccgcggccgtatccgcgaaatcgtcgatctccgagcccagatgcagcaacggcaggccgcccggcggctgacgcgcctcgtcctcgccctgccctttctgcagactcacgaaattcaccccgccacgctccaaagcggcgtcagcaacgcgagcgacggcagtgagcggtgcgcgtcgttgtgatgcttcgggttgcctttccacacgaggccgacgcgcgggccggccggcaatacatcgaggcttgcgcgccagcgcgcgacgcgggccggatcggacgcgagccgcaccggcggcgggatcgtgtcgagtgtcgtgcccatgtgcatcggcgcgctcagcaggctcgtccagtaatcgaactgcgcggcttgcgccgtcgccgtctcgtgatcgagcaccgcgtcgacgccctcgaccgtcgccatcagccgatgcagcgcgggctggcacgcgaacaccacgcgcgtcgcgtgccgcgcacgatattccgcgaaataacggctgaactgcagcatgtcgcccaggccgtcttcctgccagacgagcagcgtcttgccgacgagcggctcgccctgccactgcgcgcaccgcagcacctcgcgggtccggcggtgcacgaacgccgtgtgttcgtagcgcgattcgtagcgccgccagccttcttcgaaccggcccaggccgagcaacagcgtcgccaggccgaaacgcgcatcgccatagtccgcacgcagttcgagcgcgcggcggtacgcgcgttcggcgtcgtcgtggcagccggcatgcgcgagcgtggtgccgaggttgtagtgcacttcggccatgtccggagcgagcaacagcgcctcggcgaacacggccatcgcttcgtcgtgacgaccctgcgcgcgcaggacgcagccgagattgttgtgcggctgcggcaggtcgggacggcaacgtatcgcgtcgcgataggccgcttcggcttccggcaggcgatcgaggttctgcagcgcgacgccgaggttgtagtgcgcctccgggtgatccgggcacagcgcgagcgcctggcggctggcggcttccgcttccggcagccgctgcatgtcgacgaggatcgcgccgagattggcgtgcgcaagcacggagtcggtgcgcacggtaatcgcgagccggtaggcgagttccgcttcggcgtggcggccgagcacacgcaacaggttgccgagatcggtcagcacgtcggccgactgcggctcgatcagcagcgcctgcccgaatgcctgctcggcttcatcgagccggccgagcgcttcgagcaccttgccgaaccggtgatggtgcgacgcccgcagcggcgtgacggacgcgagctgccggcgcaggagcgcctcggcatcggccaggcgcccttgcgacacgagcagcgcgccgaggccgtcgcaggccggctcgaacgccggcatcgcgtcgatcgcgcgccgccaccatgcttccgcgtcggccagccggttcaggccgagcgcgcagacggccgcgatgtgaagcgccgcgactgccggcgccggccggccgagcaggggcgcgacgagcgacagcgcgtcggcgaactgtccgttctggcaccgggttgcggcgtgttgaaccagcgcggattcgtcggaagcaggggtcatgtcatgcggcgccgcacggcgcgcggcgcgaacggacgttcagacggacgccggcacggcggccggttggcccggctggctgacggcccggtccctggcttcctggagcgccgcgagcgtgtcgagtgcacgcccttcgtcggcggtgagatcgaccagaaatgcatcgttgttctgcttgatccagtcgagcggcatgtcccaccacgcgagctgcagcagtcgttcgcgcactttttccgtgaaacggaagcgcaccagacgggccggcgagccggcatagatgccgtacgcctcggtgcggaaattgggcgggatgacggcccgcgcgccgatcacgcatccgctctcgatctgactgccaccgagaaacagcgcttcgtcgccgatccagacgtcgttgtggatcacggtgtccgcgtattgtggcatcggcggattggtgaggccgttaccgtagatgctgaacatgctcgtggaaatggtgcgcatctcgtgctgaccgttcaacaggaatcgcagacgcattccgccggacacattcttgccgatcacgagtttctgatggccctggtcgtacttcacgagtgagcccacaccgagcccggagcaacggccgatatgaaaagtaccgacctgcgcctcttcatcgagccagtcgcggaaaaattgttcggaatcgtcgacaaggcaccatcccggtagcccagtacgatgaaatgcttcgcccacggatggtcaggcagcacgccaatacaatcgtcggaggtcgtaacgttcattcgcggtcgcaagtgtgccgctgcggcggctcgatgccgggccgcgcgatacggcggtgggaaaggtcgcggcgcatcggccgcaaacatggacgatgcagtatagaaagccggcgacggcaaccgacaacgaataagaacggcgttctggcttctgttccggagataggggctggtgaggtctcgcgtccgcggcccggctgcgccgcgcgtgggcgtggaattgccgtcgccggccgatgacgggtgcgtgcatcattcggcgctcgggcgttgacgcccggttttccttcgtgatgctcacacgtcggcagagtcgcagcttcgatccggccagcacgttccgtcaccggagccggccgccgtagcgatgtgctgccgccgccttcaccaacggtgtgcgccgctcactccccgcgttcaattactcgacgaacacccgccgcaactactcgaactgcacgaactggaactgcacgaactcgacgaactgcagctcgacgacgagcaactgctgtccgatgcatcgaacgaactaccgctgcccgctttcagggcggcgagcgacgacatccgcgacgcggtctgcacggtttgcgaatacaccgaccaagcggtgccggccagcgcacccgcaccgaacagcgcggcagtccacagcaacgggtccgggtcgtcgcgttcgcggtcctgcgtctgctgcgtctgctgtgctgcgtgcgcatcgggttgcgaggattgcgggcgctgaggatttcgcgcggcgcgcggatcgtgcgcgatccggcgcgcaagcagcgcggcccgcccggcagccgtcgccccaccccgcccgaaaccggtcagccgccgcacgacgatccggtacgcgaccgcgaacaccaccatgcagaccgcgagcagcaacacgggccgcccgcggctcaggccgatcgcgagtttcgcggcccccgtgcccagtacgatcagcacgatcgcgcgcgcggccaggcgcgacgcgcgcatctcgccgggtgcccacagccagccttgtgcgcgcattccgtcgacgacctcctgcgcatgcccggcgagtcgcttgcgaaacacgtcgtagctcacggtgccggacggctgctccttgagccacgcgcagtggtcgtcatggcgccccgcacgttccacgtcggcgatctgcacgtagccaccctgcccggggcggtccacaggtcgaccgcgcccgcctgcgcgagcgacatcgtcacgacctgggcgacccgtgcctcgccgccggtgagataggcgacttcgtcggtgctcaggtcggccgacgccttgcgcgtatgcccgccccagcgtcgacagcggaactcgatcgcctgaagcacgacgatcaacaacaacgcgacgacgcacgccggcacatagaacgcgagaaactgcggccccgcgtagttcagcacgttgaagtcctgcgccgatgcgcaggtcgcggcgacgctcgcggcggcagccggccaggcgagtttcggcagccggtcgcgccaggtcctgcgcgccggcacggcggccggcgaattcgcgcccccgccccgttcgcggccgacggtttcgggcgcggcgatccggatgcggcacgcaggccggcaggccgcggccagatcgactccggcggctcgcagccgaacagccggcgatagctgtccagcgtgtcgcgataacgctgcgcgtacacggcggcctcgtccggcgcgcccgtgccgggcatgtgatgcagccgcgcgcgcagcacgccggcgcagaagacgtcccagtattcgagcgtgtattgcaggtggaaatgccacgcggcatcgaccgcgaccgacggcgtgaccgggtgtccggccgcctgcgcgaggaacgcgaagcgcttgtattcgtcgatcacggccagcgcgtgcgcatgcgaccagccttcggcttcggcaagacgccggctgtacggcagcggcgcgttcgggtcgtcagggaatacgcgtgcagacgcgcgagcagcgcgtgctgcgcatcggtcagcgcgcgggcatcgactgcggtcgagttagacggaatggcagccatcgggagtcggcgcgatgcgcggacggccgccgcgatcgacgcttggagttgtcgttgcggggattctcgcacatcggcgaggcggcgcgacggcgtgccgggcctgcatgcagggccgcttgcggcgctgcgccgcgggtcagaaagtcagaaatcgagctgcgcgatcgtgatgtcgagcgcggccgcaaccttcttgcgcatcgactcgcgcagcttctcgcgcttttcctgtttggcgtagtccgagcgactgatgccgatccgccgcgcgacctcggcccgcgtcaggccgagatgctcgcgccacgcgcgcgcgggcgagcttccgtcgaacacgacgcgcgtcacgagctcgtgcggaatcaggtcgcgtgcggcgcaccgctgcgcgacatagtccgcgtacgggatcacgacgaaggctggcgcgccgtccgggccgttgatgatctggactgggagggatttgctcatgcggtgatcgcggcgccggtttccgggcggctgttcctcgtttcggtcgacatgttcaatcggcgtttcaggccggcttcgggtgcgtcgaacgacatcggtgcaaggtttcgcccggtcggatgcacgcgatcggaaaccgccatgctgatagccggccggaatattactgcaagcggggaaatggtgatgcggatgagacggcgaaaccgccgagcgcctgaacaggcatgttttggcgcgcccggctgggatcgaaccagcaacccctgccttcggagggcagtactctatccattgagctacgggcgcgtgagacagtgaaacgaccccaatatacaggccgcccacgattggcaagacggcaaggatacccggtttcccatgacgcgtccaccttgcccgacgaatccccgccgcaccgcgctgcgtgcgggtaaacacgcgccatcgcgccgctcgccgtgatgtaaacgttccgtctataatcgtccgtgcttcattggactgccattttgccgttgcaccgcgctcacaattcctattcacggagacgaggcaagcatgagcgaagcaccccacgaatctcccgtcaaaaccccgggcagctgattgccgttatcatcgcgtcgttcgcgattccgatcatcctgatcgtcctgttcgccaattatgcgaaccatgcgttccgcgccggcgccggcacggacgcgctatccgacgagcaggtcgccgcgcgtatcgccccgctcgcgcaggtcgaagtgaaggacgccaacgcgccccgcacgtacaagaccggcgaggcagtctacaaggccgtctgcgtgacctgccacggcacgggcgccgccggcgcgccgaaattcggcaacaaggacgactgggcgccgcgcatctcgcaaggcttcgacacgctgctgaagacggcgctggccggcaagggcgcgatgccgcgcgcggcggcacgagccccgacgacgtcagcgactatgaaatcgcccgcgcgatcgtctacatggcgaacaacgacggcgcgaacttcccgaaccggcagcaccggccgccaacgcggcgcagcccgccagcggcgcggcaggcgcatcgggcccggccgacgccgcgagcgcgcagatcgccgccgcgcaggccgcgatcgccgcgatcccgaaggccggcgaacaaccggcggccgccccggccagcgccgatgccgcaaccgccggcaaggcactgtactcgtcgacctgcgtggcctgccacggagcaggcgtgctcggcgcgccgaagttcggcagcaaggaagactgggcgccgcgcctgaaggactcgatggacacggtctacaactacgcgctgcacggcaagggcgcgatgccgccgaagggcgggtcgaacgcatccgacgccgacgtgaaggccgccgtcgactacatggtcaactcggcgaagtaacaccggccggccagaaaaccccgcggcgcacgcgcaccgcggggtttgtttttgcctgaccggctgaccggctgaccggctgactgtcggatcgtcggttagtcgcgacaccgcacgcccgacggcgccgccgcttcacttctgcagcaacgccttcaggctggcgagccggtccttcggcgacatcggcgcctcttccggggtaggcggcggcgcatcgtcgagccccatctccggaatgaagcgcgacggctcgcacacgaccgtctcgcgcgcccgcttgcgcttcttgcaccagttcaggtgcaggctgcgctgcgcacgcgtgatcgcgacgtacatcagccggcgctcttcctcgatccgctcgttgtcgatcgggccgtcgtcctcgctgccgccgcggtgcggcatgatgccttcctcgacgccgaccaggaacacgtgcggatactgagccccttcgatgcatggacggtcgacagccgcacggcgtccggatcctcgtccttgccctcgagcatcgacatcagcgcgacggtctggatcaggccgagcaggttcttgccggtatcggcgagcccgtcggcgttgtggaagccttcggcctcgccgtcgacagcctccgtctcgggcttggtgcccttgcgcttcagccattcgaggaattcgagcacgttctgccacttcgactgcgcctggcgctcgtcgaacgcgtcgtacaggtacgcctcgtaatggatcgcctccatcatgtcatcgagcacgacggtcgcgggctccttgtccgcgcgctcggtcaggcgctggatgaagtcgcagaacatccgcagcggctcgacctggcgcgccgacagccgcgcctcgatgccgcccatgtacaccgcttcgaacaacgacaccttcgcctggcccgcgaacgagccgagcgcctcgagcgtcgtgttgccgatccgcggcgcggcgtcgtgaccgcgcggatgaacgcgggatcgtcgtcggcgttcgcgatcagccgcaggtacgcgcacaggtccttgatctcggccttgtcgaagaacgactggccgcccgacagcacgtacggaatgcgttcgcgccgcagcacctgctcgaagatgcgcgcctggaagttgccgcgatacaggatcgcgtagtcgcggaactgcgcgcgccgctcgaacttgtgcgcggacagccggaacacgaccgattcggcttcatgctcctcgtcgttgcacggcgtgacggtgatcgaatcgcccatcccgtgctcggaccacagcttcttctcgaacagtttcgggttgttcgcgatcacgttgttcgcggcggtgaggatgcgcaccgtcgaccggtagttctgctcgagcttgaccaggtgcagcttcggaaaatccttgccgagctgcgcgaggttctcgagcgtcgcaccgcgccagccgtagatcgcctggtcgtcgtcgccgaccgccgtgaacgcggcgcgcgggcccgcgagcaacttcagcagttcgtactggcacgcgttggtgtcctggtactcgtcgatcagcaggtagcgcagcttgttctgccagcggtcgcgcacctgctcgttcttcgcgaacagctcggccggcaggcggatcaggtcgtcgaagtcgaccgcctggtacgcgtgcagcgtcgcgacgtagttgcggtagaccagcgcggcctgatgctcgtcctcgttggccgcgatcgccatcgcctcgtcgggcatgatcaggccgttcttccacagcgagatgatgctctggatcttgcggatcagccccttgtcggtcgtgccgagctgctcctggatcatcccgaagcagtcgtccgaatccatgatcgagaactgcggcttcaggccgacgtgctcggcctcctggcgcaggatctgcacgccgagcgagtggaacgtgcagacggtgagctggttgacgggcaccttgcgcccttccttgccgggcgtggtgagcgtcttgccctcgagcagcttcccacgcgctcgcgcatttcggcggccgccttgttcgtgaacgtgacggccgcgatgtggcgcggctcgaagcctttcgcttcgatcaggtgcgcgatcttctgcgtgatcacgcgggtcttgccgctgcccgcgccggcgagcacgagacagggaccgtcgaggtagcgcaccgcttcgttctgggcgggattgaggcctgcggacatgatggcggatggtgttgcggttgacggcggaacgccgggaggatgccgtgcgcggcgggccggcgaagcaggcggacacgcggggcaggacgcgcatgttaacacgtcggcggcgcgcttttcgggagcgccgccggacggggccgcgcgggcggattccgccgccgccccttgtccgtgcggccaatccggccccgttcgcgcagcgatcggccacaatatctccacccggcgccgccccgcgcccaaccgcctgaatcgcctgaatcgcctgaaccacctgaaccgcctgaaccgcctgaaccgcctgaatcgccaccggatcgacatcatgggatacccgttcgccaccgccgcccttggcccgctgctgttcgcgcaggggcgctacgtgcgccgcgtcacgccgcgcctgcccgaggcggccggcccgcgcgacggagtagcgggcgacggcccgccgctgcgcgtgctggtggtcggcgattcggccgctgcgggcgtcggcgtcgcgacgcagcgcgacgcgctgtccgggcagctggcgaacgcgctcgcggccacgcaccgcgtgcactggaagctgctcgcgcgcacgggcctgaccacgcgggagctcgtcgactggctcgccgccgaaccggccgagccgttcgacgtggccgtcacgtcgctcggcgtcaacgacgtgacgggcggcgtgccgccggcccgctggcaggcgcagcaggccgagctcgtccggctgctcgccacgcgcttccgggtcggccacgcgatcctgtcggcggtgccgccgatggagcgctttccggcgctgccgcagccgctcgcgtggtatctcgggttgcgcgcgaaacggctcaatacggcgctcgccggctgggccgccacgcagccgcactgcacgttcctgcgcgtcgagctgccgctcgagcgccacctgatggccgccgacggcttccaccccggtgccgccgcctgcacggtgtgggccacgcaagtcgccgccgccgtgctgcgccgggcggccgcatgacgtgccacgacgccccggcaccggcctttcaccgcgcgggccggcacgcaaaacccgcacggtcggcacacgggcccgagcaaaatgccggctttccttgcgcaagtgccgcatcgcaccgcgcgtgtcgcccgaacgccccggtacgagcggcggcgccatgccaaaatagccggtcgtcttcgcgccgtctcggcgcaccatccttagtttccttcgcagccagggattgccatgtcgtcattgctcaggattggtttgatgggtttcggtttcgccggcgcgacgttccacgcgccggtcatcgccacgagcggccgcactgaagtcgccgcgatcgcgacgggcagcccgatcgcgcgcaggccgcgtatccgggcgcgcgcgtcgtccccgatctcgacacgctgctcggcctcgacgacatcgaatgcgtggtgatcgccacgccgaacgacacgcacttcgcgctcgcgcgccaggtgctcgaagccggccgccacgtggtcgtcgacaagcccgtcacgctcaccgccgacgaggcgcttgcgctcgcgcggctcgcgaacgcgcgcagccggctgttcgcgccgttccacaaccgccgctgggacggcgatttcctcaccgtgcgccgcatcgtcgaatcgggcgagctcggccggctcacgtatttcgcgtcgcacttcgaccgcttccgcccgacgccgcgcacgcgctggcgtgaggagcccgcccgcggcggcggcctgctgctcgacctcggcccgcacctgatcgaccaggcgctcgcgctgttcggcctgcccgaaacggtgggcgcaaccgtcaagacccgtcgcgacaacggtacggcgcccgatttcgtgcacctgcagctcggttatccgaacaaggaagtggcgctgcatgcgagcgcgctgtcggcgatcgaacccgcgcgcttcacgctgcacggcacacgcggcagctaccagaagttcgggctcgacacgcaggaagaccagctcaaggcaggcctcaccgcggacgacgtcgaattcggcggcggcaacccgccgggcctgctgcgcgtgctcgacggcgaggtcgaagtcgaacgcccggtgccaacactcgacggccagtacgcggagttctaccgcgcgctcgccgcgtcgatccgcgacggcgcgccgttccccgtcaccacgcaggatgccgtcgacgtgatgacgatcatcgagctcgccgcgcagagcgagcacgacggccgccggctgccgttcgtgcgccgcacgatctgacaccgcgcgccggccggtcgcggccggccggcatacgcgcggccggcccggcggattcgattacaggaacattcggttacaaatgccggggaacgaaagtcagcgtccgaccggtctgacgcgtttctcgaaaaagtcgatccgacaccaatccgtctggagaatgttgatgcaacggttgattcgcgcagcagcgtgctgcgtcctggtttcctcgcttgcggcctgtatcgtgcagccgcagcagccggttcgcccggccctccgccgcggccgaatccgcaggtcgtcgcgaacgagcggatgcagcagatccagggccggatcgacaatctgcaccgccgcatcgatgcgcgcgtgaacggcggctactacccgccgccgtacggcgcgcagcttcaccaccgcctcgacgtgatccgccaggaagcgaacgacatgtccgcgcagcacagcggcggcctgtccggcgacgagcagcgcgtgctgaaccaggaactcgacacggccgcgcgcgcgatcggcgagtaacgcaccggcgcccgccggcgcggaaagcggcggcaccggttgccgccgcttgtcgcgaagcgacattctttgctcaaattgacaaggcccacctgctcgcgtacagtcgcccgcacgcgtcgggagagcgtgtgaccgtgctgttccagccggttgcgccgccgaaggggcacacccgcaaactctcaggcaaaggaccgaccgcgtcggggaacctcgtccgtgcatcgcgcgggccacacactcccgcactctggagagcggcagtagcccgcagcgcctaggctgcgcgggcaggctgcccaccgaagggcgcgcgttcgccaggcctggccggcagcgcaatctctcaggtatcgaggacagaggggcatgtaccggatcgctcgcaggccgtcggccgcggtggtcggcacatggccgttctgatccgcgcgcaagcgccttgcctgaggcctcgatgactgcactgaatcacaccccgctcaacgccgcgcaccgcgcgctcaatgcccgcatggtcgacttcggcggctgggacatgcccgtcaactacggctcgcagatcgaagaacatgaagccgtgcgcaccgacgccggcatgttcgacgtgtcgcacatgtgcgtcgtcgatttcaccggcagccgcgtgcgcgcgttcttcgagcacgcgatcgcgaacaacgtcggcaagctcaagacgcccggcaaggcactctactcgtgcctgctcaatccgcagggcggcgtcatcgacgacctgatcgtctactacttcaccgaagaattcttccgcgtcgtcgtcaacgccggcacggccgagaaagacatcgcgtggttcaaccagctgaacgagcaaggcggctacggcgtcacgatcgcgccgcgccgcgatttcgcgatcatcgccgtacagggcccgaacgcccgcgaaaaggcctgggcgaccgtgcccgccgcgcgtgccgcgacgagcgagctgaagccgttcaacgccgcgcaggtcgccggcacgccgttcggcgatctcaccgtcgcacgcaccggctataccggcgaagacggcttcgaagtgatcatcccggccgtgcacgtcgaagcgctgtggaacgcgctgcagcagaacggcgtgcgcccgtgcgggctcggcgcgcgcgacacgctgcgcctcgaggccggcatgaacctgtacggccaggacatggacgacaccgtctccccgctcgacgcgggcctcgcgtggacggtcgacctcggcgcgccgcgcgacttcgtcggccgcgccgcccttgaagcaaacggcacccgcgccgcgttcgtcggcctgatcctgcagaaggaaaacggcaaggcgggcggcgtgctgcgcgcgcaccagaaggtcgtcacgccgcacggcgaaggcgagatcacgagcggcacgttctcgccgtcgatgcaggaatcgatcgcgttcgcgcgcgtgccggcggccgtccagatcggcgacgtggtccaggtgcaaattcgagacaagaatcttcccgcgcgcgtggtaaaactgccgttcgtgcgcaacggcaaggtcctcgctgcgtaacggccgggaggcccgcctcccgggaagccgggagatggcgcctggcgcaacaccacacccggcgcgccccggcggcgcgccagcaaaacgaacaaacccttttatcaggagcatccgatgagcaacgtcccggccgatctgaagtacaccgacgaacacgagtggatccgcactgaagccgacggcacgctgacggtcggcatcaccgatcacgcgcagaacacgctcggcgacatcgttttcctcgaactgccggccgtcggcaagcaggtgaaggcgggcgacgcgatcggcgtcgtcgaatcggtgaaagccgcgtcggacatctattcgccggtgtcgggcgaggtggtcgcgatcaacgcggacgccgtcgacacgccggaagaagtgaacagcgacgcgtacgacacgtggctgttcaagatcaagctcgccgacggcgcatcgaccgacggcctgctcgacgccgccgcctacagcaagctgatcgactaattcccttacccgaaccgcgcgacgccggccgccggccggcccgcgcgggaccagagtcacgccatgaagctcgaacacccggaccgcctgatgaaccgcacgccctctcgctcgccgcgctcgaaacgcacgacgcgttcgccgaacgccacatcggccccgacgccgccagccagcaggccatgctcgacacgctcggcttcgcgtcgcgcgccgccctgatcgacgccgtgatcccggcctcgatccgccgcgccgaaacgctgccgctcggcccgttcgcgcagccgaagagcgaggcggaagccctcgccgcgctgcgggttctcgcgaacaagaaccaggtgttccgctcgtatatcggtcagggttaccacgacacgcacacgccggccgtgatcctgcgcaacgtgctcgaaaacccggcgtggtacacggcctacacgccgtaccagcccgaaatttcccagggccgcctcgaggcgctcctgaacttccagcagatggtcgccgacctgacgggcctcgcgatctcgaacgcgtcgctgctcgatgaagccaccgccgccgccgaagcgatgacgctgctgcaacgcaccggcaagccggcgtcgaacgtgttctacgtcgccgacgacgtgctgccgcaaaccctcgaagtgatccgcacgcgcgcgctgccggtcggcatcgaggtcaagacgggcccggccgccgacgcggcgcaggcgaatgcgttcggcgtgctgctgcaatacccgggcgtgaacggcgacgtgcgcgactaccgcgcgctcaccgaagcgatccacgcggccggcggccacgtggtcgtcgcggccgacctgctcgcgctgaccgtgctgacgccgcccggcgactggggcgcggacgtcgcgatcggcaacacgcagcgcttcggcgtgccgatgggcttcggcggcccgcacgccgcgtatctcgcggtgcgtgacgaattcaagcgccagatgccgggccgcctcgtcggcgtgacggtcgacgcgcagggcaagcccgcgctgcgcctcgcgctgcagacgcgcgaacagcacatccgccgcgagaaggcgacgtcgaacgtgtgtaccgcgcaggcgctgctcgcgatcatggccagcatgtacgcggtctaccacggcccgcacggcctgaagacgatcgcgctgcgcgtgaaccgcatcgcggccctcttcgccgccggcgtgaagcagctcggcttcacgacggtcaacgacacgttcttcgacacgctgacgatcgataccggcgcgcgcaccgcgcaggtccacgaactcgcgaaggccaagcgcatcaacctgcgccgcgtgagcgacacgcaagtcggcgtgtcggtcgacgaaacgacgacgcgcgacgacctcgccgatctcctcgccgtgttcgcacaggccgcgggcggcaccgccccggccgtcgatgccctcgacgcgggccttgccggcgttgccgcgctgccggccggcctcgagcgcacgagcgcgtacctgacgcaccacgtgttcaatcgccaccattccgaaaccgaaatgctgcgctacctgcgcagcctgtcggacaaggatctcgcgctcgaccgctcgatgatcccgctcggctcgtgcacgatgaagctgaacgcgacgtcggaaatgctgccggtcacgtggcccgaattcggcggcatccatccgttcgcgccggccgagcagaccgtcggctaccgcgagatgatcgaccagctcgagcagatgctcgtcgcggccaccggctacgcggccgtgtcgctgcagccgaacgccggctcgcagggcgagtacgcgggcctgctgatcatccacgcttaccacgcatcgcgcggcgaagcgcaccgcgacgtgtgcctgatcccggcgtccgcgcacggcacgaacccggcgtccgcgcacatggccggcatgaaggtcgtggtcgtcgcctgcgacgcgcagggcaacgtcgacatcgccgatctcaaggccaaggccgacgagcacgcgaaggacctcgcggcgatcatgatcacgtatccgtcgacgcacggcgtgttcgagcagaacgtccgcgagatctgcgagatcgtgcatgcgcacggcggccaggtgtacgtcgacggcgcgaacatgaacgcgatggtcggcctgaccgcgccgggccagttcggcggcgacgtgtcgcacctgaacctgcacaagaccttctgcatcccgcacggcggcggcggcccgggcgtcggcccggtcgcggtcggcgcgcacctcgcgaagttcctgccgaaccagcattcgaccggctactcgcgcgacgaaaacggcatcggcgcggtgtcggccgcgccgtacggctcggcgtcgatcctgccgatctcgtggatgtacatcgcgatgatgggcgcgaagaacctgaccgccgcgacggaaaccgcgatcctcaacgcgaactacatcgcgaagcgcctcgcgccgcactacccggtgctgtattcgggcccgggcgggctggtggcgcacgagtgcattctcgacctgcgcccgatcaaggaatcgagcggcatcaccgtcgacgacgtcgcgaagcgcctgatggattacggcttccacgcgccgacgatgagcttcccggtgccgggcacgctgatggtcgagccgaccgaatcggaatcgcaggaggaactcgaccgcttcatcgccgcgatgatcgcgatccgcgaggaaatacgtgcggtcgaggaaggccgcgccgaccgcgaggacaacccgctgcgtcacgccccgcacacggcggccgtcgtcaccgcgaacgaatggccgcacgcgtactcgcgcgagcaggccgcgtacccggtcgcgtcgctcggcacgaacaagtactggccgccggtcggccgcgcggacaacgtctacggcgaccgcaacctgttctgctcgtgcgtgccgatgtcggaatacgcataacgcacacgaggccaggagccgtccgatggtgcccgcaccgcacgcaacccggggttgcgtgcggttttgttcgccgctcgaacccgtgcacgttcgtgcgccaatccagctaacatcacacgcgatccagccaatgaaggagttccgcatggtgcgtccgatgtttccgggccatggtgcactgcaagggcggccgcgcgcgcgccgcttcgtgccgatgttcgtcgcgtcgctgtcgttggccgctgccggcctcggcgcgtgcggcagcgcgcgcgcgcgatgaatttctgcgcggcgccggccctgcaggcaagcgaaacgacgcaggccgagccgggcgtccaggcgctgatccgcagcgtcgacgcgcgcatcggcgagcagccgaaggcgatggcgcgcgtgcacaccgagggcacgctgccgcacgaaggcatctacgaccagagcgccgccgcgctgaaggatctcgacctgatgcgcgatgccgcgctcgcgtggcgcgtgacgaacgcgccgcgctacctgcagctcgtcgaccgcttcctgtccgcgtgggtcggcacctaccagccgagcttcaacccgatcgacgagacgcgtttcgacagcctgatcgtcgcgtacgacatgaccgcaagcgcgctgccggtgaagacccgcaacgcgaccgcggcgttcatcgcgaagctcggcgccggttatgtcgcgcagatcgacgcgcagaagcgcccgctcaccggcacctggcgcaacaactggcagagccaccggatcaagctgatcgcgctgtccgcgttcacgctcggcgaccgcaggatgatgaacgccgcgcagcggctgttcgtcgagcatctggccgacaatatcggcccggacggcaagacgtgggacttcgaggagcgcgatgcgctgcactacgcggtctacgacctgcagccgctggtgacggccgcactcgccgcgcgccgcttcaaccgcaactggctgcgcgagcgcggcacgaacggtgcgaccctggaggccgcgctcgactggctcgtgccgtacgcgctcggcgagaaaacgcacgaggaattcgtgaattcgccggtgccgttcgacgcgaagcgccgcgaagccggcctgccgggctacacggggcagtgggacccgaaaaacgccaccgaactctttcatctggccgcgcggctcgacgggcgttatgcccgcgtcgcgcagcaactttccccaacgccgcccgcatggctcgccgcgtgcctgccattgcaggcgcgctagcactactcttaaagcaaggcaggaatcgaaatggcagtcagcgtctttgacctcttcaagatcggtatcggtccgtccagttcgcatacggtcgggccgatgcgcgcggcgctgatgttcgtccagggcctcgagcgcgacgggatgctcgacgcgaccgcccacgtgaaggtcgagctgtacggctcgctcggcgccaccggcaagggccacggcaccgaccgcggcgtgatgctcggcctgctcggcgacgcgcccgacaccgtcgatcccgacacgatcgacgcgcggctggaagacgtccgccagtcgaagaagctcgcgctgctcggcacgcacccggtgccgttcgtgctgaaggagaacatcgcgttctaccgtcaggcgctgcccgagcatccgaacgggatgaagctgcgcgcgagcgacgcgaacggcgcggtgctggtcgagcgcacctacctgtcggtcggcggcggcttcgtcgtgacggccggcgcgccgaacacgaaggtgctgagcgcggccgagcagatgacgcacccattccgcaccggcgccgagctgctcgcgctgaccgagtcgaccggcaagtcgatcgcgcagctgatgtgggaaaacgagcgcgcgtggcacaccgaggaagagacgcgcgacggcctgctgaagatctgggcggtaatgcagtcgtgcgtgtcgcgcggctgcggaatcggcaacccggatgccgacggcaacctgcccggcccgttccaggtcaagcgccgcgcgccgcagctgtaccgcacgctgacgggcagcccggagcgtgcgctgcaggatccgctgtcgatgatcgactggatcaacctgtacgcgatcgcggtcaacgaggaaaacgcggccggcgggcgcgtcgtgaccgcgccgaccaacggcgcggccggcatcatccccgccgtgctgcactactacacgcgcttcacgccgggcgcgaacgagcagggcgtgatcgacttcctgctcaccgccgccgcgatcggcattctctacaagctgaatgcgtcgatctccggcgcggaagtcggctgccagggcgaagtgggcgtcgcgtgctcgatggccgcgggcgcgctcgccgccgtgctcggcggcacgccgcagcaggtcgagaacgcggccgagatcgggatggagcacaacctcggcctcacctgcgacccggtcggcgggatggtgcagattccctgcatcgagcgcaacgcgatggcgtcggtgaaggcggtcaacgcggcgcgcatggcgttgcgcggcgacggctcgcactacgtgtcgctcgattcggtgatcaagacgatgcgcgagaccggtgccgacatgaagacgaagtacaaggaaacgtcgcgcggcgggctcgcggtgaatatcgtcgagtgctgatgccggttcggcggtcatgcggggcggatcgatgtcccgcctgaccgccgggctcgatgcccgacatcaatcgttcagccagttctccagccgcaatcccggatagctgacgaaatcctgctcgttgttggtcacgagcgcaacgtcgagcgacaccgcgtgcgcggcgatcagcttgtcgagatgatccctcttccgctcgcgggttgcgtcgcggaccggaccgtacgcttgcgccgccgcgacgtcgaacggagcaacggggatatcgtcgatcagcgcggcgagatggcgacgctcccgcgcaggattcgcacatgcggcgacgccgtactcgagctcggcatacgtgatcgccgacatcaccacatccccgtgtagcactgtgcaaatcgtttcgcgacttgctcgggctggttcttcaccagatagatgcacatgttggtgtcgagcatgtagcgcggcattacagctcctcgcgatcggcctgctcctggtcgccgcgcccttcggccatgaaatccggcccgaatttcgcgaacttctcgagtacgcgggtcaacggccgccgcatcggtcgaatacggatttcgtcaccgatacgctcgatttccagttcgatatcgttacgctcataggcgaggtcggcaggaattcgcacggcctgcgagttgccgttccgaaataccttcgtcgtgtgcatgtcgatctccgcacggatgtacatgggatgtacattatccgatgcggtctgcgatgtaaatccatgtgtgtacataacatgcgttcccgtgaaatccttcatccgctgctcgacgccgacttgcggatatcgggcatcacggccactgccgtcgcgcatgcagcacgcggaggatctcgacgatcccctcagccggtctgatgcgatacacgagcacgtagttcggcgcgaccaccagttcgcgcgtgccggccactcgcccttgccgatacagctctgcacgggccggcaacgtggcggccctttgttccagcagttcgtcgagttcgattgcggcctgcgggtcgtcctcgccgatgtagtccatgatcgcggcgcgatcctcgtacgccttcggattccagtgcagcgcgagggtcaagaagcatcccctcgcctgcccgcgagccgttcacgcagtgccgcacggcgcgacgcgaagtcggcgctcacctccgcgtcgggaatcgacgcgcgcggatcgtccagcgcctgctgcacctgctcgcgaaaccagcgatcgtgggccgctgcctcgtgtgccgccttcagcgcagctgcgcgatcgggccgggtcacgcggcaggccgcatccgggtcgaacgtggacgcgtccacatcgaaccggctgatgccgatgtcgcgcagaaagccgaccagcgtttcaaagcggcgaaacacccgcacgtcgccgcgtttcgccgacaggaaacgttcgtgcgcaccgcaacgggcggaaagtgcccaaccgttgccgcaccccaccacgcgggccgcgcttacggcgccggctttgacaagctccgtcagcatcttttgatcgatcgtttcggttgtcatggcgatcctcgatccctttatccatccgttcgttgaaattttactattgcctggctgcccattttattgttaatcggcgcccactttcagcggacaaacaggtattgggtccagcttcgcatccatggcaatcacttttcaccttcgcgcacgccgacacaagccggccgttcggccacccgaagccacgacgcgcgccgcaaaccgccccgcgttccgacacttttctccggccgccgtaccggcaccccgccgacaggcgtaagctgtacgtcccgctacccaggagacggcagcccatgtcgcattccaaggatctcgagcagcccgccaccaccggcgcgcgactgctcgtcgatgcgttgctcgccaatcacgtcgaacgcgtgttctgcgtgcccggcgagagtttcctcgccgtactcgatgcgctggcggacgacaccgcgcgcatccagacggtcgtctgccgccacgaggcggccgccgcgaacatggccgaggcggtcggcaagctgaccggccgccccggcatcgcgttcgtcacacgcgggcccggcgcgacccatgcgtcgatcggcgtgcacaccgcgttccaggattcgacgccgatgatcctgttcgtcggccagtgcgcgcgcgagcacctcgaccgcgaagccttccaggaaatcgactaccggcggatgttcggccagatggcgaaatgggtcgcgcagatcgacgatccgcgccgcattcccgagtacctgagccatgcgttccacgtcgcgaccgccggccggcccggcccggtcgtgctcgcgctgccggaggacgtactgtccgaagcctgcgcgccgcagcccgtcgtgccggccgcgaaacgcgtcgcggccgcgccgtcggccgcgcagctcgacgagctgcgcgagcggctcgcgcgcgccgaacgtccgttcgcgatcgtcggcggcagcggctggacgcccgacgcgtgcgcgaacctgcgcaccttcgtcgagcgctggcagttgccggtggcctgcgcgttccgctaccaggacacgatcgacaacgcgcacccgaactatgcgggcgacgtcgggctcgggatcaaccccgcgctcgcgaagcgcatccgcgacgccgacctgctgctcgtgatcgggccgcgcctcggcgaagcgacgaccggcggctacacgctgctcgacatcccgaagacacgccagacgctcgttcacgtgcaccagggcgcggacgagctcggccgcgtgtatgcggccgacctgccgatcgtgtccgggatgcccgaaatcgccgcgccgctcgccgcgctcgagccgcccgagcaccccgcgtgggccggcagcgccgccgacgcgcatcgcgcgtatcgcgaatggcatgcgccgctgccgatgcccggcgacgtccagctcggcgacgtgatggtgcagttgcgcgagcgcctgccgcacgacgcgatcctcaccaacggcgcgggcaactatgcgatctggctgcatcgccacttcgcgtaccggcacttccgctcgcagctcgcgccgacgagcggcgcgatgggctacgggctaccggccgcgctcgccgcgaagtcgctgtacccgtcgcgcgccgtcgtcgcgctcgcgggagacggctgtttcatgatggccggcaacgagctcgcgaccgcgatgcagtacgggctgaacatcgtggcaatcgtcgtcaacaacgggcatttcggcacgatccgcatgcatcaggagcgcaactacccgggccgcgtgcacggcacggggctcacgaatcccgatttcgcagcctatgcgcgcgcattcggcgcacatggcgagaccgtcgagcgcaccgccgatttcgcgcccgcgctcgaacgcgcgctgacctgcggactgcccgcgctgatcgagatccgcatcccgcaggacgccagcacgccggccgcgaccctcgagcagatccgcgaacagggccgccgcgcgcgcggcggatgacggtgagcacgcacgccgcgccgcctgccggcgcgctgtcgcacgacgacgcgctcgcgctcccggcacgctgctcgcaccggacggcacgctcgtcgcgccctacgacctcgagcacagcgacgcgcgtgccgccggccacgtcgcggccgcgcccgcgcgcggcctgctgcacgcggcacaccggccgttccggctcgactatggccgcgcacggcaggtgcatgtgatcaacgggatgggggtcacgctcggcgattcggtgatcgggctcacggccctcgccgcgctgcgcgcagcgcacccgggcctgggcttcacgctgtaccggcctgcccgcgcgccgcgctacgtcgatgcgctgtatgcgctcgcggccgacatcgtcgcgccgtcgcgcgcgctgccgtaccccgccgacgcgctgccggcggacgcgccgtgcatcgacgtcggcaatcacctgtactggcccgcgttcgcgcggttgccgatgatcgatttcttcctcgacgcgctcggcgtggagcctgcctcggtgccggcgtcggccaggcgcaaccgctggctcgcgcggctgccgttgcccgcgttgcccgcgcaatggcagcgtccgtacgtgctgttctgtccgaacgcgagcaccgcgttgcgcagcgtgccgcctgccctccgggctacgttcgtcgaacagctggcccggcgctacggcttgccggtagccgggttcgggccggtcgcgcatcccgcgtatgtcgacgtgagcgccgatgcggcagacgatacggcccggttcatcgcatgggtcaagggcgccagcctgctgttcgcgcccgacacggccgcgctgcaccttgccgacggtttcgacgtgccgacgctcgcgtgcttcacgacgatcgggccggcgctgcgcgtgcgcgactatccgcattgcgtgccggtcgcgctcgacgtgccggccgaattgcgcgggctgcatcgcagcgagcggccggccgatctcgcggcggtcgaggccgcttaccgggcgatcgactgggacgcgctggcctggcccgcgccgcgcaaagccgcggcgaccgccgcacaggaaaaccggacgccagcatccgctgcgtggccgaaagcgcaatagcgtgcccgcgccgcctgagcctgagcctgagcctgagcctgagcctgagccggagccggagccggagcccgagcccgagcccgagcccgagcccgagtccgagtccgagcctgagccaggctcaccccgactgccgccccgcgctcaccccgccaccatcaccgcgcgatcgcgcagcgtctccgacggccgcttgccgaacagtcgccggtaatcggtcgcgaactggctgagatgccagaagccccacgcctccgcaacgtcctgcaccgaaccggccgcgcggccgcacaggtcgcgccgcgcgccgttcagccgcagcgtgcgcaggtaggtggcgggcgccatgccgagcacgtcctggaagcagtactgcagcgtgcgcctgctcacgtgcaactgctcgcacagttcgggcacgccgaccgggcgcgtgcgatgcgcaagcacgtagtcgcgcgcctgttcgacgatccagcggcgcatcgacggcgcgcggccggcaccgtcgtcggccggttgcgcgcacacgtcgaacagcgcggccagcacctcggcctgcaggtcgtcgcgctgcgcatcggccagcgggccggccatcgccaccgccccgtcgagccggcggccgagcagcgcgcacaggcgcgcgagccgcgcatcgccgacctgcatcacgcgctgcgtgaacagccgctcgtcgagtgcgcggtgttcgacctcctccgcataacggcgcagcacgtcgccgcgcacgacgatcccgtagatcgagaactgcgcgggcgtcaccagttcgaattcgacgttgccgggccggaacgcgagcgcgccgggcccgatgcggcacgcatcgacgcgcgcggtgccgtcgctcacgagcgggatgccgaaccagtacgcatcgccgcgcacctcgcatgcctggcgcagcaggtggctcgtcgattcccgaaacagtttcatcgtgtcgagcggcagctcggtcagcgtgccgacgaaacggccggccgcgagctggtcgtaggtctgccgccagccgatcaggttgcgcgcctgctcgtcggcgtcgtgcgcgacgctgacgaccgcctgcccggccagcgcatcgtcgccctgcgcgttgcgccgcgtgtcttcggccgtcggttcttcgctatacgccacgtgttggtccatcgtgtcctccctcacctgcccggaaccgcgtctgtcacgcaagtcccgtgccgaaccgcgcggttcggcgcacggcccgtcattccacgttgcccggccgttgcgcgccatccgggcgcacccgaaggcggcgtgccgcgcacgccgccggtgcgatccgcgcgacgaccgcgcatctcgaccgccgccggccaccgaatcccggctaccaggccggcttcagccggacgacccgcgtgccgcaattgccatacgcctgcgcgaccgccagctcgacgatcgcgcttccggccggccagggcgccgcgtcggcttcgggcaaatcggcgcgcagcgtcgcgcgaccgttgatccggtagcggatgccgcgcacgaagtcgacgaacagcaacccgacgccgctgccgtcgcatgccgccgcatcgatccggcccccggcgccgggggcggccggcaacgcgaaccgcagcgtcttcgtgtcgatcacgcggacgaccggcagcagatcgccgttcgcatcgcgcatgcccggcacgatgtcgcagctcacggatgtgcgcgagccgcctgcggtggcgacgaacatgaacggctgagattcgacgaactgccgcacgccgatgctcacgcgtgtcgtcaccacgtcgctcatccgctcggcttcgtcggccacgccgaagcggtgctgcgcgtcgagttcgcccgcgtggaacacggggtgacgcggaaaggatcggggcagttctgccatgctggttttcgttacacgcatcggcgcgccgtgccgcagcgacgacacgacggccggtatcgtttccggcgccggccgcgacgatgctcggccggcgccggggtcggatgtcgaagtcgaaaatggcgaagtgccgggtggccgggtggccggatgggccgacggccaccagccgatagccggtagccgccggcatcgcacccgcatgtgcaacgcccgacggacgggcaaacgtcacccggctatcgaacgttgaacgcagcccgcgcgccccaccaacgaaccccggcgatcgtcccggccggcgctaccctgccggccgatcccggcgccccgccactgcgtcgacgccccgggtcagaagaacccgagcgcctcggcctggtagctgaccagcaggcacttcgtctgctgatagttcgacagcgccatcttgtgcgtctcgcggccgatccccgactgcttgtagccgccgaacgccgcgtgcgcggggtacaggtggtagcagttggtccacacgcggccggcctcgacctcgcggcccatccggtacgcccgcgtgccgttgcgcgtccacacacccgcgccgagcccgtagaacgtgtcgttcgcgagttcgatcgcctcctgctcgtccttgaacgtcatcaccgacgcgaccggcccgaagatctcttcctggaacacgcgcatcttgttgttgccgagcagcatcgtcggcttcacgtagtagcccgtgtcgaggccggcggccggcgccgtgcgttcgccgcccgtcaggcattgcgcgccttcgccgcggccgatgtcgatgtacgacaggatcttgtcgagctgctgctgcgacgcctgcgcgccgatcatcgtctgcaggtcgagcgggtggccggccttgatgcgctcgacgcgcgcgaccgccttctcgatgaacttctcgtagatcgattcctggatcaggatccgcgacgggcacgtgcacacttcaccctggttcagcgcgaacatcgcgagcccttcgagtgccttgtcgaggaacgcgtcgtcctggtcgagcacgtcggcgaagaagatgttcgggctcttgccgcccagttcgaccgtcgacgggatcaggctgtcggccgccgcgcgcaggatgtgcttgccgaccggcgtcgagcccgtgaacgcgatcttcgcgatccgcttgctggtcgcgagcgcttcgcccgcttccttgccgaagccgttcacgatgttgatcgtgccggccgggaacaggtcgccgatcagctccatcagcacgagcaccgacgcgggcgtctgctcggccggcttcatcacgacgcagcagccggccgcgagcgccggcgcgagcttccatgcggccatcagcagcgggaagttccacgggatgatctggccgacgacaccgagcggctcgtggaagtggtatgcgacggtgttgtcgtcgatctcggagatgccgccttcctgcgcgcggatgcagcccgcgaagtagcggaagtggtcgatcgcgagcggcaggtcggccgccatcgtctcgcgcagcggcttgccgttgtctatcgtctcggccaccgccagcagcttcaggttcttttccatccggtcggcggcggcgagcagcaggttcgcgcgctcggccacggacgtcttgccccacttgcggcgcgcggcatgcgcggcgtcgagcgccagctcgatgtcgtcggcgcccgagcgcggaatgcggcagaacggctggccgttgatcggcgacacgttctcgaaatactcgcctttcaccggcggaacccacttgccgccgatgtagttgtcgtattgctgacggtacgggtattcgacgtcgaggcccagttgcttcaggtcaaacgggttcatacatgtctcctgttcatcgtgcttgtgtgcgtacagcgccggttggatcgcgctgcatccgtttacgcaacatgcgtgccaaaccggacggaagcacggcgaccacggccggcccgcgtgcgcaccgtgccgtgttcacccacgcagcacggcgggtgtacccattctgaacagcgcgattgcgcagcagccgggccggtgtgcgaaatttccacagtgcgcgggcgcgcgtgcgggcggacgccggccgcgacgcgtggcatgtcgcttgcgtgcgcatcgtgcattcccacgcaacggcgagtgcgccgaccgacaccatgagcgaccgcggcccctgaccgacgacgccatcgcgttcatccgcgagcaggcgttcctgatcgtcgcgaccgccgacgaaggcggcaacagcgactgctcgtaccgcggccgccagccgcgcgccgacggctcgttcgagccgctcgtcgacatccccgaccgccgcacgctcgtgctgcccgacttcgcgggcaacaacctgttcaacacgatcggcaacctgctcgtgaatccggccgtcgcgctgctgttcgtcgatttcgtgcgccagacgacctggctcgtgcagggccgcgcgacgatcgacgaggatgcgcaaggccgtgcccacctgtggccggacgcgcggcgttatgtggtggttgaagtggaacgggcgcaggcgcgcgcggatgcggcgctgccgccgctggtgctggcgtgattcacgggatgcactgaacgaatcgtcgacttgcgatgcaaacgacgatgaaacgacgcggcgctccggctgccgtggccgaagcgcccgtgcatggcgatacgccgctcaacgcccgtgcgtttccgtgcaggccgcatcgatccggctgcgcaccggcacgtcggcatgggcgtgcccgtcggtgccgtcgcccgcttccgcagccacccgccgcccgccgagaaacacgaacaccaccaccgcacacagcaccgtgacgaccgccagaccgatcagcaaccggtcgaatgcatgcgcgtaactcgcgagcagcgccgcctggccgacacccggcaatgcagccgccgcgcctgcgagatcgccggtcgcgagccgcgcggccgcacgcagcgtcgcctcgggcgtgccggcggcgcccgccgcctgtcgcagccccgtctgcgcgagtgcggccagtaccgcgccgacgatcgcgagcgcgatcccttcgccggccacgcgcgtcgtgctgaagatgcccgtcgccatccccgcgcgctccttcggcacgacgctcaccgacagcccgtccatcagcccccacggcatgccggccccgacgccgatcgcgagcatcggcgcgatcgccgccggccccgcgccgccgcgcagcgcgacgtccagccacacgagcccggccgccgcgatcagcagcccgagccccgagatcacgccggccgtcagccagcgcgtgagcgtcgccgcgaccagcggcacgaccagcatcggcgcggaaatcgcgagcatcagccagccggcgtcgatctcgctgaagccgtcgatgccgatgaagcgcagcggcagcacgacgagcagcacgatatagcagcagcaggtcgacaccggcagcacctgcacgccgacgaagcgcgcgatccggaacaacgacaggtcgagcatcggccgcgcgacccgcgtctcgatcgccacgaacgcgcaggcgccgagcgccgcgccggccagcagcgcgatcacgagcgcgttcgaccatccgcgtgcgggggcctcgatcacgccgaacgtgaacagcgtcagcgcggcggtgaacgcggccgtgccgggccagtcgagccccgtcgcgtgcgggtcgcgcgactcgtgcatgcgcggcagcccgaagccgagcgacagcccgccggccaccgcgctcgtcacgaaaatcgtgcgccagccgccgtgcccgatcagcgcgccggccagcacgggcccgaacgcgagcccgatgccgaaggtcgtgccgagcaggctgaatgcgcgcgtgcgcgccgcgccgtcaaactcctgcgcgagcgcggccgtgccgcccgcgagcgccgcggccgccgcgagcccctgcgcggcgcgcagcaggtcgaccgcgagcatcgacggcgcgaacgcgagcgcgaccgacatcagcgtgaaaccgccgacgccgatcgcgaacacgcgcttgcggccgaactggtcggccagcgcgcccgccgccatcaggcagctgccgaacgcgagcatgaacgcgttggtgatccagttcatcgcgaccgtgccgccgtgcaggtcgcggccgatcgcgggcgtcgcgaccgcgccgcccgaaaacgacaacggcagcgcgacggcggccatgcagacggcggccagcacccacgcgcgccggcgtgccgactgcgtcgatgcggctgaaaaaggctgatccatcatcgctcaaaaggccggcgcggatgcgccgtcagagcgacagaagataaatccgattcaatcgaagaaaaaccacgcgaagttccgcatataccggactagaattccgcaattcacttcaccacgcgcgtcgtcgagcgcgcttcgattcgatggaaaacctgtccggcatcgtcgcgttcgtccgcaccgccgaagcgctgagcttcgtcgcggccggccgcacgctcggcatctcggcgtcggcggtcggcaagacgatcgcgaaactcgaacagtcgctgggcgtgcgcctgttcaaccgcacgacccgccgcgtcacgctcaccgaagaggggcgccacttctacgaacgttgccagcggatcctcgaggatttccgcgacgcggaagcgaccgtgacggcgtcggcgcagcgcccgcgcggcaggctgcgcgtgagcctgccggtgatcggctaccggttcctgctgccggtgctgcccgagttccggcagcgctacccggacgtcgagctcgatctcgatttcaacgaccggatggtggatgtcgtcgaaggcggcttcgacgcggcgatccgcagcggcccgctgtccgattcgagcctgatgtcacggcggctcggcccgtttgcgttcgtgctgtgcgcgacgcccgcgtatctcgcgcgggccggcacgccgcgcatgccgcgcgatctcgaagcgcacgaatgcgtgcgctactgcttcccgaccaccggcaagctgcaggactgggcgctctcggccgccgacggcacgccgccgaagctgcgcaccgcgctgacctgcaacaacatggaagccctgcgcggcaccgtgctcgcggggctcggcatcggctacatgcccgacttcctcgcgcgcgacgcgctcgaacacggcgcgctcgtcaccgtgctcgacgactaccggatcgcgccggggcagttctcgatcgtgtggccgtcgagccggcagttgtcgccgaagctgcgcgtgttcgtcgattttctgtgcgagcggctgttcaggtagccgggtagcgggcgcctcgacagccgccctcgtgccgctcgtgccgctcgaacggcacgcaacccgcgatgcgggagcggcccgcgtgcgaccgttttcagtccgccccgatccgctccgcttccgcctgcggcaacagtgtgtcgctgtcgtccttcagcccgacgcccgtcaactgaagccggcgcgcatgcgtcatcaggtaatgcagcttgtgcgcggccgccgcgtacggcagcccttcgggccgcacgttcgagatgcagttgcgcagcgcgtcgtggcagccgaccttcggcgcccacgtcaggtacacgccgaggctgtccggcgagctgagccccggccgttcgccgatcagcatcgccacgaccttcgcgcgcagcagctcgccgatctcgtcgccgagggcgacgcgcgcctgcgtcgcgaccaccaccgggccgatccgccagccgtccgcgtcgagccgcggccgcacggcctgcagcagcggcagtgcctgcttcgcggccgcgaacgccgagagcccgtcgccgaccacgaacacgacatcgggcgcgtcgtcgagcgccgcgccgtaaccggcgagcagcccgcggctgtcgtccgacagcttgcggccgagatcgggccggcgcagatagtggtcacggtcgggcgcggcgctctgcacgccgagcgtcggcagcaggccggccgcctcgatctcgcgccgcagcgcgtccgagtcgagcggctggtgcaccgcatcgcgcgcctgcgcgtgcgacaggttgaaggccagcagcggcgcggtcggcaggctgttgcccgcgcggccgagcgcgatccgcgcgttcgtgaacgacttcagctggccccacggattcttttcgacggcgtcgctcatgccgaaatccccatccagtcgttcgcgcccgcgagcagcggcacgcgtgagctcgcggcgcgcaatgcaccgtgcgcgtcggcgatctccatcgtctccagccactcctcgaattccggcgcgcggcgcaggccgagcacctcgcgcacgtagagctggtcgtgaaacgacgtgctctggtagttcagcatcacgtcgtccgcgcccggaatccccatgatgaagttgatgccggccgcgcccagcagcgtcagcagcgtgtccatgtcgtcctggtcggcttccgcgtggttcgtgtagcagatgtcgcagcccatcggcacgccgagcagcttcccgcagaagtgatcctcgagccccgcgcggatgatctgcttgccgtcgtacaggtattcgggcccgatgaagccgaccaccgtgttcacgaggaacggctcgaacttgcgcgccaccgcatacgcgcgcacttcgcaggtctgctggtcgacgccgaaatgcgcgttcgccgacaacgcgctgccctggcccgtctcgaagtacatgagattgttgccgacggtgccgcgcttgagcgacagcgcggcctcgcgcgcctcgccgagcagcgcgagcgagatgccgaagctcgcgttcgccttctcggtgcccgcgatcgactggaacaccagatcgaccggcgcgcccttctcgaccgccgcgatcgtgttggtcacgtgcgtgagcacgcacgactgcgtcggcacgccgtagcgttcgcggaacccgtcgatcatcgcgagcagcttcacgatcgccgcgaggctgtcggtggccgggttgatgccgatcatcgcgtcgccgcagccgtacatcagcccgtcgagcatcgacgcggcgatccccttcacgtcgtcggtcgggtggttcggctgcagccgcaccgacatccggcccggcagcccgaccgtgttgcgaaagcgcgtgacgacgcggcgttttcgcgccgccgcgatcaggtcctggttgcgcatcagcttcgacacggcggcgaccatctcgggcgtgaggcccggcgcgatccgttcgagcgccgcgccgtcggcggcgggcgacagcagccagttgcggaagtcgccgacggtgaggtgcgagatttccgcgaacgccgccgcatcgtgatcgtcgaggatcaggcgcgtgacctcgtcgtgttcgtacggaatcaccgcctcgttcaggaacgccttcagcggcacgcccgcgagcgcgatcttcgcggccacgcgctcctcctcgctcgccgccgcgacaccggcgagctggtcgccggaacgcagcgggctcgccttcgcgagcagcgtcttcaggtccgcgaaacggtacgtgcgcgggccgatcgtctccgtataggacatcgtgcgagtctccttgccttgccaaagccgacggcgcgcccgttcgacggggcgcgccggatgccgtcaggaacggccgttcaccttcacctgctcactcctccagcagcgcgtcgcccggcgcgctcgcccgctgcgaacgcgtcgcgaggaagtacgcgtagccgaccgcgaggaagccgacgaacaccagcgcgaccagcccgttgaaatacaccatcgtaccgaggcagacgagcgccgccaggatcgcgaaggccgggaagatcgggtacagcggcgcgcggaacggccgcgccatgttcggctgcgtgcggcgcagcttgaacagcgacgccatgctcacgatatacatcacgatcgcgccgaataccgacatcgtcacgatattcgcggtcagcgtctgcccgccgaactggatcagctcgtcgctgtagatcgccgcgatgccgaccacgccgcccgcgagaatcgcgcggtgcggggtcttgaagcgcggatgcaccttgccgagccactccggcaggtagccttcgcgggccagcgcgaagatctggcgcgaataaccgaggatgatcccgtggaacgacgcgacgaggccgaacaggccgagccacacgagcatgtgcatccagccgctgttctcgccgacgatgtatttcatcgcctgcggcagcgggtcgttgatgttcgcgagcttggtccagtcgcccgcgccgccggcgaacaccatcacgccgatcgcgagaatgacgagcgtcaggatcccggccacgtacgcgatcggaatcgagcgcttcgggttcttcgcctcttcggcggccatcgcaacgccttcgatcgcgaggaagaaccagatcgcgaacgggatcgccgcgaacatcccgtggaacgcgcccaggctgaaatgatcggcacccgaccagccgcccttcatgaagttgctccacgcgaagcccggcgacacgacgcccatgaacaccagcagctcgaagatcgcgaacagcgtgacgaccagctcgaaggttgcggcgatttgcacgccgacgatgttcagcgccatgaacacgagatacgcgcccatcgccgcgtgcttcggttcgagccccggaaactgcacgtgcaggtacgcgccgatcgcgagcgcgatcgcgggcggcgcgaacacgaattcgacgagcgtcgccgcgccggcgagataaccgccggtcgggccgaacgcgcggcgcgcatacgcgaacgggccgcccgcgtgcgggatcgacgtcgtcagctcggtgaaactgaagatgaaggtcgtgtacatcgccgcgacgaacagcgcggtgatgacgaaacccagcgtgccggcgctcgcccagccgtaactccagccgaagtattcgccggaaatcacgaggccgaccgcgatgccccacagttgccaggtcccgagcgtctgctgcagcgcgggctggccggacgacttgcgccggcggcgggccggccattcgactctgctttcatcggactctctctcaaatgcgccgggcctggcggcctgcgcgactgagaatcgatgctagagagtcattaaacgacgtgttatcgaaattcggcaaagatcgcggctgacatttcgctgacggaaacgcctgttccgggcgtgtacggcctcccgatgcgcgaaaggcgccgatgccgggcccgcccgctgcgaccgccgccgccggccgcacgaagcggccggacggatgatcgacgcgcaagacttattgcccgccgccgcgctggttgaaccagcggtcgagcagcttgccggccgcttcgcggccgccgaggccgaacgacagcgccaccgccaccgcgatcgcaccgagcacgaggccgaacgcgagctgcacgatctcgttcgcgatgcccatcgcgcgcagccccatcgcgaacacgaggccgaggatcgcgaattgcgcgatgcgcgcgaacagcacgctgtgctcgcggtcggcctgctcgatcacgcggcgcgcgaggcccgcgagccacacgccgatcacgaggatcacgccgcccgtcagcacgtggccgccgaattcgatgaacagcgtgacgacgtcgcgcacctgcgagaagccgagccggttcgccgcttcgaccgaggcgaacagcatcgcgaagaacacgatcagccgcgccaccagcaccgacggctgcaggatccccgagaacacgcgctcgacgccgagcacggccgggagcccgtcggcgcccgcggcttccagcagcttctgcgcgagcgacgcgacgaagcgcgcgaagtagaacgtcaccagcacgatcacgatcgccgcgacgatgtccggcaccgcgccgaggaactggttcagcatgttggtggccggcaccgagatcgcgtcgatcttcagcgcgtcgagcgcggagatcagcgtcggcacgaacacgaacacgtagacgaccgtgccgatcaggctcgacacgcgcacgggcgtcgggctgtcgagacgctgcgtgaggcggtcggcgccggcggcgacgagcaggttcgtcacgaggccgcgcagcacgcgcgcgacgatccagccgacgatgccgatcaccgcggccgcgaacaggttcggcacgatcgcgagcagcttgtcgaccatcccctgcacgggcgtcagcagccccgacagcgcgaacgacgcgaggatcgccggcaggaacatcaggatcacgagccagaacagcacgtcgccgagataaccgctcatcggctgcaagccggcgccttcggacaatttgtcgtcgatcttgctcgccttcagcgcgcggttcgcgaggctgcgcagcagcgacgcgatgagccacgcgatcagcgtcagcgccgcgccgccgatcaggttcggcaggtagttgacgatgtgggtgacgagcagcgagaacgggttggagaccgcatacaggttgagcacgttgaagatgcccaccgcggtgaccagcagcacgagccagaacaggccgccggcgatgatgcgctcgacgcatgcgccctggccggtgctttcgttgatccgctgatcgaccttcagcgcgccgagcagacgcatcgcgccggcccgcaccacgacggcgatcagccagccgatcaccaggatgccgatcgcgccggcaatctttggcagataccccctagcgtggtctgcagcgacgtgatgaagctggaagcatccatttcttcttctcccgaaaacgtggtgttgcgattggacatcgacgaactacctgcgtacttcgaaaagcgtgctgccccgacggagcaacttacccgagaaaaatgacgcgatcacccgatttcaccgtctttaactttagtcatagatcgcagaggggcaagaccccatttcgtcaaaatgaaaaagggcccgacgggtcggcgcgcccgcgtatttccgcaagatttatcaattcgcaccgtgctaccgtggcgtcggttcctgcccggatacgccgatgaccgtcgaaacgaaacccgaccagcctgcctgggcccgctacgcggcaagcgtggcgcgcgtccacgaatacatccgcgcgcacctcgacggcccgctcgacctgaaccggctcgccgaagtcgcgtgcctgtcgccgtatcactggcagcgcgtctatcgcgcgctgtacggcgaatcgatcgtgctgacggtgcggcggatgcggatcgtgcgcgcgtccgaggatctcgtgtgcacggcgcggccgatcgacgagatcgcacggcgcgcgggctacggttcgacgcacgcgttcgcgcgggcgtttcgcgacgcatacggtgtgccgcccgcgcagcaccggcgcacgggcagccaccggcccatctatccactacagagaggagaggaagacatgttcaagcacgaagtcgaaatccggcggctgccggaactgcgtggctacgcggtggcgcacacgggcgcgtacatgaaggtcggcgacgcgttcgggcggatcggcgcgtgggtcgggcagcacgggctgatcggcccgggcgcgaagatgatcggcattttctacgacgatccggacacgacgcccgaagcgcagcgcgcgcgaaggcgtgtttcatgccggccgacggcgcgccggacgtcgagcccgtgccgccggtcgaacgcgcgacggtcgcgggcggcgaatacgcggtgctgctgcatacggggccgtatgcggacctgaagacggcctaccattggctctacggcgactggctgcgtcattcgggccgcgaagccgccgacgcgccgccgttcgagctgtacctcaacacgccgatggatgcggcgccggccgacctccgtaccgaaattcatctgccgctgcgctgagcaaagggtgcgtcgtggagcggtgtaactggacggaccgcgacgatattgccggcgcgagcatgcccgggacgatatcgggcaggctggtgcgccggccgtcgaacgaagcgtgccggcctgtgctcatgcgcagccggcacgaacgcgcggacctcttcaagccgcctgcgtcccgcagccgggacagaaccgcgcgtcggccgccagcgccgcatggcagcggctgcaggccttgccgcgttgcgccgcgccgcactgcgcgcagaagcgcgcatcggccgcattgagcgcgccgcagccggcacacgcgagctggctcagcggcacgttgccgccctggccgcctcgcccgccactggcgtcggccggcgcctgccagccccagccgtggcgatcgcggccgcgcgcgtcgtggccgccgtgtgcgtcctggcgctgcgcgccgtgatgcccgcctccgccaccgtggcctccgccgccgtggccgccattgccgtggccaccgccgtggccgcccaggattcgcttcagaaagctcatcgcccgctcctcaacgcgtggcctgcgcgccgccgaacgccccggaggacgacagcagccgcaagccgttggccacgacgatcaggctggcacccgcgtcggcgaagaccgccatccacatcgtgccgagccccgcgaccgtgaggccgaggaacacgaccttcacgccgagcgcgaagccgatgttctgcaccaggacgcgatgcgtcgcgcgcgacagccgcacgaacgcgggaatcttgcgcaggtcgtcgtccatcagcgcgacgtcggccgtctcgatcgccgtgtcggtgcccatcgcccccatcgcgaagccgatgtcggcacgggcgagcgccggtgcgtcgttgatcccgtcgccgaccatcccgaccgcgcccgcgccgccggccgccagctcctcgaccgccgcgagcttgtcttccggcaactggttgccgcgcgcgtcgtcgatgccggcctgcttcgcgattgcctgcgcggtatgcgggttgtcgcccgtcagcatcgcggtgcggatgccgagcgcgtgcagatcggcgatcgcttcacggctcgtgtccttgatcgtgtcggccaccgcgaagatgccgagcacgcgcgcttcgtcgaccagcaccacgacgctcttgccctgccgctcgagcgcatcgagcttcgcttcgagcgccgtcgagcagcgttcgagctcctcgacgagccggtggttgccgagccagtagcgcgtgccgtcgatcgtgccgcgcaccccgcgcccgacgatcgcttcgaaatcctgcacatcggcaaatgtcgtcgtgccggcgtcgcgggccgcggcggcgatcgcctgcgacaccgggtgatcggagcgcaccgcgaggctcgcaccgaggtgccgcacccgcaccgcatcggcgtcggtcgcatgcaggtcgaagtcagtctgcaccggcttgccgtgcgtgatcgtgccggtcttgtcgagcgcgagccaggcgagcttgcgccctcttccagatagacgccgcccttcacgagaatcccgcgtcgcgccgcggccgcgagccccgacacgatcgtcaccggcgtcgagatcaccagcgcgcacgggcacgcgatcacgagcagcaccagcgcacgatagatccagtcgtgccacgcaccgcccatgacgagcggcggcaccaccgccaccagcagcgcgaccgcgaacacgatcggcgtgtagacacgcgcgaactggtcgacgaagcgctgcgtcggcgccttcgcgccctgcgcctcctcgaccgcgtggatgatccgcgcgagcgtcgagttggccgccaccgccgtcacgcggtattcgaacgaacccgattcgttgatcgtgcccgcgtacacggcgtcgccggtcgtcttttcgacgggcaggctctcgccggtgatcggcgcctggttcaccgtcgagcggccggcaacgacctcgccgtccagcccgatccgctcgcccggcttcacgcgcacgaccgcgccgagcgccacctgcgcggcctcgatcgtgcgccacgagccgtcggcgtcctgcacggtcgcggtgtccggcgcgagctgcatcaggccctggatcgcattgcgcgcgcggtcgagcgacttcgcctcgatcagctcggcaatcgtgaacagcaccatcaccatcgcggcttcgggccactggccgatcgccatcgcccccgtcaccgcgatgctcatcagcgcgttgatgttcaggttgccgtttcggatcgcgatccagcccttcttgtacgtggtgagcccgcacgcgagtaccgcggcgagcgcgagcgccgccgcgagccacaccggcagcccggtccacgtcgcgccctcggatgcgatcgcggcgacgccggccagcgccagcggccaccacggcttcgcgggcgtgtcgacgacgcgcgacgccggcgcgccagccgccgcggcctcgggcgtcatcccgagcgtgcggatcgcgccttctatcgccggctgggcgcccggcacgtgttcgacggtcagcatccgctgcatcaggttgaattcgagcgccgacacttcgctcatcccgccgagcttcttgcggatcagcgtttcctcggtcgggcagtccatctgcatgatccggaacgcggagcgcacgtggcccgacgcggtcgcctgcgcgaccggcagcggcgcgagcgtcagcgcggcaggcgcgcagcagtcgccggccgcgaggtcgtggtcgtggtcgtggtcgtggtcggcatggtcgtgcttgccgtggtcgtgagagcacgcgtcgccgtgtgcatggccgttgccttccgcatgatcgtggccatgatccgaagggtcgtgcgcgccgtggtcgtgcgtgcacgccgcgccgtgccgatgcgcgtcgccgtggtcgccgtgatcatggtcgtggccgtgcgcgcgctcgccggccgccggcaccgcgtcggcaacggtcgccgtctgcgtgtcgcgcgaatcggcgcagcacgcatcggcgccgccggcatgacggtgtcgtgggtcgtgggtacgctgggcatcggtcatgacaacctcctcaatggctttcaatggcttgacggagtagagttaacaccctgaagccactacaaggtcaacccttgcacgggagaaagacaatgaagatcggcgaactggccaaggcggcccgctgcacacccgagacgatccgtttctacgagaaagaggggctgatgccggatgcggagcgcaccgactcgaactaccgcaactacaccgacgtgcatgtcgaacggctgcgcttcatccgcaactgccgcgcactcgacatggcccacgacgaaatccgcgcgctgttgcagctcaccgacacgccggccgatccctgcgattcgatcaatgcgctgctcgacgaacacatcggccacgtcgatgcgcgcctcgcggaactcacgcatctgcgcgaccagctcaccgaattgcgccggcagtgcgtcggcgagcattcggtcgaggattgcggcatcgtgcacggtctcgcgacgatggaaaccgtcgcaccggccgcgaagcgctcgcacctcggctgaaacccttgtggaatatgatggtttcgtcgagaatagttatattattactagatatgcgataactattcatgtccactagtcgcccgtccccgctcgcgctggccgtcctcgcgacgctcaccgaaacgccgatgcatccgtacgggatgctgcagcaactgaaggcccgcgggtacgacgaagtcgtcaacgtccggcagcgcacgagcctctaccagacgatcgaccggctgctgcgcgatggcctgatcgccgttcacgacaccgagcgcgacggcgcgtttcccgagcgcacgctgtatgcgctgaccgaggccgggcatacggccgggcaggcgtggctgcatgcgctgctcgcggagcccgcgcgcgaattcccggcgttcggcgccggcctcgccttcctgccgctgctcgacgccgaagatgcccgccaccagctcgagcttcggatcgcccggctcgacgccgagcgcgagcgcctcgaaacgctgcgcaacgccgcgcaggccgaccaggtgccgcgcctgttcctgctgcagaacgaacatgcgctcgtgctgctcaatgccgagctcggatgggcgcgcagcgtcgtcgaacacctgaagatcggcgcgctgcgctgggtggacggctgacgaatcacgcaggcgggcgcccggcggcggcaggcaacgccgccgtcaaagcaccttgccgggattcaggatgccgcccggatcgagcgcgtccttcaggcgtcgcatcagcccgatttccgcgtcgctgcgcgtgtgcgcgagataaggccgcttgagtgcaccgatgccgtgctcggccgacaccgagccgcccatgtcccgcaccaccgcgtacacgcagtgttcgagcgcgtcggcgtccgcatcgctcatcccggccagtgacacgccgatatgcacgttgccgtcgccgacgtgcccgaagaacaggcacacggcatccggccattgcatgcgcagcgccgcctcgcagcgttcggcgaacacgccgagttcgccggtcggcaaactcacgtcgaagttgaccagatgcggcagcgcgtcgatcgcgaggccttcgcgcagcgtccacaagtcccgcgcctgccgctccgacgtcgcgagcaccgcatcctccacgagcccggcctcgattcccgccgcgaggccggtttccagcgcctggtgcgcatcgccgcgcggtgcgctcgtcgcgcattcgatcagcaccgcgaagccgtcgtcgccgacaaacggcgccgagacgcccggcgtgcggcgcgcgacgtagtcgtagaacgccggccacatcgcctcgaaactgacgacctccggcagcgtgcgcacgcgattccacagcgcgatgaccgcgtcgtagtcgcgcacgcggcagagcgccgtggccggcgcggcgagcaacggatgcagccgcagcacggcgcgcgtgacgacgccgagcgtccctcgctgccgatgaacagctgcttcaggtcgtagcccgcgttgttcttcagcatccggttcatcgacgacacgaccgtgccgtccgcgagcacggcctcgagcccgagcacctgctcgcgcatcatcccgtagcggatcgcgcgcgtgccgcccgcgttggtcgcgagcatcccgccgatctggcacgagccgcgtgcgccgagatcgacaccgaaggtgaaacccgccgcttccgcggcttcctgcaccgtctgcagcggcgtcccggcgcgcacggtcatcgtgccggccgccgcgtcgagcgcctcgacgcccgcgaagcgttccatcgacagcacgacctcgccgccaagcgcgaccgcgccgcgcgcgagccccgtcaggccccctgcggcacgaccgtctggccgagccgcgcgcacagcgcaagcgtgcgcgacacgtcgtcgacactgcgcgggcgcaccagcgcgcgcggccgcgccggccggctcgttgtaggcggtgaaataacgcggatcgatgtcggccgcgcgcgtgacgagcgcatcgcccagttcggcgatgagcgcggcttcgagcgcgtcgcccgacagcggcgtgcccgccggttcgccgcccgcggcggtcgtgttccggttctgcatcgcgcgctgccccgcttacttcgccgaaatgtcgatatcgccgaaatacttcaggccgagcgacttcaccgtgccgtccgccttcagcttgtcgatcgcggcatcgagtttcgccttcagcgcgctgtcgcccttgcgcagcccgaatgcgatgccgctgccgaggatccggtcgtcgtgcacgggctggccgacgaacgaaaagcccttgccgtccggacgcgacaggaagccgcgctggccggacggtgcgagcacgagcgtcgcgtcgagacggcccgcgaccagatccgcatacgcctggttctggtcctggtacgcgacgaccgcgacgccggccggctcccagtgcgccttcgcgaaggtttcctggatcgacgcctgcagcacgccgacccgcttgcccttcagcgattccggcgtcggcagcaggccgctgccggtgcgcgcgatcagctgggtcggcacgcgatagatgatcgtcgtgaagtcgatcgcctggcgccgctgctcggtcgcattcatcgccgagttgatcgcgtcgaacttgcggcccttcagcgcgggaatcaggccgtcgaacgacgtctcgacccatttgcacgacagcttcgccgtctggcagacggcgttgccgacgtcgatgtcgaagccctgcaggtcgccgttcggcgctttcgattcgaacggcgggtattgcgcctcgaggccgaagcgcagcgtctgcgcatcggcgagcgccgcgccggaaccgatggcgcacgcgagtgcgaacgcgagtttcagggtggccgtgtgcttcatcgtgatctcctgtgtctggtcgatgcgacgtacccgtcgccggatgcccgtggccggatgccgtacggggtttacagcgaacgcagccgccgcgcgccttcgaccagcgtcgcgtcgtccttcgaaaagctgagccggatcacgccggcgtcggtgccgtcggtgtagaacgccgacagcggaatcgtcgcgacacgcgcgtcgcggatcaggcgcagcacgaaatcgctgtcgctttcgtccgagaagtgccggaaacgcgcgagcatgaagaacgagccctcgctcggcagcagctcgaaacgcgaatcggccagctcgcgcgcgagcaggtcgcgcttggcctcgtagaacgccgacaggccgagatagctgtccggccgcgcgaggatctccgcgaacgcgatctgcatcggcgtatcggccgagaacaccatgaactggtgcaccttgcggatctcgtccatcaggtcggccggcgcgaggcaatggccgacccgccagccggtcacgtggaacgacttgccgaacgacgacacgatcacgctgcgctcggccagctcgcggtggcgcgcgacgctctggtgctgcgcgccgtcgaacacgacgtgctcgtagacttcgtcggacagcacgacgatgcccgtgtcgcgcgtgagctgcgcgagccgctcgagatcgtcggccgagaacacggtcgcggtcgggttgtgcggcgtgttgacgatgatcatccgcgtgcgcggcgtgatcgcggccgccacctcatcccagttcacgcggaaatgctccggcgacagcttgatcgccacgggcgtcgcgccctgcagccgcacgatcggcgcatagctgtcgaacgacggctcgaagtagatcacctcgtcgcccggatgcacgagcgcgctgatcgccgcgtacagccctcgctcgcgctcgcgatcaccgtgatctcggtggccgggtcgtagcgcgcgccgtacagcgcctcagtcttttccgcgagccgctcgcgcagcgccatcacgccggccatcggtgcgtactggttgtgcccgtcgcgcatcgcgcgcgcgacgccttcgacgagcgccggatcgggcgcgaaattcggcgccccctgcgacaggttcaacgcatcgtgccgggcggccagctggccgatcaccgtgaagatcgtcgtcccgacgtcgggcagtttcgaacggggcgcggtggcgcttcgcatgactcctccttctgatgtccttcgggcggccccgcgcgacgcgcgcggcctgcatctgccgcatgatttagcccgagccaatatcggtggacaaacgaaacttcgtcatggcggccatgcattttctcatggcccatggagagaagcacgcggcggcaaggctcacctgcctggccgacatgcgaatccggcatttcctttaagggatgctaccggccggccgccgccagataggcgagcagcacggcccgcaattcgccacgcagcgcggcgatgtcgaacgcgggcccgagcgtcagcagcgcctgcgagagcccgccgtagcagagcgtgtgcgccatccgcgcgatcccgtcgagccgcgcggccggcggcggatcggccgcgtgcgcgagcgcgtcgcgccacagcgcgacgtacgcgtcgtaatgccggcggtaggcggcgagcggcgacacctgccgctccagcgcgaagagcgcgccccacagcgccgcgtcggcgccgatcgcgtcgacctgcaggtcgacgagcgcggcggcgagttcggcccgcggcgcgccgcgcagccccgccaccgcgtcgcgcagccggtcggccagcgccagcacgtgccgatggatgcagagcgccgcgaggctctgcttgtcgccgaaatactcgtagaaggtgccgatgctgacgcccgcgacggccgcgatctcgcggatcgtcgctttcgcgtagccgcgttcgagcaaaagctgaacgaacgcctgctgcagcgcgtcggaactcgcctgcgcgcgcgactggcgcggccggcggcgcaacgcgggcgcgggttgcgccgccggctggccgggcggcgccggaacctgaacatgtcgcggcggcatatttgctactctggaaatcagcagggcatgcgttttaccggggccggaaccggcgccgaagcgtcatccgggcggcatgacgccggccgcccgcgaagcatgagaccggagacaacttcgatgaccgaatcgactcacgccgtcacgaaccagttcgacgaactggtcgactataacctcttcacgacggacatcgcgctgcgcgacgcgctcacccgcgcgggcgccgactgggccgtgccgcagctcgacgcatacggcgcgtggctcggcagcgccgacaccgcgcggcttgccgacgaagcgaaccgtcacacgccggaactgaacacgttcgaccggcgcggccggcgcatcgaccgcgtcgactttcacccggcgtggcacgcgctgctcggccggtaccgccaggaaggcttcgtgtcgctcgcgttccgcgagtcgcgccgcggccgctgggccgcgaccgcggccggcttctacctgcatggccagatcgaggccggcacgctgtgcccggcgacgatgacgcaggccgcgattcccgtgctgcagaaggagcccgcgctgtgggcgctgctgcgcgacaagctctacagcgacgactacgatccgcgcgacgtgccggtcgccgacaagcgctcgatctggttcggcatgggcatgaccgagaaacagggcggctccgacgtacgcgcgaacacgacgctcgcgaccgccgtcggcgcgggcgggcgcggcggcgaataccggctgcgcggccacaagtggttcttctccgcgccgatgtgcgacgcgcacctcgtcgtcgcgcagaccgaaggcggcggcccgtcgtgtttctacgtgccgcgctggcggccgggcggcacgaagaacgcggtcgagatccagcggctgaaggacaaggtcggcaaccgcagcaactcgagcagcgagatcgagctgaacgacgcgtggggcatcatgctcggcgacgaaggccgcggcattccgaccatcatcgagatggccacctacacgcggctgaactgcgtgctcggcagtgcggcgatgctgcgccagggcgtcgtgcaggcgatcgcgtacacgcgccagcgccatgcattcggccgcgcgctcgccgaacagccgctgatgcgtaccgtgctggccgatctcgcgctcgaaagcgaagccgcgctcgtgctggcgatgcgtctggccgacgcgttcgagcgcgacgactcgccgcgcgaacgcgcatggaagcgcatcgtcacgcccgccgcgaaattctgggtgtgcaagcgcgcggtcgagctgaccggcgaggtgatggaagtgttcggcggcaacggctatgtcgacgacggcccgatcgcgcggctgttccgcgaggcgcccgtcaactcgatctgggaaggctcgggcaacgtgatgtgcctcgacgtgctgcgcgcggtgtcgcgcgagcccgacgcggctgccgcgctgttcaccgaactcgccgacctcggcgcgggcgaaccgcgcatccgcgcggcgctcgacgcgctgcgcgcgatgctcgacgcaccggccgacacgctcgaggcgtcgggccgcgtgttcgcgcagcgcctcgcgctcgtcgcgcaggcgtgcctgctgcgccgcgacgcgccggcggccgtcgccgacgcgttcgtcgcgacacggcttgccgcgcccgactggggccgcatcgcgggcggcttcgacccgcacgcgatcgacgtcgccgcgctgctgcgcgcgtacccggcctgacgcccgctcgtccggcccggttccccgttcgccccgttcgccttcgttcgcccgcccggagctccgatgaacctcgtcgccgccctcgaccgcgccgcccgcgcgacgcccgacaagccgttcctcgtcagcgaatccgcgacgatcacctatgccgccgcgcgcgagcgctcgcaccgcgcggcggccgtgctgagcgcgctcggcgtcgcggccggcgaccgtgtcgccgcgatgtgcttcaacacgccggccttcgtcgacctgatgttcggcgcgtggcggctcggcgcgacgttcgtgccgatcaaccacaagctgcaggcgcaggaagtcgactacatgctcgaacacagccgcagcaagacgctgctgttcgacgtgacgctcgcgccggtggtcgagcgcatcgtgcatcccgcgcgacggctcgtgaccgaaggcgagctcgacggcgtgccgtgcttcgacacgctgtgcgcaacgatggacggcctcgcgggcatcgagccggccgacggcgacatcgcgcagatcctctatacgtccggcacgaccggccacccgaaaggctgcgtgcacagccaccgcaccgtgacgctcgccgcgatgcaggcggccctcgcaaccggcatcggccgcaacgagcgcacgctgatggcgatgccgatctggcattcgtcgccgctcaacaattggttcggcggcacgctgtatgcgggcggcaccgtcgtgctgctgcgcgaataccatccgctgcggttcctgcaggccgtcgagcgcgagcgcgtgacgctgtatttcggcgcgccggtgtcgtacctgctgccgctcgacacgatcgagggtttcgcggcgttcgacctgtcgagcgtgcgcgcatggctgtacggcggcggcccgatcggcgccgcgcaggccgaacggctcgcgcgcgcgtatcgcagcgacgcgttcttccaggtgtacggcatgacggaagcgggcccggccggcacgacgctgtatccggacgagcagatcgcgaaggccggttcgatcggccgccacggcggcccgggcgtcgacctgcgcgtcgtgcggatggacggcgtcgacgcgcagccgggcgagaccggcgagatctggctgaagaccgacagcatgatgctcggctatctcgacgatgcggccgcgacccgcgccgcgttcgcgccgcacggctggtatcgcaccggcgacatcgcgcggatcgatcaggacggctacctgttcatcgtcgaccggctgaaggacatgatcgtgacgggcggcgagaacgtctattcgaaggaagtggaggacgtgctcggcgcgcacccggacatcgccgaggcggccgtcgtcggtgtcccgcatcccgactggggcgagacggtcgtcgcgcacgtcgtgctgcgcgcgggcacggcgcccgacgcggacgcgctgcgcgcgttctgcggcgagcggctcgccgcttacaagattccgcgtgagttcacgttcgtgcaggcgctgccgcgcacgcccacgggcaagctgcagagttcctgctgcgtgtgcgtcgcgaggactaagcatccacgattgcgcaagcgcacttacaactcacgcactcatattccccttgcgaaccacaaagcaagatacggcatcactccttatccgcatcacctgatcaacacattcgagcacgcgcggtcaatgcaaaaggcagaactgaacaagtaatagaaattggcagccctgaatcatattcgtccgattgatctacgttccctatctggaatagcgtctctaggcagccattccatttactgagacagggaagccggatgaaagacgaactcaaagcaccgacccatcttttcgccaccgttggtgcactcacggaacgcggtggacgcgtcaccaccgcaaccagcggcctgaccctggctggattagaagtcgcctgcgtcggcgacgtagtgacctatgacgacggcagcgaggctgcaattatcgacggcgcgggaaacaaccatagcggaggcaagccgttcgcgttggtcggcagccggttgagcaacggtgaccgcattaccgaaacactgcgcacctcatggggcattcacgtgcgggatgggcaaagcgctgcgggcctgttcgatccgacctatgtgccgccgcccgcgccgcccgcctacagattggcggtatgtggcgcgacaaccgcgcgcggcggtgcattgcgcgagccgtccggcacatgggaagtagcgccgcacttgggcaaggctgccacggtgggcgacctgatccactacccggacggttcaaccgcgcgcgttacgagcggtctgggtttggccgacaggcccgacttcccaccgctcgcattcgttggcagcgaactcgataatggcgacacgatcaccgatagtcccgaacgacgaggcgtagcgtcatccgttgtatttagcgtcgtcacccgctcgtccatgccccgctgaggtagcgtccatgatccgctactttcttgccaaaggcgaccgcgccggggaagcgataattgtcgaaggcctcgacaccgtgacctgttccaatccgccgccgagggttcatatcgccacgctggatatgaagacctactgttctgcctgcaagcgtgaaggacacatcgcaccgcaaggtccgcgctggccaggtaccggtccgaacggcaagcagtgggcattgagcggggatatcaatgtctgcggctgcaacccaccgccgatcttctacgctgagcgcggcatgcggatgatttttactgcggaagagactgcgacgctgaatgggcgccaacctgatgcagccgatcggtcatttgctcggtcggctgtcgtacacgacgagcaattcaccttgctcgatgactcctgccgcccgctcgcgaacattcgctatcgaatcgttacggacactgggcagattttcacaggcaccacggacacggccgggcaaacacatcgaatcgccaccgacgcctcggcaactctgaaaatctatacgacggaacattgaagcaatgaaaaattttgatgtgaatgatgacggagaatggttcctcgtacactcaggcgcagtcaccaataccaatcctgggtcgatggtggaagtaacgatcaataccgaaaaatatgtcacaacatgacaaacaaggaattccgggaaatggtattgagtaaacgcgatcgagccgtttctctcgtcgagaaaagaatcaaggatctgcagcgctggtccaacactgataaggcacgcgtattacagtggttcggcaggactgatgaacgcacccgcataacgctattaacaggcctgactgcaatcgtccgcgtactaaaggcactcaccggatacaatttcacgcgatgggacagcgagcgattcaaacatattggatgcgttccaaattcgaacaaatcgggagtcgcggcatcagtttgttcgccggataccgtaactcatacgctcgcaatacaccccgatttttgtacaatgcgagacttctcatgggaaaaagattccgtcgtttccaccctgattcatgaggtgagtcattttgacgacacaatgggaacccgcgatcacaaatatttcatggaggagtgtttgacgtttggagccgaaaacccgaatcaagcaatcaacaatgccgacagcattgcaggatacgtcatttacaatgcttaaatttattcttgccctaagccttctcatctccaatccggtatttgcttgtatcgccagcgagaacttcgacatctacttttcgagagatagctcgcacctatcgaatgcagagatcgtccgcattgcaaaatggacagccgaccaaaagctcaattacgcgaatcacctgaccaaagagacaaccctgatcagtggccatgccgaggaaagtgaaccgggagcactggcccttgcgcaatcaagattacaaaccgcgtatgcgctgttggagcaactcggctttttacgcggaacgatcaagaagagcgcccgcgtctattcgcatggcgacgtggacaatgggcgacgtgtggaaatttccttcctgcccgattgccctaacaagtgctgcgacggcaagtaacgtcatactgccgccgatcggggcgatgcggtatcgacgtacacatgcggcgatcctgctgcaccactgcctgcaacatccctatgcccctgtcgggtgtgtcccaccaaagaaaaagccacccggcccgatggccaggtggctttttcgcatgaccggcggggcagcgacgtgcgccgccgcccgttcgtcacgtcacaggctgcttacttgccgccgatgctcttcagcggcttccactcgcccttctcgaccttgtacatcgtgatgccgccgttcttcaggtcgcccttcgcgtcatacgcgacgtgcgtcgacgtcacgccggccatgtcggtcttcgcgagcaccggcaggtacttcgccggatcggtcgaatcggccttcttcatcgcgttgaacagcgccatcgcgccgtcgtacgcatacggcgagtaggtctgcacgtcttcgccgaagcgcttcttgtacttgtcggcgtacgtcttgccgcccggcatctcttcgagcggcaggcctgccagcgaggcgatcgtgccgtcggccgcgttgcccgcgatcttcaggaacgtcggcgtcttcaccatttcgccgctcatcagcggggcggtgatgccgagcgtcttcatctgcttgaccatcggtgcagcctgcgaatccgcgccgccgtagtagacgagatccggcttcgccgccttcagcttggtcaggatcgccttgaagtccaccgccttgtcgttcgtgaattcacggtcgacgatcgtcgcgccgccggccttcgcggccttctcgaactggtcggcgagaccctggccgtaggccgtgcggtcgtcgacgatcgcgatcttcttcatgccgagatccttcgacgcgaacgtgccggccaccgagccctgctgcgtgtcggacgtcatcatgcggaacgtcgtcttgtaaccctgctgcgtgtattccggtgcggtcgccatcgcgatctgcggaatgcccgcgttcgcgtagatgcgcgaggccggaatcgtcgtgcccgagttgaagtggccgagcatgcccttgatgccgtcgtcgacgagcttctgcgcgaccgtcgtgccggtgcgcgggtcagcctggtcgtcctgcgtgtcgagtgcgaacttcaccggcttgccgccgatcttcgggctcgtcgcgttgaaatcctcgatcgcgagcacgatcccgttctgcatatccttgccgtagtgcgcctgcgcgcccgtcatcggccctgcgtaaccgatcttcacgtcatccgcatgggccgtccccgccagcgacatgaccgcgacgaacgtcgcgcctgccacctttttcatcgtgtgttgcatagcatctccttggtaccagggtaaatggagcggcttcgggatcgcctagccgcttcctttgtttgatccgaacggcaaggatgatcagccgatcgtcatcaaattcgcattgccgcccgccgcggccgtgttcacgctcaccgagcgctccgtcaacagccgttccagcgcgtaatcttccgcatcgccgttctcgaacgcgcccaccgacacgccctgcaccgacacgatcgggcccggccgctgcgcgacgtccttcacgagcgtctgcagttcgtcgctgtcgccttcgaacagcaccgcgtcgaacggcgtatcggcctgcttgcgcacggtcgcatgcgccttcagcgacgccggcagcgcggcgaccagcgcctcgccggccgcgcccgcgaacagcgcgcggttgccggtcgccagcactgccgcgaactgcgcgcgcgcgccgcccggcgtcgccgcgacacacagcaccgtgccgcgcgggccgagtgtacgtgtttcgctcgcccgtcgggccggtcagcacggcggtcgcaccggccggcacctgcgccaggtagccgtcgcaacgcgcggccagagccggctcgcgctgctcgatcagccagtcgcgcagcgtcgtgagcgctgccgcggggttgccgcgcgcatcgccttcgaccgcgccgtccgcgatcagcgtctgcgcgagcgaacgcggcaggcccgacggacgcgtcgcgagcaggcgctgcaggtacagcgcgccgccggccttcgggcccgtgcccgacagcccttcgccgccgaacggctgcacgccgaccaccgcgccgatcacgttgcggttcacgtagatgttgccgacgtgcgcattcgagatcacgtgcgcgatcgtctcgtcgatccgcgtgtggatgccgagcgtcaggccgtagccggtcgcgcggatctgctccagcagcttgtcgagctggctgcggcggtagcgcaccacgtgcagcacggggccgaacacttcgcgcttcagctcgtcgatgctgccgatctcgatcagcgtcggcggcacgaacgtgccgtgcgcgcaggcttccggcgccggcagctgcgtgaccgcgtggcccttctccttcatcgccgcgacgtgcgtgtcgatcgtctgcttcgcttcaccgtcgatcaccgggccgacgtccgtcgacagccggtcggggttgccgagcgccagctcgtgcatcgcgcccttcagcatcgtcagcgtgcggtccgcgacatcgtcctgcagacacagaacgcgcagcgccgaacaccgttgaccggccgagtcgaacgacgactgcatcacgtccgcgaccacctgttccgcgagcgccgacgagtcgacgatcatcgcgttctggccgcccgtttccgcgatcagcgggatcggcttgccgtccgggtcgaggcgcgccgacagcgtcttgttgatcaggcgcgcgacttcggtcgaaccggtgaacatcaccgcacgcgtgcgcggatcggcgaccagcgccgcaccgacggtctcgccgtcgcccggcagcagctgcaccgcgccggccggcacgccggcctcgcgcagcaggcgcacggcctgggcggcgatcagcggcgtctgttcggccggcttcgcgagcaccgtgttgccggccgcgagcgcggcggccacctggcccatgaagatcgcgagcgggaagttccacgggctgatacagaccacgggaccgagcgggcggtgcgtgtcgttcgagaattcgtcgcggatctgcgcggcgtagtagcgcaggaagtcgaccgcttcgcggatctcggcaatcgcgttcggcagcgacttgccggcttcgcgcacgatcaggcccatcagcgtgtgcatctgcgcttcgagcaggtcggccgcgcgcaccaggcaatcggcgcgtgcgtcgaccggcgtcgcctgccagatcggcgcggcggccaccgcgtgcgcgagtgccgcgctcacgtgttcggccgtcgcttcgctgacggtgccgaccgtgtcacgctggtcggccgggttgcgcacgtcgcgggccggcgcgtcggcgagcgcgtcgtcggcgagcatcggcgccgcgcgccacggaagtgcgcgctcgcgagcagcgcggacgacagcgacgcgaggcggtgttcgttcgacaggtcgaggcccatcgagttgggacgctcgtcgccgtacaggttgcgcggcagcgggatcttcgcgtgcggcgcgccgagcggcacgaccttcgacgcttcgtcgaccggatcggcgaccagctccttcaccgacacggtcttgtccgcgatgcggttcacgaacgacgtgttcgcgccgttttccagcaggcggcgcaccaggtacgcgagcaacgtctcgtgcgtgccgaccggcgcgtacacgcggcacggccggttcagcttgtcgcggccggtgacttcctcgtacagcggctcacccatcccgtgcaggcactggaattcgtactggcccgggtagtagttctggcccgcgagctggtagatcgcggcgagcgtgtacgcgttgtgcgtcgcgaactgcgggtagacggcgtcgggggcggcgagcagcttcttcgcgcacgcgaggtacgacacgtccgtgtagatcttgcgcgtatagaccggatagccttcgaggccgtcgacctgcgcacgcttgatctcggtatcccaatacgcgcccttgaccagacggatcatcaggcggtgacggctgcggcgcgcgagatcgatcaggtagtcgatcacgaacgggcagcgcttctggtagccctgcaccacgaagccgatgccgttccagcccgcgagatccggatcgaagcacagcgcctcgagcaggtcgagcgacagttcgaggcggtcggcttcttccgcgtcgatgttcaggccgatgtcgtagcggcgggcgagcagcgcgagcgcgcgcacgcgcggcagcagctcgctcatcgtgcggtcctgctgcgaacgcgagtagcgtgcgtgcagcgccgacagcttgatcgagatgcccgggccttcgtagatgccgcggccgccggccgccttgccgatcgcgtggatcgcctgttcgtacgacgcgtagtagcgctgcgcgtcctcttcggtcgtcgccgcttcgccgagcatgtcgtacgagtagcggaagccgcgcgcttcgtacttgcggctgttggccagcgcttcggaaatcgtctcgccggtgacgaactgctcgcccatcaggcgcatcgccatgtcgacgcccttgcggatcagcggctcgccgccgcggccgatcaggcgcgtgagcgccgacgacagccccgcttcgctgttggtcgtcacgagcttgccggtgatcatcagcccccaggtcgccgcgttcacgaacagcgacggcgcgtggccgacgtgcgagcgccagtcgcccttgctgatcttgtcgcggatcagcgcatcgcgcgtcgcacgatcgggaatgcgcagcagcgcctcggcgaggcacatcagcgcgacgccttcctggctcgacagtgagaattcgtggatcagcccttcgacgccgccgcccgagctcttctcgcgcagcgcctcgacgagcttcgtcgcgagcgcctgcacgtccgcctgaaggttcgcgggcaggcgcgcctggccgagcaggaacggcacgcattccggctcggggcggcggtacgcggccgtgatcgccgcgcgcagcaccgattgcggctgcacgttctgcgcgaattcgaggaacgggtgcggcgagttgtcgtcgtcgccgtccgcggcctggccgtcggcgagctccgtgacgccgctgtggcccgacagctcgggcggcaactggccgtgctcgatccgctcgagatacgcgaagatcgcctgtttgatcagccagtggggagtgcgctcgagacgcgcggctgcgtccttgaggcgcgagcggagaaggtcgtcgaccttgacgccgagagtcgtgcttgccatggtgggttcgtgcgccggtgcgagcccggcaatgtggtgtgagaggatgcgcgaaatcctacggcacgcaataaaaggtgcaaccaaattgcaagatgggttgcaccctttggttagtcaatataatcagccacttatgcggttgcaacctaggagttgcccgtggtcgggggtcggtgttttccctgagcaggccggtttggcgtgcgtgcgcaaccttcccgcgcgtggcggcggacgaaaacgggttgcactggggtggcggcggatggggtggccggggttggccgtgccgcaaagacggttcggggctgcccgacggcccgggcgtcgacgcagcggcacttggtgtgcggtgtgcggtgtgcggcacgacggccgcatggcgcgccgctcagatatccagcggatcgacctcgacgctccaccgcagcacgcccttcagcgcgcgcaactccggctgccatgcgcgcagcgcatgctgcagcgccgcccgcgacgcgctttcgagcagcaactgcgcgcggtggacgttcgcgaccttgacgatcgtcatcggcaccgcgtcgtagacggtcacgcgatcggcgcccggcaaccccggcaacgcggccgcggcttgcagcaggaacgcgagcgccgcgtcgagcgtgcgccctcggcgcgcagcagcgcctggtagacgaacggcggcaggtgcgcgtcgcggcgctcgccgagcgtcgaattcgcgaagccgacgtagtcctgccgcccgagcgcgtgatacagcgcgtgacgcgggtagcgcgtctgcacgagcacctcgcccggcagccccgcgcgccccgcgcggccgctcacctgcatcagttgcgcgaacagccgttcgctcgcgcggaagtcatgcgagaacagcgccgtgtcggcattgagcacaccgacgagcgacacgcgctggaagtcgtgccccttagcgatcatctgcgtgccgacgaggatatcgacctcgcccgcgtgcacatcggaaaagagcgcctgcgcactgcccttgcgacgcgtgctgtccgcgtcgatccgcagcacgcgcgcgcccggcacggcctcggcgagcgcctcctcgatgcgttgcgtgccgcgcccgagcggcgcgatgtcgacgttcccgcactcggggcacgatcgcggaatgcgggcttcccagccgcagtgatggcagcgcagcgcatgctcgggcttgtgcagcacgacgtacgcgctgcagcgcgggcagcctgcgacccagccgcatgcgtcgcacgcgagctgcggcgcgtaaccgcgccggttcaggaacacgaggctctgctcgccgcgttcgagccgcgccttcagcgccgcgacgagcggccccgacagcccgcccatcgacgcgcggccgcgccgccgctcctcttcgaggtcgatcagccgcacggtcggcagcgtcgcgtcggccaccgcgcggcgcgacagcgtgagtcgcgtgtagcggccctgctccgcctgccaccagctttcgagcgacggcgtggccgagccgagcacgaccgtgatgccgagctgcttcgcgcgccacacggcgagatcgcgtgccgaatagcgcagcccttcctgctgcttgtacgcgggctcgtgctcctcgtcgacgacgatcagcgcgagcgccggcatcgacgcgagcaccgcgaggcgtgtgccgagcacgatccgcgctcgccctgtatgcgcggcgagccagttgcgcgcccgctcgccctcggcgagcccgctgtgcagcgtgacgatcgcgtcgtcggcgagcgcacccgcgaagcgcgcgcgaaacgcggcctcgaactgcggcgtcaggttgatttcggggacgagcacgagcgcctgcgcgtccggccgggcatcgagcagcgacgcgagcgcatgcagatagacctcggtcttgccgctacccgtcacgccgtgcagcaggaacggcgcaaagccctgcgcggcgcggatcgcgtcgagtgcctcggcctgctggtccgtgagcgccggcggcacagttcgtccaccggctgccaacaggttatccacagctttgggcacaggcgcatcggcccagccgatctcctcgatgtcgacccagccgcgcgccgcccagtcgtcgagcgtcgcgaccgccttcgggtgcagcgcgcgtgcatcggggagcgcgagcgagccggtgtcgaccagcgcctgcgcgagccgccgcagcgcggccccgcgtgcgggcaacgcatcgggcagcgccgcgcggccggcctccgtcggccggtagcgcacctcgggcgcgagcagccgcccccagcgccccgcatcgcgcagcgcctgcggcagcgccggcagcgcgacctcgccgcgcccgcgctggtagtaatcggcagcgaacgacacgagcgcgagccagtccggcgacaacggcggcaggtcggtgcagatcgcgtcgaccgcgcgcagccgggacggcggcacgtcggtgtgagtcgtcacttcgtagacgagcccgaccgcctgccgcttgccgaacggcacctgcacgagcgtgcccggcacgggcgccggttgcgcgtcgcagcgatagtcgaacagggtggcgagcggatggtcgagcgcgacgcgcaggtaggtgccgctcatcgcggcgctccggcggcggcatgcaccgcatcgagacgggcggccggcatccgcgcccgcatcgtggcggcggacttaaagtaaaacgtcagattcggcgctaagttttggattcgcattaggaatcgccgtataccctgcccagcctgtggataactttgttgagaactcgccgctcacgggccgcaacgcacgcggggccgcgctttccgctgattttcgccgtttgtggcggtccccgcggagccttattccataaggctgctattcaaattaccgaaccatagcgaggcaatttgaccgacacagggctctaccgcgctgcaacgaggaaaatgtgtataagtcaagtcttgacaagcactgaatcggcaaccggtgcggggttgcgccctgtttagcgccgaaaacgaaacgctgtcaccccgcagtgcagcatgacagcgcttgcgttcagccggcggctccgctacggatcgcgcggctgtggttatgcacctcgtcgacgagttcagcgacgtgatcgggcgacgtgaattgcgaaataccgtgcccgaggttgaatacgtggcccggatggttgccgtagctgtcgagcaccgcgcgcgcctgctcgcgcaccgcggcgggcggcgcaaacaggatcgtcgggtcgaggttgccctgcagcgcgacacgccccgcgacgcgctcgcgcgcggcgccgaggttgaccgtccagtcgagcccgaccgcgtcgacgccggtcgccgcgatctcctcgagccacagcccgccgcccttcgtgaacgtgatgaccggcacgcgctcgccgtcatgctcgcgcttgagctgcgccaccacgcggcggatgtagtccagcgagaagcgctggtacgcgccgtccgccagcgcgccgccccacgtatcgaagatcatcacggcctgcgcgcccgcttcgatctgcgcgttcaggtaggccgccacggcctgcgcgttcacgtcgaggatccggtgcatcaggtcggggcgcgaatacgccatcgacttcaccgtgcggaaatcgtccgacccgccgccttcgaccatgtagcacgcgagcgtccacgggctgcccgaaaagccgatcagcggcacgcgctggcggccctggccgtcggtaagcgcgcggcggatctcgcgcaccgcgcccgtcacgtagccgagcgtctcttcgatgtccggcaccgcgagcctggcgacgtcggcctcggtacgcaccggatgcgcgaacttcggcccttcgccgacctggaagtcgaggccgaggcccatcgcgtccggaatcgtcaggatgtccgagaacaggatcgcggcgtcgagcggaaagcgctcgagcggttgcagcgtcacttcggtcgcgtagtcgggattcttcgcgagaccgaggaagctgccggcgcgtgcgcgcgtcgcgttgtattcgggcaggtagcggccggcctggcgcatcagccagatcggcgtgtagtcggtcggctcgcgcagaagcgcacgcaggaaggtgtcgttgagcagggtatgggccacggtaggagcgacggtgcgaaggcaaagcggcattttaccggacagccgccgcaaggctgcgcatgccgacacgatggcggccatatgacgcgcgcgatggctccgttatgatcggacgctcatatcgaacgaaacgaaggaggagaccgatgaaaccattcgccacgctcgccgccgccgcgttgttttgctgcgccgccgcgcacgcgcagaccgccggggcgcagccgccgccgcaccgggcgccggctcgcggctcgacgacgtgctcgcgcgcggcacgctgcgcgtctgcacgacgggcgactacaagccgtattcgtactaccgtgcggacggccgcttcgagggcatcgacatcgacatggccgaatcgctcgcgaagtcgctcggcgtgaagaccgactacgtgaagacgagctggccgaacctgaccggcgacttcgtcgcgaaatgcgacatcgcggtgggcggcgtctcgacgacgctcgagcgccagaagcgcgtgttcttcacgcagccgtacgtcgtggacggcaagacgccgatcgtgcgctgcgcggacgccgacaaataccagaccgtcgcgcagatcgaccggccggaaacgcgcgtgatcgtgaacccgggcggcaccaacgagcgtttcgcgaagcagtatttcacgcacgcgaacctcacggtctatccggacaacgtaacgatcttcaagcaaatcctcgcgggcaaggcggacgtgatggtgacggatgcgtccgagacgctgctgcagcaaaagctgaatccaggcctgtgctcggtgcatccggacaagccgttccagttcggcgagaaggcgtacatggtgccgcgcggcgacgtcgcgttccagcagtatgtcgaccagtggctgcatctcgtgctgtcgaccggcgaataccaggcgatttcggacaaatggctgaagtaagcgggttcgcacgcggcggcccgcagtgactttagcgggcaccgaccccgcggcggccgcccgcgaaaatcgctgcacggcggcggccgaatcgccgccgttacacttcgacgcagctcgccggcgccggcaaaatcggcccgatgccggcgaactggccgaacggtcgacttccgcgccggccaatcacgtttcaaaatctttctgacgaatgaatcgtcatgcgcggcatctgccgaaccgcgcattttctcgcgtgtaaatcggcaattcgtcgagcctgatacgcatgaaaaacgcatcgtgcgcacgcgctgaaaacgctgcggaaaatatgggtaaaatgaccttttcgggccctcaaaaacagcaaaaatcccggaaagccttatctggcgggcgttacaacctgaaacactttgttaccgcgaggggtcattaattcgcccacaatggcctcaacggtttcaacacggatgcggtctcgtgtgccaagtgtgagcggacgcgaagcgctgcgagccagtcggtcacgtaccgaagcccttccaaggggcatccctgttggagtcgtttccggcccccgccggactcggtttcatctttggtctcctcgcgctaaccccgtagcgtgtggtttttagcgggctaataagcccgctttttcgtccatcgaaaacgcaacggcccgcaggccgccgcgtttttccagcgtattttccttcttcatgccgcgctaagcggtcttctgcacgtcgagcttcagctcctcgatcatccggtcgcgcatcacgaacttctgcaccttgcctgtcaccgtcatcggcagctcgtcgacgaagcggatgtagcgcgggatcttgtagtgcgcgatctgcccgttgcagaacgcacgcacgtcgtcctcggtcatctgctcgtccgcgcgcagcacgatccacgcgcacagctcctcgccgtacttcgcatcgggtacgccgaatacctgcgcgctctgaatcttcggatgccgaaacaggaattcctcgatctcgcgcggatagacgttctcgccgccgcgaatcaccatgtccttcaaccggccgacgatgttgcagtaaccgtccgcatcgagcgtcgcgaggtcgcccgtatgcatccagccgtccacgagcacctcgcgcgtcttcgtgtcgtcgtcccagtagccgagcatcaccgaatagcccttcgtgcacagctcgcccgtcgcgccgaccggcacgatatcgccgctcggatcgacgatcttcacttccagatgcggctggatgcggccgaccgtcgtcgtgcgcttctcgagcgggtcgtcggtcgagctctggaacgacacggggctcgtctccgtcatcccgtacgcgatcgtgatctcggacaggtgcatctgcgacacgacgcgcttcatcgtctcgatcgggcacggcgagccggccatgatcccggtgcgcagcgtcgacaggtcgaattgcgcgaacgccggatgatcgagctccgcgatgaacatcgtcggcacgccgtgcagcgcggtgcaacgctcgtcggccaccgccgcgagcgtcgcgaccgggtcgaatgcttcgcccgggaacaccatcgccgccccttcgacacgcacgcgagcactgcgagcaccatcccgaagcagtgatacagcggcaccgggatgcacagcgtgtcctgttcggtgaagcgcatcgcggtcgcgatcgagcggccgttgttgacgacgttgcgatgcgtgagcgtcgcgcccttcgggctgcccgtcgtgccgctcgtgaactggatgttgatcggctcatgggcctcgagcgtcgcgccgatcgcatcgagcagcgcgggatcgacggcctggcggccgcgcgccatcacgtccgcgaagcggaacatgccggccggcgcgacgtcgcccatcgacacgaccgtgcgcaggctcggcacgcgcgccgcatgcaggtcgcccggcgtcgcggtcgcgagttccggcgcgatggtctgcagcatctcgacgtacgcggacgtcttgaagcgctcggcggcgatcacggctttacagccgaccttgttcagcgcgtattcgagctccgcgagccggtaggccggattgatgttgacgagcaccgcgccgatccgcgcggtcgcgaactgcgtgagcagccattcgctgcggttcggcgaccagatgccgacgcgatcgcccttcacgatgccgagcgaggccagcccggccgccagcacgtcgacctcgttcgcgaactcgcgccaggtccagcgcacctgctgctcgcggaacacgacggccggccgatcgggaaagcggcccgccgtgtcgagcaggaaccggccgatcgtcgcttcggagagcggcacgtcggtcgtgccgcgcacgtacgacaatccgttttcgggcgcgatcagcgccccacgccaaggtctgctgccatgaatgtctccgtccgtttttgtctgaccggcccgacatgcggctcacgcgtgtctgctccgccgccgtcgcgacggatagcctctccgggatgatgccgtgcgcggctgacgacactctgacatcgaattactgcggacgggtgaaatagcacgaccggacggtatgatccgacccgtaaaaacagacgaaaccgacggccgaaaaagcagcccgaaggctgctttctttcgcgggatacgcggcgcggctcagtgccggctgcggatcttcgccagacgctggatcgcttcgagctgcgccatcgcggtcgcgagctcggattgcgccttcgcaaggtcgagatccgacttcgcgttctgcagcgtttcctcggcacgcttgcgtgcttcctcggctttcgccgcgtcgaggtccttgccgcggatcgcggtgtcggcgagcaccgtcacggcacccggctgcacttcgagaatgccgcccgcgacgaacacgaattcgtcgttgccgccctcgacttcgatgcgcaccgcacccggacgaatccgcgtgatcagcggcgtgtgacccggcagaatacccagctcacccgtttcgcccggcagcgcgacgaatttcgcctcgcccgagaagatctgctcttccgcgctgacgacgtctactttgatggttgccatatcgactcctgtcgatcggaacgagcgcttcagcgcctgctccgatcccatgcacggcgggttgagcgtattacgtgagcgcctgtccgcgaacggataccatcaaggtatccctcacggacgtagcggcgcccgctgcgttacgcctgacccttacgagatcttcttggccttttcgaaggcttcgtcgatcgtgccgaccatgtagaacgcctgttccggcaggtggtcgcactcgccgtcgacgatcatcttgaagccacggatcgtttccttcagcggcacgtacttgcccggcgagcccgtgaacacttcagcgacgtggaacggctgcgacaggaaacgctggatcttacgcgcgtgcgaccgacagcttgtcttccggcgacagttcgtccatgcccagaatcgcgatgatgtcgcgcagttccttgtagcgctgcagcgtctgctgaacgcgacgggtgatcgagtagtgctcttcaccgatcacgttcgggtcgatctggcgcgacgtcgagtcgagcgggtcgaccgccgggtagatacccagcgaagcgatgtcacgcgacagaacgacggttgcgtccaggtggccgaaggtcgtagccggcgacgggtcggtcaagtcgtccgcagggacgtacacggcctggaccgacgtaatcgagcccttcttggtcgacgtgatgcgctcttgcagcttgcccatttcttcagccagcgtcggctgatagcccactgccgacggcatacggccgagcagtgccgacacttcggtaccggccagcgtgaaacggtagatgttgtcgacgaagaacagcacgtcgaggccttcgtcacggaagtgctcggccatcgtcaggccggtcagcgcgacgcgcagacggttgcccggcggctcgttcatctggccgtacaccagcgcgaccttgtcgagaacgttcgagtccttcatttcgtggtagaagtcgttcccttcacgggtacgctcgcccacgcccgcgaacacggagtaaccgccgtgctccttcgcgatgttgttgatgagctccatcatgttgacggtcttgcccacgccagcaccgccgaacaggccaaccttgccgccctttgcgaacgggcagatcaggtcgataaccttgatacccgtttcgagcagttcggtcgacggcgacagttcgtcgaacgccggagccttctggtggatcgaacgcgtcgtttcgctttcgatcgggccggcttcgtcgatcggacggccgaggacgtccatgattcggccgagggtcggcttgccgaccggcaccgagatcggctttgccgtgttcttcacggtcaggccgcggcgcaggccgtcggatgcacccagacaaatggtacggaccacgccgtcgcccagctgctgctggacttcgagcgtcagttccgagccatcgagaatgagcgcgtcgtagatcttcggcatgctgtcgcgcgggaattccacgtcgataacggcgccgatgcactgtacgatcttgccttctaccaaagcagcagtactcatcgcttttcctttaaatacctgattctttactcgcgcaaaggcgcagttgtcgtccgtggcgcgcgcttaaacagcggctgcgccgccgacgatctccgacagttctttcgtgatcgcggcctggcggctcttgttgtacacgagctgcagttcgctgatcaccgtcttcgcgttgtcggacgcggccttcatcgcgaccatgcgcgccgattgctcggacgccatgttttccgcgacggcctggtacaccagcgcctcgacgtaacgcacgagcagttcgtcgacgactgcctgcgcgtccggctcgtagatgtagtcccacgacgtggccggcgtaccgtcatcggcttcgaagtgttccgacgacagcggcagcaactgctcgatcacggcttcctgcttcatcgtgttgacgaagcgcgtgtaagcgatataaaccgccgacagcttgccttccgagtacagatcgagctgcgtcttcacggcgccgatcagcttgtccagatgcggggtgtcgccgaggtgcacgacctgcgacatcaccttcgcgccgaagcggttcaggaacccgaggcccttgctaccgatcgcggtggcttcgaccttctggcccttctcttccagctccttgaacttctgaaccgtcgcacgcagcacgttggtgttcaaaccgccgcacagacccttgtccgtcgtgacgagaatgatgccggccgtgttcgcgccttcgttcgccaccatgaacgggtgacggtactccgggttcgcgcggctcatgtgcgcggcgatggcacggaccttgtccgcatacggacgagcggcgcgcatgcgttcctgcgcgcgacgcatcttcgatgcggccaccatctccatcgccttcgtgatcttgcgcgtgttctgcacgctcttgatcttcccgcgaatttccttcattccagccatagcttgctccttgaccgaagcggcgcgggcgcatcagcacccgcgcggcctcagtgtgtcactcgcggatcaataggcaccggacttcttgaaggattcgatcgccgagcgcagtgcgccttcgtcgtccttcgagagatccttggtgtcttcgatgcgcttgatgaggtcagcgtggctggtcttcaggtattcgcgcaggcccttctcgaacgacagcacttgcttgacgtcgaggtcgtcgaggtagccgttgttcgcggcgtacagcgacacggccagttcccagacctgcagcggctggtactgcggctgcttcagcagttccgtcacgcggcggccgcgctcgagctgcttgcgggtcgcttcgtcgaggtccgatgcgaactgggcgaatgccgccagttcacggtactgcgcgaggtcggtacggataccgcccgacagcttcttcacgaccttcgtctgagcggcgccaccgactcgcgacaccgacacgccggcgttgattgccgggcggatgcctgcgttgaacaggtcggtttccaggaagatctggccgtcggtaatcgagatcacgttcgtcggaacgaacgcggtcacgtcgccagcctgcgtttcgatgaccggcagtgccgtcagcgagccgctcttgcccttcacttcgccgttcgtgaacttctcgacgtactcttccgacacgcgagccgcacgctcgagcagacgcgagtgcagatagaacacgtcgcccgggtacgcttcacggcccggcgggcggcgcagcagcagcgagatctgacggtatgcccaggcctgcttggtcaagtcgtcatagatgatcagcgcgtcttgaccgcggtcgcggaagtattcgcccatcgtgcagccggcgtacggtgcgaggtactgcatcgctgccgaatccgaagccgaagcggcgacgacgatcgtgtattccatcgcgcccgtttcttcgagcttgcgaaccacgttcatgatcgacgaagccttctggccgatcgcgacgtagatacagatcaggtccttgcccttctggttgatgatcgcgtcgagcgccaccgcggtcttgccgcactgacggtcgccgatgatcagctcacgctggccacggccgatcggtaccatcgcgtcgatcgacttgatgcccgtctgcaccggctgcgacaccgacttacgccagatcacgcccggggcgatcttttcgatcgcatcggtcagcttcgcgttgaccgggcccttgccgtcgatcgggttgccgagcgcgtcgaccacgcggccgacgagttccgggccaaccgggacttcgagaatgcggcccgtcgtcttgacgatgtcgccttccgagatgtgttcgtattcgccgagaatcaccgcgccgaccgagtcgcgctcgaggttcagcgcgaggccgaacgtgttgcccggaaactcgagcatttcgccctgcatcacgtccgacaggccgtggatacgcacgataccgtcggtcacggagatcacggtgccctggttgcgaacgtctgcgctcgcttcaaggccctggatccggctcttgatcagctcgctgatctcagagggattgagttgcattattcgctcctgatagtcaattctgttgcgtgccggcgtggcgctcaggcggtcaaggcagcctgcatcgatgcgaggcgcgcgcgaaccgaggtgtcgagcacttcgtcgccgaccgtcacgcgcacgccgccgatcagcgacgaatcgacttcgaccgtcggtttcagcttgcgcttgaacttgcgttcgaggcccgagacgagactgtcgagatccgcgccgttcagcgggaacgcgctcacgatctcggcgtcggcggcaccttcacgttcgttcttgagcgcctcgaactgctcggcaatttccggcagcagcgcgatgcgatgattgtcgaccagcatctgcacgaagttcttcgcttcggcgccggccgcgagcggcgacttcgcagcagcaagcagcaactcggctacttgcgtgcgcgtcaccttcgggctcgacgcgaccgacagcacttccggcagacgcgcaacctgggccagctcttgcacgagcgtggaccaggcggcgatgtcaccgccctcggccacgcggaacagcgcttctgcgtaagggcgggcgatggttgcaagttcggccatgatcagagctcggctttcagttgattcagcagttgggcgtgggccgtttgatcgacttcgcgcttcaggatctgctcggcgcccttcacggccagcgtagcgacttcgccacgcagcgcttcgcgcgccttcacgatttgctgttctgcttccgccttcgcctgggcgacgatgcgggcggcttcagcctgggcgttggccttgatttcctcggcgaccgcctgggcacgcttttcagcgtcggcgatgcgctgctggccgtcattgcgggcctgcgcgagttcctggtccacgcgcttgtgcgctgcgtcgagttctgccttgcccttctcggcggcggcgaggccgtcggcgatcttcttcgaacgttcgtcgagggcgttgatcaacggcggccacacgaacttcatcgtgaaccacgcgaggaccaggaacacgaccatttgcgcaaacagagttgcgttgagattcacggtgtttccttatctgctattccggaaaaatgaaacggtaaggcgctcatcgagttgcattcgatcagcgccccaagtctccgttccgccctgcgccggctcacgccggacgcatatttccgaggaaccttagcctgcgacgagcttcgacaggagcgggttcgcgaacgcgaacagcattgcaacacccacgccgatcaggaatgccgcgtcgatcagaccagccagcaggaacatcttcgtttgcagcgggttgatgagttccggctgacgtgcgcaggcttcgatgtacttaccacccatcagcgcgataccgatacaggcgccgattgcacccaggccgatgatgatgccgataccgatggcggtcagaccctggatgttggcgatgtaagcttgcatgatcactcctttgtgaaaagacttggaactgagatttaaaaactaaaacggaaactctttttgcacgccgcgcttagtgcttgtcgtgcgcctggccgagatacaccagcgtcagcatcatgaaaatgaatgcctgcaacagaacaatcaggatgtggaagattgcccagacgctgcccgcgatcacgtggccaacgaagccgaggaacgttgcgtcgccaccgaagctccacatgctgccgagcagggcgatcaacaggaacaacagctcacccgcgtacatgttgccgaacagccgcataccgagggagacggtcttggcgagatattcgacgatgttgagcgcgaggttagggatccacagcagcgggtgggcgccgaacggtgccgacagcagctcatgcacaaagccgcccgcgcccttgatcttgatgctgtagtagatcatcaggacgaacacgccgagcgcgatgccgagcgtgccgttcaggtcggccgtcgggacgatgcgatggtgggaaatcacgtccgacagaccgagcaggccgatcacgcggcccggcaggtcgaccgggaggaagtcgagggagttcatcagcgcgacccacacgaacaccgtgagcgcgagcggagcgatgaaggtacgattgccgtgaacgatggccttcgattggtcttcgaccatctcgacgagcatctcgatcgcgcactggaaacggcccggcacgcccgacgtcgccttgcgggcagccagacgcagcaggacgatcgtcacgatgccgcaaacgatcgaccagaacagcgtgtcgagattccagacgtggatgtcgaaaatcgacgtctgatgcgaggtggagaaattctgcaagtggtgcgcaatgtactcggacggatccggaccgcgcgtgccttcgctagctgccatatcgttaatgccacccaaattgtcgaaaatcgttttgccagttccgcaacacgctattgcgggaacgggccggcgcggttcgttgtcgaaaccgcacgctgcttgttccttaccgccaggccagtgcgatccagtacgtcttcagcacgacgaggtacgtgacgaggaacggcacccagtgcacgccggcccagccgaacgccactgcagtgaacatcccgatcgtcagagcgagcttcagggcttcgcccatcacccagctcatcacggtggccgaaccacctgccttcagtcgtgccacgaataccgcacttggcacccagccgatcgctccgcccagaaacgcggattgcgcagcggcgcccggcgacttcgaaaacagccaccacgccagcgttgcaaccagggacagaaccacttgcgcgaataccaccttataggagtcacgcgcgagggcttgctcacgttcgggccgaacagcttttcggcttctgcccgcgtgagcggaacgatgttgttatcttgctgctcggcgtcccagtcatcgtcggattcgcgccgctcgccggccgccgaagcggtgcgttgcgtgcgctgatcatcgtgcctgtcgtccggcgcctgacccgccatcgcaatcttccgcaaaatccttgaacccggccccaagctttctgaaagctttcaggggtgcctagctaacaaatccgggcgattgtaagcgatagttgcaagtgattcaaggctttagacgcgacaaaaacctgcgtaaaacgacgcctcatcatgtgaaaaacacgcgattcgacgacgtacgatgacagttgtaaggtcgctttttgcgccggtatttcttgctcgaaaaatccggcgacgaggaaatgacaaggaaacgaggcccgatgcgggtgccggcgggacggctcgaacgccatccggaatccacgccgtgacgcggccccgggctcgcgccaagcacgaagcgccgagcacgaaaaacctgtgaccaccccgcggcaccggatgcccgaaatcggggccgacgtcgacgcgtcgaatcatccaatcagttgtcatgccaccacaggcgatcgactgtgaattgccggacttatcaacagccccgcaaccagcgcgaatactgtgcacctgccccgccacccgaatcgcacggctgtgccgcgcgcagccgcgtcactcaaccgtgaacgagcagccacgcaccgaccgccgcgctggcgagtgcgaacggaatcgaaaccagatggaacggcagccacatgcgcggctccttcgcgagacgcaccgcgatcaggttcgcaagcgagccgatcgcgaaaccgaagccgccgaccgatacgccgaacgcgagcgcacgccagtcgtgcgtgaattccgacagcaggatcgcggccggtacattgctgatgacctgtgacaacagcgcgccggccgcgtagacgcgcagcggcgaatcgagttgcgcattcgcaatcgtgtcgtgcacgacgggcagcgcagccgcggtacgcagcacgacgaacatcagtacgaagatcagcagcagcagccagtcgatcttcaggactgcgtcgcgtttgacggcgagcagcacgatggcgacaccgacgagaccgggcagcggatgatgcgcatcggcgagcagcacgaacgcggcgaacagcaccgccgcgatcagcgcgtgcatgcgttgcacgggcagcgctgtgacatcgccggacaagtcgagcggctttgcgcgaaacgcgcatgcggtcagcacgagcagcagcgccatcagcgcgatcgcgagcggcccgagcgtgaccacgaagcggccgaacgacgcaccgctcaattgccacaggaaagattctgggattgccgagcggcgtcgcgacggaccccgcgttgaccgccagcgcgacgacgatcacgagccgccggaacggcagtggcgtcagcgcacgcagcgagaccatcaacggcacgacgacgaacagcgcgacgtcgttggtgagccacatcgacaacaacgcggcgaaccctacgagcaacaacgcgagcccgcgttcggaatgcacgtgatgcacgatgcggtgtgcgagccacatcaggcagccggacaactcgagcgccttggtcagcatcagcaggcccgccagcgtcgcgaccgtctgccagtcgacgcgaccggccaacacggaaaatggttgcggacgcacccattgcagcacgatcaggccaagtacaagaaccgacagcaccggctcctgcgcaagccatcccagccaccggcgcggcgtcggcgcgcccgtcttctccatcggcaccgcgttactcttcggtcgcgacgttgccgcgcagccgcacgagaatgccctcgagcgcgtcgaggttgccgaagtcgatcgtgacctgccctcgtccgcggcggccaagcttgatcttcaccgtcgacgcgagcaggtcggacaactcctcctcgagacggcgcgtatcgcgcccgccgtcgtccttcgcgcgcgccttcacggccggcgcttccttcgtcgtgtgcgtgacgagcttctcggtctcccgcaccgacatgcgcttgttgacgacctggtgggcgagcgtgatctgcgtggccgcatcgacggcgagcagcgcgcgcgcatgccccatgtcgagatcaccggccagcagcatcgtctgcaccggcgaagccaggttcagcaggcgcagcaggttcgacaccgcgctgcgcgaacggccgaccgattcggccgcctgttcgtgcgtgaaaccgaactcgtcgagcaggcgctggataccgtgcgcctcttcgagcgggttcagatcctcgcgctggatgttctcgatcagcgccatcgccgcggcagcctggtcggacacatccttcacgagcaccggcacttcatcgaggcccgccaggcgtgccgcgcggaaacggcgctcgcccgcgatgatctcgtatttgtctgacgaaatgggccgtaccaggatcggctgcatcacgccctgcgcgcgaatgctcgccgcgagctcctgcaggctgccttcgtccatccgcgtccgcggctggtacttgccggcctgcaacttgccgagcgcgagcgtgttcggtgccccttcgatcttcaccgcttcggtgatatcggcactgccgccgagcagcgcttcgaggccacgtcccaagcccttcttctttggtaccgcgttcatgtctttcttcctcgcttcgctcatgtccggatcacgacacctcgaacgcgcgaacgcggtcgatcatctcggcaccgaactggagatacgcttgcgcaccgcgcgagctgcggtcgaacacgacgcccggcagcccgtaactcggcgcttccgccaggcgcacgttgcgcggaatcaccgcgtcgaacaccttgtcgccgaagtgcgctttcagttgatcggagacttgctgctgcagcgtgatgcgcggatcgaacatcacacgcagcaaaccgatgatcttcaggtcgcggttcatgttcgcgtgaacctgcttgatcgtgttgacgaggtccgacaacccctccagtgcaaagtattcgcactgcatggggatcacgacgccatgcgccgcgcacaagccgttcagcgtcagcagcgacagcgtcggcgggcaatcgatcagcacgaaatcgtaatcgtcggccacgtgctcgagcgcggccttcagccggcgctcgcggttgtcgatgctgatcagttcgatctcggcaccggacagctcgcggttcgcgggcagcacgtcgtaggtgacgccgtccggccggatgcgcgcgtcggtcaccgacacgccgtcgaccagcacctcgtacacggtcgcttcgcaagcagccttgtcgatcccgctgcccatcgtcgcgttaccctgagggtcgagatcgatcagcaggactcgttgctcctgcgctgcaaggcttgcggcgagattgaccgatgtcgtcgtcttgccgacgcccccttctggttcgcaacgcagaagatctttgccatcgttggtgtgttccctttaccttcaaacaaacggcgcgccatcgcgcgccggcccttcaattcgcttcgtcgacggccacttcgatcagatgccgttcggcatcgagcaacggcaccgccagccgtatcgtctgcttcacgcggctgccttccggcaaccgcgcaatctcgtcgtccggatgaacgcccttcattgcccagatcgatccgcccggcgcaaccaggtgtcgagcaagtttaacgaagtcggacagatccgcgaaagcgcgggatacgatcatgtcgaatttttccggcacttcgacacccggctgcagcgattcgacccgccccgtgaccaccgacaggttcgcgagcttcagctccgcacgcatctgggtctggaatgcagacttcttctgcacgatatcgttcagcgtgatctgccaatccggctcgacgatcgccagcacgataccgggcaatccgccgcccgagccgacgtcgagtacgcgggccgatgcacggccacgcagatgcggaacgatggaaagcgaatcgaggatgtgctggatcagcatctgcttcgggtcgcggatcgcggtcaggttgtagaccgcgttccacttgccgagcagcgcgacatagtcgagcagctggttgtgttgtgcatccgtcagcgtgaggtcgagcgccgtcgtgccttcgacgagcatctgttccagtacgtcccgattaaccgccggcgcgcgacgcgccgtcattgttgcgtcgggacggcgccgtcccctgctccgctgccgcttcggccgtgccattacggcggcccaggccgcgacgcttcaggtgcaccatcagcagcgagattgccgccggcgtgacacccgagacgcgcgacgcctgcccgatcgtttccggtcggaactcgttgagcttctggctcacctcgaacgacaggccgcggacttcgcggtaatcgataccgtcgggcaggcgcgtgttctcgttcgcatcgttgcgttcgatttccgatgcctggcgctcgatgtagccctgatacttgatgccgatctcgacctgctccttgatctgctcgagcagcaccggatcgtcggccagcggctcagcggggccgcgctcgccgcccttcagtccgcacacaccgtcgtagctgatacccggacggcgcagcagttcggcgaggctgtattcgtggtcgatcgccttgccgaggagcgcggtcgcctcttccgacggcaacgtcttcggcgtgacccacgtcgacttcaggcgttcggtttcacgtgaaacagcgtcgcgcttccggctgaatgcgtcccaacgtgcgtcgtcgacgagccccagttcgcggccgatctcggtcaagcgcatgtcggcattgtcttcacgcaggctgaggcgatactcggcgcggctcgtgaacatccggtacggctcggccacaccgcgcgtcacgagatcgtcgaccagcacgccaaggtaggcctggtcacggcgcgggcaccatgcgtccttctcctgcacgtagcggccagcgttgagaccggccagcagaccctgcgcggccgcttcttcatagcccgtcgtcccgttgatctggcccgcaaagaacagcccgttgatcgccttcgtttcgagcgacgccttcagcgcacgcgggtcgaagtagtcgtactcgatcgcgtagccggggcgcaggatatgcgcattctcgaggccgcgcatcgagtgcacgagctcgagctggacgtcgaacggcaggctcgtcgagatcccgttcgggtagaactcgttggtcgtcagcccttccggttccaggaagatctggtgcgattccttcgaagcgaaccggtgaatcttgtcctcgatcgacgggcaatagcgcggcccaacgccttcgatcacgcctgtatacataggcgaacggtcgaggccgccacgaatgatgtcgtgcgtgcgctcgttcgtatgcgtgacccagcacggcagttgctgcggatgctgctccgcacggcccaggaacgagaagacggggatcggatcgagatcgcccggctgttcatccagctgcgagaagtcgatcgagcgaccatcgatacgcggcggcgtaccggtcttcaggcggccctgcggcagcttcagctccttcaggcgcgatgacagcgacacggccgccggatcgcccgcacgaccacccgtatagttgttcaggccgacgtgaatcttgccgtcgaggaacgtaccggcggtcagcacgaccgcacgcgcacggaagcggatgccgatctgcgtgacggcgcccaccacgcggtcgccttcgaccatcaggtcgtcgacagcctgctggaacagccacaggttcggctgattctcgagccggtggcgaatcgcggccttgtacaggatgcgatcggcctgcgcacgcgtcgcgcgcacggccggccccttcgacgaattgaggattcggaactgaataccgctctcgtcggtcgcggctgccattgcgccgcccagcgcatcgacttccttgaccagatgccccttgccaatgccgccgatcgacggattgcagctcatctgcccaagcgtttcgatgttgtgggtcagcagtaatgtctttgcgcccatgcgggcggacgccagcgcggcttccgtgccggcatggccgccaccgacgacgatgacgtcaaattctgtgggaaaaagcatggtggattccgtacgcaggacggcgcacgaacctatctgagaaatgtatgggccgaattatagcgggttcgcttttcacccgaaggccatccgaatggtagggtctgtgcatttcggcgatttttctgtgctcggccgcggaatccgtggcgcagagcccgctccggcaacgcttccggcccgccggcagcacatcgttgggcctgtgcaaaaaaattcgcttgccgggaaatttcacgtggaacacatacccgttcgatgcctgtgccccgcgcggcaacctggacggaacaccctgtgcgaccgcgcccgccctctccttcacagaatttcgggcagttcgctcgacacttatcccctgtgacccggcacaacatccccagtgtgtgaaacaggcggcagccacccgcgaacgatgctccggatcgtcatccgcttgcacagagcgtccgactgtttccttggcacttatccccggccgctagccgtcgcgtgtcggggtcacatctcacccaaaaacaaaaacggcgtgtttcacgtgaaacacgccgcccgttccgcccaccacaccaccgatcaggccgttttcttcgccaacccgaggtacgtctcgatcacgcgtggattctgcgcaagttcggccgccggcccttccagcgcaaattcgcctgtctccagcacatagccgtaatcggagatctgcagtgcagcccgggcgttctgctcgatcagcagtgtcgccacgcccgtcccgcgcaacgcgctgatgatatgaaaaatctccttcacgatcagcggcgccagctgaggctcggctcgtcgagcatcagcagatcgggcttgcccatcagtgcgcgtccaaccgcgagcatctgccgctcgccgccggatagcgtgccagccgcctgcttgcggcgctccttcagccgcggaaacagggcgaacacatgatcgagctggtcgaggaagttcgcttcaccggcctgcttgcgccgatacgcgcccaatacgaggttgtcttcgaccgtcatcgtgctgaacagctcacgcttttccggtacgaggcacatcccgcgtgcgacgcgctgttcgaccggcaatgcaccgacgtcgtgaccgcggtacacgatcgcacccgatgcatgcccggtcaccggcagcgcgcccatgatcgcgttcagcagcgtcgatttgccggcgccgttagggccgatcacgctgacgatctgccccgcgccaaccttgatcgccgcgccgtgcagcgcctccaccttcccgtaccggaccgccagcccgcgcacttcgagaatcggcatcgtcgtgtccgtcatcactccaccccgcccagatacgcttccagcaccgccggatcctgctgcacgtcctgcggcagtccttccgcgatccgcgtgccgaactccatcaccaccaaacggtcggtgagattcatcacgaaatccatgtcgtgttccacgagcaacacgctcatgccttccgccttcagccgtcgcagcagctcggcgagttgctgcttctcctggtaacgcagcccggcggccggctcgtcgagcagcagcagcgtcggatcgcagcacagcgcccgcgcgatttcgagaatccgctgctgccccagcgcgaggctgcccgcttcgtcgtacatgtgcttttcaagcccgacgcggcgaatctggcgtgcggcctcggccagcagctgcgcttcctcatgtgcattgagccgcgcgacgctgcgccacacgcccgtacggccacgcaggtgcgcaccgatcgcgacgttctcgagcaccgtcatcgccggcaacagcttcacgtgctggaacgtccggccgatgccgcggcggacgatctggcgcgatgtgagcccgtcgatacgctcgccacggaacgtgatcgtgccacctgtcggcttcagcacacccgtcacgaggttgaacgtggtcgacttgccggcgccgttcgggccgatcagcccgatgatctgccccgctttcacgtcgaagctgacgtcgttgacggccacgagcccgccgaactgcttgcgcgcattgtcgacgacgagcagcggctcgccggccgtcggcttcgcgcgctgcggcaacggatccgcgtgctcgggcacatgcgcgcgcggcccacgcgggaacagcctcgcgacgaacggccacacgccctgacgcgcgtactgcagcagcagcaccatcagcacgccgaacacgatgatctcgaagttgccttccgagccgagcagcttcggcagcagcgtctgcagatagtcctgcagcacggtcaggatcgccgcgccgagcaccgcgccccacacgtgcgacacgccgccgaccacggccatgaacaggaactcgatcccgtggttcagcccgaacggcgtcgggttcaccgcgcgctgcaggtgcgcgtacaggaagcccgatacggccgcgagcacggccgcatagacgaagatcacgacgcgcatccacgcggtattcacgcccatcgcctcggccatcacgccgccgccgcgcagcgcgcggatcgcacggcccgggcggctgttcagcaggttctgcaccgacacgatcgcagccagcacgacggcccagatcaggaaatacaggctgcgcccgcttccaagctcgacgccgaacaggttcagtgccggaatcccgttgatgccgtcgtacttgccgagcagttcgaggttgccgaacaggtagaacagcgcaaggccccacgcgatcgtgccgagcggcaggaagtggccggacagccgcatcgtgaccgcgccgagcacgagcgcgacgagcgccgtcagtacgacgccgacgatcagcgcgagccacggcgacacgccgtatcgcgtcgtcaggaacgcggtcgcataggcgccgatgccgacgaacgcggcctgcccgaagctcgtcatcccgccgacgcccgtcagcagcacgagcccgatcgcgacgatcgcgtagaggccgatgtagttcagcagcgtgatccagtattcgggcacctgcagcgcaccaggcagcaccggcagcgcgaacagcaccacgagaaacacccagaaggtcttgttgcgtaccatcgtcttcatcgtgtcactcctcttcctcttccgcgtgcggcgtcgcgaagctccgccacagcagcaccggaatgatcagcgtgaacacgatcacctccttgtacgcgctcgcccagaacgacgaatacgattcgagcacgccgacgagcagcgagccggcggccgcgagcggatagctgacgagcccgccgatgatcgcgccgacgaaacccttcaggccgatcaggaagcccgagtcgtagtagatcgtcgtcagcgggccgacgaggatcccggacagcacgccgagccccgccgcgaacgtgaacgcgagccgccctgcctcggtcgtgccgatgccgacgagccgcgcgccgagccggttcaccgacgtcgcgcgcagcgccttgccggcgatcgtgcggccgaagtacacgtagagcgcaccgatcagcacgagtgccgtcacgacgaccaggatgctctgcaccgacacggtcatgctgccgatcgcgagcgacgcatccgagaacccgttggtgcgcgaaccttccgcgccgaacatcacgagcccgaggccgaccatcgcgaagtggacggcgaccgacacgatcagcagcagcagcgtcgtgccttcggcgatcggctggtacacgagccggtagacgaacggccccatcggcacgacgatcgcgagcgtcagcgcgatctgcgcgagcatcggcagcggctgtgcggcaaagctgcgcgtgatcgcgaacaccgcgagcggcagcaggacgtagcggctgccgagtgtcgcgagtgtgcggccgagctgatggcgacgttcgcgatgccggatcaggccgccgacttcgagcaggaagcacgcgatgcccatcacgaacaacagccagcaggtggcgggaaatttctgcgcctgcaacgcggcaagcgtcagcgcaccgtaggcgacgaattcgccctggggaatgaagatcacccgcgtgacggaaaacaccagcacgagcgccagcgacagcaatgcatatatggcgccggtcgtgatgccgtcttgcgcgaggatcgctgcaatcgagagatccatacgtttcgtgtatcgagaatgctgcggagaaacgaaagacggaaacggccggggcgcgcggacggcaagaccggtgcgcaggcacccggcgacgggccccggcggttccaggcggcatgggcgcgacccgtcgggccgcgcaccctgccgacggcacgcacggcgccgttcgcgccgcgcacgccggtttcacgtgatgcttactcggcctgcagcttccacttgccgtcgacgatctgcaccatcacgcgcgcacgcgtatcgaagccgttgtgatcggtcggcgtcatgttgatcacgccgtgcgacacgggcaggtccttcacgctttcgagcgacgcgcgcagcgcttcgcggaacgcctcggtgcccggctggcccttcttcagcgcttccggaatcgcgcgctgcagcagcagccccgcatcccacgcatggccgccgaacgtcgccagcgagcccgcgccgtaggccttctcgtacgcggccttgtacccgagcgccggcttcttcaccggattcgaatcgggcagctggtcggtcacgagcaccgggccggcaggcaggatctcgccttcgcagtccttgccgcacacacgcaggaagtcgttgttcgcgacgccgtgcgtctggtacaccttgcccttgtagccgcgctccttcagcgtcttcgccggcagcgccgccggcgtacccgagccggcgatcagcaccgcatccggattcgagcccatcagcttcagcacctgccccatcaccgacgcgtcggtacggttgaagcgctcgttcgacacgaccttcaggccgttcttcgcggccgccgcgttgaacgtgttgtaccagctgtcgccgtacgcatcggcgaagccgatgaagccgaccgtcttcacgccgtgcttcgccatgtagccggcgatcgcgtcggccatcagctggtcgttctgcggcaccttgaacatccaggcgcgcttcgcatccatcggcgagatgatctgcgcgctcgccgcgagcgagatcgtcggcgtcttgccctgcgacacgggatcgagcatcgcgagcgagttcggcgtgacggacgaaccgatgatcgcgtcgacgtgatcctcgtcgatcagcttgcgcacgttctgcaccgcgcggctcgtgtcggatgcgtcgtcgagcacgatgtactgcacgctcttgccggcgatttccttcggcagcagcgcgatcgtgttcttttccggaatcccgagcgacgcggccggcccggtggccgacagcgtcacgccgatcttcacctgcgccgacgccgtggcggccgcgcacacgaggcccgcggcaagcagaacttccatccatcgattcatcttcatttatgtcgtctccaaacgctgctcgaaagccacgggtcgctcgggcggctcccggtctccaaacaagttaataatttaactatctcgccttgccccgcctacactcgttttcccgtgaaacgccggcgccgccatcgatccccggcgatgccgcacatgcacgcgccgcagcgcgtgccgaaacggtcgttcgaccgccacgatgcgcggcggcaatgtcgtcaggatgaaggaaacggagaaaggcggcgctgtgcgaaacgcgatcgatgcgggcgcaacgatcgccggaaggtcggccggccggacctgatacggctccatgcgcgggcaatgcaggatcggaaaaacggccgttcatgcgaatgcgaacgacgcatcggatgcgaacgcaacgaccggacagaccatcgtgccggcaaattgcatcggaacgcacatgccggccgcagagcggctcgtgaaagccggggcataccgatgcatgtccgccccgaacgagcggcgccagccgccctcccgtcccgatccttcgtcccgcgcttctcatccaaccgcactccctcttctgcattttgcttgtaggagaactgccgaccgttttcccgaccgcacggtcggcgaaagctgagtgtaacggacgcttttgcgcacgccaaccgggtaagcccggacggcatgcgcacggctgcgccggcggcgatcgaccggaaggaatggatgaaatcgggggacgagatgacgcgcgagtgacgcgaggcagaacacgggcgcgcggaatgcagcgcggttcgcctgcaccatcgatgaaaattcgtgcaccaaatgaaaaagcgctgttggattccgtccaacagcgctttagggtccgggcactttgtgcctcgattgtctcctcgttctccacctgcaaattcgtttcgcggtgcatcagaactagggtgaatcttaaagaggcttaagcaccacggcaacttagcatttacccctatggtgcatcgccgcacgaaaatggggcagcagccagccgcgcggtgccgccccgagcgcgctgcgacgcgcttcacgagcatgccggatggtgcttcgcatcaaccggcggcgacgtgcgcggcatgcgctcaggaggccctgagcggcttgatccgcgcgaccatctcgccgacgatgccgcgccggaacgcgagcacgcacacgatgaagatcagccccgtgacgatcgtcgccgattcgccgagcgaatggaaccatgcgacgcccgtcgccgatgcgagcccttcgccgatgtcgccgagccggtcttcgagcgcgacgatcagcgccgcgccgagcagcggcccgaacagcgtgcccatcccgccgacaagcgtcatcagcacgaccaggcccgacatcgtccagtacgcgtccgacagcgtctcgaagccgagcacgagcaccttcagcgagccggccagccccgcgatgcccgccgacaggatgaacgcgagcagcttgaaacggtcggtgtcgtagccgagcgagatcgcgcgcgcctcgttctccttgatcgcgacgagcacctggccgaacggcgaatgcacgacccgcacgatgaacgcgcacgcggcgacgaccaccgccaccacgacgtagtacagcgcgacgtcgttcgacaggtcgagcagcccgaacaggtgaccgcgcggcacgccctgcaacccgtcttcgccgtgcgtgaacggcgcctgcaggtagatgaaatagaccatctgcgcgaacgcgagcgtgatcatcgcgaagtagatgccctgccggcggatcgcgaacagcccgacgacgagtccgagcagcgtcgcggcaacggtgccgacgagcaccccgagttccggcgtgaagccgagcgtctgcatcgaataaccggtcgcataaccggcggtcgcgaggaacatcgcatggccgaacgacagcagccccgtatagccgatcagcaggttgaatgcggccgcgaacagcgcgaacgtgagcaccttcatcacgaacaccgggtacgcgccgatgaacggcgcggcgagcagtgcggcaagcagcacgccgtagagcacttttctctgcatcatttttccttgccgaagaggcccgccgggcggaacagcagcacgatcgccatgatcacgaacacgacggtggccgacgcttcggggtagaacacgcgcgtgaaaccctcgatcacgccgagcatcaggcccgtgacgatcgagccgaggatcgaccccatcccgccgatcacgaccaccgcgaacacggtgatgatcatcggctgccccatcagcggcgacacctggatcactggcgcggccagcacgcccgcgaacgccgcgagcgcgacgccgaagccgtaggtgagcgtgatcatcatcggcacgttcacgccgaatgcctcgacgagcttcgggttctcggtgcccgcgcgcaggtaggcgccgaggcgcgtcttctcgatcacgaaccaggtcacgagacacaccgcgagcgacgcgacgaccacccacgcacggtagttcggcaggaacatgaagccgagattggtggcgccggacagctgcgacggcacgtcgtacggctggccggacgagccgtagatcgaccggaacacgccttcgacgaccagcgtgagcccgaacgtgagcagcagcccgtacaggtgatcgagcttgtacagccagcgcagcatcgagcgttcgatcaggatcccgaacgcaccgacgaccagcggcgcgatcacgagcatcgcccagtacggcagcccgaagtacgacaggcccatccacgcgagcatcgcgcccagcatgaacagcgcgccgtgcgcgaagttgatcacgttgagcagcccgaagatcaccgcgagcccgaggctcaggatcgcgtagaacgagccgttgacgagcccgagcagcaactggctcagcatcgccggcaacggaatgccaaagatttccatcgacttagccgtcagtatgagtttcgttgcgtgcgcaaccttctcgggatgcgcacgcgggcggcgcagcggggcacatcgctgcggccgccaccgtgcggcgcgcaactcgcgcgccgccaagccccgcttacttccacaacgcgcagcgcgattcctgcttggtcccgaacgcctgttcgcccggaatcgtcgcgagcaccttgtagtaatcccacggctccttcgattcagcaggcttcttcacttccatcaggtacatgtcgtggatcatgctgccgtccgtgcggatgtagcccttcgcgtagaagtcgttgatcttgatcttcttcagctcggccatcaccttgtcggaatcggtcgtgccggcagcctggaccgccttcaggtaggtcgtcaccgacgagtagtcggccgcctgcaggctcgacggcatcttcttcatcttgccgaagtagcgttgcgcccactggcgcgacgccgcatcgcggttccagtaccagctgtcggtcagcacgaggccctgcgtcgtctcgaggccaagactgtgcacgtcgtcgatgaacatcagcagcgcggcgagcttcatcgtcttcgtgatgccgaactccttcgcggccttgatcgagttgatcgtgtcgccgcccgcgttcgcgaggccgaggatctgcgccttcgacgcctgcgcctgcagcaggaacgacgagaaatccgacgcggacagcgggtgacgcaccgcgccgagcacctgcccgccgttcgccttcacgacgtccgacgtgttcttctcgagcgccttgccgaacgcgtagtcggcggtcaggaagaaccagctcttgccgccctgcttcaccaccgccgaaccggtgcccttcgcgagcgccatcgtgtcgtatgcgtagtggaccgtgtacggcgtgcactgctcgttcgtcagcgtgtcggcgcccgcgccgatgttgatgtagaccttcttcttctcggccgcgacctggttcatcgacagcgcggtggcggagttcgtgccgccgaccagcaggtcgagcccgccacggtccatccattcgcgcgccttcgacgcggcgatgtcggccttgttctggtgatcggcatacacgacctcgatcggcttgccgagcaccttgccgccgaaatcggcgaccgccatgcggatcgcctcgaggccgccctgcccgtcgatgtccgcgtaaagccccgacatgtcggtgatgaagccgatcttcacggtatccgcggcctgcgcggcgccggtggtgaacgcggccgccgcgagcgcgagacaggcgtgtgcgagggtcttcattttcattgacgtctcctgttgttctgatgcgttgtggttgttcgaagccgccacggctagcggcgaaagagacggggcggcgtcacaccccgagcaggtcgtgcagggtcggcatcttgctttccagttcggccgcctggaaatgttcgacgatgctgccgtgctccatcacgtagaaccggtcggcgagcggcgccgcgaagcggaaattctgttcgaccatcacgatcgtgtagccgcgcgccttcagcgcgacgatcatccgcgccagcgactgcacgatcaccggcgcgaggccttcggagatctcgtcgagcagcagcaggttcgcgccggtgcgcaggatccgcgcgaccgcgagcatctgctgctcgccgccggacagcctcgtgccctggctctgccggcgcgacgcgaggttcgggaacatcgtatagatctcgtcgatcgacatcgcgtgatcgcgcggcccgatcggcggcggcagcatcaggttctcctcgcacgagaggctcgagaagatcccgcgctcctccgggcagtagccgacaccgaaatgcgcgatgcggtgtgtcgcgaggccgatcgtctcgttgcccgcgaccttgatcgacccgctgcggcgacccgtgaggcccatgatcgcgcgcagcgtcgtcgtgcggcctgcgccgttgcggccgagcagcgtgacgacctcgccgcgatgcaccgtcaggtcgacaccgtgcaatatgtgggattcccgtaccaggcctccaggcccgtgatctccagcgcgggcgtaccgctttcgacgccgctcaattcgcgttcctcccgttcgctgtgcttcatgcgtgcgcccccgcgagcgccgcgtcggcgctgcccatgtaggcctcgatgacgagcggattcttcgacacttccgcatacgagccttcggccagcacctcgccacgttgcaggacggtgatcgtgtcggagatgcccgcgatcacgttcatgttgtgctcgaccatcaggatcgtgcggccgctcgcgaccttcttgatcagtgcggtcacgcgatcgacgtcctcgtggcccatcccttgcgtgggctcgtcgagcagcatcagctcgggctccatcgcgagcgtggtcgcgatctccagcgcgcgcttgcggccgtatgcgagttcgacggtcggcacctgcgcgaaatcggtgaggccgacctgcgtgagcagatccatcgcgcggtcgtcgagccgcttgagcgtgcgttcgctgcgccagaaatgaaattcggtgccgagcgcgcgttgcaggccgatgcgcacgttctgcagtgcggtcaggtgcggaaagacggccgagatctggaacgaacggatgatgccgcgccgcgcgacctgcgcgggccgctcgtcggtgatgtcgatcccgttgaagacgatctggccggccgtcggcgtcaggaatttggtgaggaggttgaagcaggtcgtcttgcctgcgccgttcggtccgatcaacgcatggatcgcaccgcgacgcacacgcaggttcacgccgttgacggccgtgaaaccctgaattccttggtcagtccgcgtgtttccagaatcgtgtcgccgagaatcatgttcccttccatacgaagtcaggcgaagcaccgggaagattcgcgcgaagcggccgcgaaacacgtcagcggatgagcaggctgccccgggcgccgtgttacgcctcgagggtggtctcccgcgccgacgcgtatgcacactgcgccacattgtctcgccgttggtgcagtgcaatcatcgggatttgcacttatagggctggccgccatgtcgcgcgcggttgtgctcggtttttcgccacgtttttgacacgtgcatcatcgaccgttgtctcttcgcacggcgcggcaggcacgcagcaagaaagccgtgcggctgcacggcttgcatggatcttgccggtgaagcgacgcaatcgacacgatcggcaccggcagcttgtttcgcatatcgaatcagcgggcgtcatcatgacgccccgctgtcgtgcgtgtcagcgttccgtcacgcggccgtcgccgcgggctccgttcgcaccgtcgtcgcttcgcgcgccgcgcggcgatcggcacgaatcatgtcgctcgcgcgctcggcgatcatcagcgtcggcgaattggtattgcccgatgtaatgaagggcatcaccgacgcatcgacgatccgcagcccggcgatgccgcgtacgcgcagccggctgtcgacaaccgcacgctcgtcgtcggcccgccccatccggcaggtgccgaccgggtggaagatcgtcgtgccgacggcgcccgccgcgtcgatcagctcggcttcgctgcggtactgcgtgccgggcaggatttcctcgggccgataacgcgcgagcgccggcgcggacgcgatccggcgcgtgaggcgcaacgcgttcgcggcgacgtggcgatcgtggtcggtcgacagatagttcggcgcgattgcgggtgcgacacccggatcggcgctcgcgacatgcacgctgccgcgcgacgtcggccgcagatggcacacggacgccgtaaatgcattgaagctgtgcagcggctcgccgaaacgttcgagcgacagcggctgcacgtggtattcgagatcggggcgcgtgagtgccggatcgtcgggatcggatttcgcgaatgcgccgagctgcgacggcgccatcgacatcggcccacgctgcagcaacgcatattccgcgccgatcatcagcttgccccaccagtgcgcggacagcgtgttgagcgtgcgcacgccctcgacgcgaaacgccatccgcaattgcaggtgatcctgcaggttttcgccgacgcccggcagatcctgcacgacgtcgatgccgagcgcctgcagccgccggccgtcgccgatgcccgacagttcgagcagctgcggcgaattcacggcgccggacgtcagcagcacctccgagcgcgcccgcgcaacgtaatcggtgccgccgccgcgatattcgacaccgaccgcgcgccgcccgtcgaaaatcacgcgctgcgcgtgcgcgccggtgatcacggtcaggttcgggcgcgccatcgcgggccgcaggaacgccttcgacgtattccagcgcacgccgcgcttctggttcacctcgaaataaccgaccccggaattgtcgccgcggttgaagtcgtcggttgccgggatgcccgtctgctgcgcggcctgcgcgaacgattcgaggatctcccagcgcagccgctgcttctcgacgcgccagtaaccgcccgcgccgtgtgcgtcgctcgcgcccgcatggtggtcctcgctgcgcttgaagatcggcagcacgctgtcccacgaccagccggcgtcgccggtttcctgcgcccagctgtcgtaatcctcgcgctggccgcgcatgtagatcatcccgttgatcgacgagcagccgccgagcacgcggccgcgcggatacgacagcgcccggccgttgagcgccgcttcgggttgggtcttgtacagccagtcggtgcgcgggttgccgatgcaatacagatagccgaccgggatgtggatccagtgatagtcgtccttgccgcctgcttcgagcagcagcacgcggatgtcgggatcctcggtcaggcggttcgcgagcacgcagcctgcggtgcccgcaccgacgatcacgtagtcgaattcgccttcgagcgtgcgtggagtactcacggcgtgtccccttcttcgttgttgtgcgccgcgcggcggtgccgcgcgcattttcagcatagtgcgtcgcggcccgcgctggcggccgcgcgacacgaccgatgaagcgtactcccgccgccggctgccgatccaatgagttatgctgaactgcgttataagccgcgctcatatcacgacgatggatctcaccctgctccgtgcgttcgcgacggtcgcacgtgaaggcaacctgacacgcgccgccgtgcagctgcacctgacgcagccggccgtcagcctgcagatcaagcatctgcaggaaacactcggcgtcacgctgtttacgcgcacgtcgcgcgggctcgcgctcacgcgcgacggccagaccctgctgccgcatgcggaacgcgcgctcgccgcggccgccgacgtgcagcgcgccgctgctgcgctgcggcacgaggtgcgcggccggctgcggatcggcacgatcctcgatccgggcttcctgcggctcggcggcttcctgcgcgcgctcgtcgaaacccatccgcagatcgaaacggcgctgcggcacgggatgtcggggtgggtcatcgaacaggtgcgcacgcaggcgctcgacgtcggctactacatcggccggccgggcgaggacgatccgctcgacggcgcactgttccacaccgtcacgctcacgcatttcgagtaccgcgtgctcgcgccggccggctggaaggagcgcgtacagcgcgtgaacgactggcgctcgcttgccacgctgccgtggatctggacgccgccggcatccgcgcaccaccggctgctgtcgcggcgcttcgccgacgccggcgcgcagccgctcaaggttgccgaggtcgaccaggagcagtcgatgctcgatctcgtcaaatcgggcatcggattgacgctcgcacgcgattcgaccgcgctggccgaagcgcacgcgcatgcgctgacgatcgtcgaacgcgtgacggtgccgaccgagctcaccttcgtgacgctcgccgagcggcgcgacgaaccggcgatcgcggcggcgctgcggctgatcgaggcgcaatgggcgatatgagcggtgctgatgaaagtgcgcgtgccggacgtcgggcctcgggcatcccgctgccgggcacgacacgcgtcatcgcgccgcaccccgcccccgccgtcacgccaccgtctccacgtttttgctagattgtgcgttcgcacaccgcgagaccccgattgaaggagacccgcatggcccgcaacatcgagatcaaagcccgcgcccgcgaattcgaccagctgcgcgaacaggcggccaaactcgcgaccgaagcgccgctcttctatcgccagcaggatttcttctacgacgtgccgcgcggccggctgaagctgcgccgcttcgaggacggcacgccggccgaactgatcttctaccagcgcgacgaccgcgacggcccgaaggcgtcgtactacacgcgcagcccggtgacgaaccccgacgcgatgcacgcgctgctcgccaccgcgctgaccacgcgcgggatcgtgacgaaggaacggcacgtgtacctggcgggccgcacgcgcatccatctcgaccgcgtcgacggcctcggcgatttcatcgaactggaagtcgtgctcggccccgacgacgacgaagccggcggcgaagccgaagcgcacgacgtgttcgcgaagctcggcgtgtcgccggacgatctcgtcgcggtcgcatacgtcgacctgctgaacgccgacacgcagcacgaagcggcctgatccggccccgcccgggcggcgcaacccgcgccgccttcggccctgccgcgccgtcgccgccctgccgccgtgtcaggccgcgccgggcgccaggtgcgcgagcggcagcgcgccgttgcgcttgaaggtcgtcagcacgatgttcgagcgcacgctgtcgacgcccggcacgcgcatcagcttcttcatcacgaactgcgacagcgcgttcaggtcgggcgcgacgatccgcagcaggtagtccgcgtcgcccaccaccgcatggcattcgagcacttcgggcagcacgtcgatctgctgctggaactgctcgatgatcgaatcgccgtggtgcttgagcttgaggctcgtgaacgcggtgacgccgagcccgagcttttcgggccggagcatcacgcggtagccttcgatcacgccggccgcctcgagccgctgcagccgccggccgatctgcgacggcgacagcggcacctcctcgccgagctgctgatgcgtcgcgcggccgaagcgctgcagcacgtccagcagcgcgagatcgaagtgatcgagttccagcatgagtattctccgcattgattcttgatttgatgcgcgattatcgcatcatcgtgcgaatcaacgccaatattgcgcccattccgcgcgcagcccgctctacacttgcatggttcacaaccgccgcgtgcagagccagatcatgtccaccgtcgtcaccgcgaaactgcaggagcagttcgatgcgggcctcgaaacccgcgccgatttcaccatcgaccagccgctcgcgcgatacggccaggtcgaccacgcggtgtggaagcagctctatgcacgccagtcggcgctgctgcgcggtcgcgcgtgcgacgcgttcgtcgcggggctcgggaagatcgacctgccggccgatcgcgtgccgtcgttcgccgacgtgaaccgccagctgaagccggcaacgggctgggagatcgtcgccgtgccgggcctcgtgcccgaccgcgtgttcttcgagcatctcgcgaaccggcgcttcccggtcacctggtggatgcgccgccccgaccagctcgactacctgcaggaacccgactgcttccacgatctcttcggccacgtgccgctgctgatcgacccggtgttcgccgactacatgcaggcgtacggccgcaccgcgctcgcggtcgccgacgacgaagcggcgctggcgcggctcgcgcgactctactggtatacggtggaattcggattgatccgcgatccgcgcagcacgaacggcctgtcgatctacggcgccgggatcgtgtcgagcaagggcgaaagcctgtacagcctcgaaagcgcggcgccgaaccggctcggcttcgacctcgagcgcgtgatgcgcacgaagtaccggatcgacacgttccagaagacctacttcgtgatcgacgatttcgcgcaactgttcgcgctcgccgacgtcgacggccgcgcgctggccgaccggctggcggcgctgcccgagttcgcggccggcgcggtgctcgacaccgatcgcgtgctgcatcgcggcaccggcgaaggctggcccgacgacgccgacgcgtaacccgcgaacgcacgtcgatggtcgccggatggccgtcccacaactatgaaacaatgaccggtgccggcttcggcgcgcggcgcagccgcgcgcgggcgccgttaccgaacgagaggtgcaagatgatccacaagctcacatcagaagaacgcaagacccggctcgaaggcctgccgctctggtcggccgtaccgggccgcgacgcgatccagcgcagcctgcgcttcgccgatttcaacgaagccttcggcttcatgacgcgcgtcgcgatcaaggcgcaggaaatgaaccaccatccggaatggttcaacgtgtacaaccgcgtcgacatcacgctgtcgacccacgacgccgacggcctgaccgaacgcgacatcgaactggcgcttttcatcgaccttgccggcgcgcacgcgaaaccggccgcctgacaccttcccctaccgccgcgcgtcctttgatgcgcggcgcgtcaacttttcatttcgatgaacgttttctaggatgtagtcagcgaaagccttcagctttccaagccatccttaaggcgcacgtaagtctcgtacgcattccgtgccttggggtccaaaccttccagttgcagcgcgccttggcgctgtacaatcagcagcgcatacggcttggaaagcgcgctggcctcttcgcagagtttgagttcgtcgccgctcgacggcgagcgggcgcgccagaaattgatcgcggcttctaggtcgttgatcgaaatatcggacatgattggatttaatcgttcgctggccgccatgcttgatgtcaggtgtcgcggcaccctgtggaaacggcgtcgtgctgtccgcgtgcctgaaccgccaacccattgtacttgagcgaacttcatgcgactccttctgatcgaagacgaccgccccatcgcacgcggtatccagagcagcctcgagcaggctggcttcaccgtcgacatggtgcatgacggcatctttgccgaacaggcgctggcacagaatcgccacgaactcgtgatcctcgacctcggcctgccgggcatcgacgggatgacgctgctcacgcgcttccgccagaccaaccgccacacgcccgtcatcgtgctgaccgcacgcgacgagctgaacgaccggatccagggcctgaactccggcgccgacgactacatgctcaagccgttcgagccggccgagctcgaagcgcgcatccgcgcggtgatgcgccgcagcggcccgcacagcgacatgccgcgcccggaagtgtcgctcggcggcgtccgcctgtcgggcgtcgatcgccgcatcttcaacgacgacaagccgctcgaactgtcgccgcgtgaattcgcggtgctcgagatgctgctgctgcgccacggccgcgtcgtcagcaaggcccagctgcaggatcacctcacgcacttcggcggcgatctcggcgacaccgcgatcgaagtctacgtgcaccgcgtgcgcaagaaactcgagcagtgccgcgtcgaaatcgtcacggtgcgcggcttcggctacctgttgcaggaaatccgccagacggcgagcgtctgaacggcggtgcggcgcaccggccggcctggccgccggcgcgcccaccctgcccgcatcgccgcccggcgtacgaccgcgccgctccccgtgagcggcgcttatccatttgcccgtcgaaatgtcacctgatccggctgtgaccaccagcctgcgccgctcgctgcttcggcgcctcgccgccccgttgtcgatgctcgcactgatgagcggcctgatcgcctactggctcgcgtggcaatacacgcagcacgtgatcgaccgctcgctcgccgatctcgcgaccgcaatttccaaacagatccagatcgccggccccgacgcgccgtttacggtgccgccgctcgcgcaggcgatgttctctgatcccgccgaagcgctgatctaccggatcagcgacggcgaacaggaactcgccggcgatccgaagctgccgctgcggggcatcaacgtgcgccgcatgcatcacgcgtatgtgttcgaggccgaatacgacaatcgcgcggtacgggtcgcgcaggtgcgcgtcgacaacgtcgaaggcggcaagccgatggtcgtcgaggtcgcgcagccggtgcggcaccgctaccggatcgcggccgaattcctcgtcgcgatcatgatgccgctgctgctgctgctgctcgcgggctggggcatcgtgtggcgcgtcgtcaaccagcagctcggcccgctcacacatctggccgattcactgaaccggcagacccacacgtcgctggaaccggtcgacgaaaccgaggtgccgctggaaatccggccgctgacgagcgcgatgaacgccctgctcggccgcctgaaaaccgcgctcgacgcgcagcgcaagttcatcgccgatgccgcgcaccagttgcgcacgccgctcacggccgtgaagctgcacgcggagcaagcggccgtggcacgcgacccgcaccagaccttcgccgcggtgcgcgagctgcgcgcggccgccgaccgcgcggtacgactgtcgaaccagttgctgtcgctcgcgcgcgcggaaccgggcgagcaggccgcgcggttcgtcgacgtcgacctcgcggcgatggcattcgagacgggcgccgaatgggtgccgcgcgcactcgcgtcgcacgtcgacctcggcttccagcgcaccgacgatccgggtgacgacgagaagctggtcgtgcgcggcaaccccgtgctgttgcgcgaggtgatcgcgaacctgctcgacaatgcgctgaagtacgtgccgctcgcgcggccggacggtgcgcggatcacggtgaacgtcgcgcgcggcgcgctcgagggcggccagccggccgccgagatcgtcgtcgaggacaacggccccggcgtgcccgccaaccagcaggccgacctgttcaagcgattcttccgcggcgacgcgcaaaacggcaacggcgtcgagacgggcgccgggctcggcctcgcgatcgtgcacgacatcatcgcgatgcacggcggcaccgtatcgtacgaggatgcgtcggaaggcggctcgcgcttcgtggtgagggtgccgctggctgcacgcacggacaagccggccagcgaaaccccggccaccgcgtcgacgcactgagcgattcgcggcgggcggcccctggccgggtcgcacgccggatgacgaaggcggaaaacccggccgcatgatgcagcagccgggcgctgaaacggcagcggcagcgcacgatgcgccgccgcctgcgtcacttcctgtttttcttgtccttcgaacgggactcggacttgccgtccttcttgtccttcttctttttcttcttcttgccgccgtcgtcggatgtcgcgagcagcgtgccgcggcacgacgatgcgccgcaatggcatgcgtattcgcgcttgagcgacttcgtcagcttcgcatcgatcacgaggccatagtcgtagaacagttcctcttccggcccgatgtcgcgcagcgcgtggatgtacacgcggcctttgacttcctcggcttcgcagttcggtgcgcacgagtggttgatccagcgcgcgctgttgccgtcgatcttgccgtcgatcaccccgcccttgtccagtgcgaagtagaacgtatggttcggttcgctcgggtcgtgcggatggcgacgcagcgcttccttccacgaaattcgttcgcccttgtattccactacgcgctcgccggccttgatcggcgccacggcgaacacgcccttgccgtgtactcccgagcggcgcaccgcgatcctgcgtgaactcatcgaacgaatccttgtgaaaacgacttgaatggggcggccgcgatcgcggcctggcgtcgcgcaaaacgaaaacgcggcaccggtcggtgccgcgtcgggacatgcggcgaatcacccgcatcctacacgttcacgattgcttcgttcaacatcacgcgcaatattgcgcgtgcgatgctcaacgctggccgaaggcaacgtcgccgaacaacgccttgtgctcgcgcggctgcgaacgccagtactgcggcggcgccgtcacctgcgcaccgagctcggccgccgcgtgccacggccagcgcgggtcgtacagcatcgcacgcgccatcgcgacgaaatcggcatcgcccgcctcgatcagccggttcgcatgcgcaggctcgttgatcagcccgacggcaaccgtcggcatgccgaccgcgcgcttcaccgcctgcgcgaacggcacctggtagccgggcgacagcgggattttctgcagcggcgacacgccgccggacgacacgtcgatccagtcgcagccgcggcgcttcagttcgtgcgcgaacgcgatcgtatcgtcgagctcccagccgccttcgacccagtcggtggccgacacgcgcacgccgaccggccggtcctccggaaacgccgcgcgcacgatctcgaagatctcgagcggaaagcgcatccggttttcgagcgagccgccgtattcgtcggtgcgctggttcgcgagcggcgacaggaactggtgcagcaggtagccatgtgccgcatgcacctcgatcgcgtcgatgccgagccgtgcggcacgcttcgccgaggccgcgaatgcttcgcggatccggttcaggccggcggcatcgagggcgagggcggcgtctcgccgtccttgtgcggcaccgccgacggtgcatgcggcaaccagccgccgtcggcgaccgacacgagctgaccgccctgccacggcacgttgctcgacgccttgcgccccgcatgcgacaactgcatcgcgacgcggatcggcgaatgcttgcggatcgcggtcagcacgggcttcagcgcggcttcggtcacgtcgtcccagaggccgaggtcgccctgcgtgatgcgcccgtcgggttccaccgcggtcgcctcgatgcagagcagccccgcgcccgacagcgcgagatggccgaggtgaatcatgtgccagtcggtcgcttcaccgcgctcggccgaatactggcacatcgggagatcacgatccggttcggaagagtcacgccgcgcagcgtgaacggggaaaacagcgcagtcatggaggccgctcgccaggaaaggaaagagcgaacgagcgtagcacgcaggccgcaagcgtgctgacggtgcacgcggcagtaagcggatggtcaggtacggcccgcggcaggttgcgggcgacgcggcaaacagcgcgcatacggcgatgcgccggcctgcaacggacgcgggccgggcaaccgcttcgctgcaaacggcagtgccgcttgccgcgtcagagtccgacgccgtcgagccactccgcgaacatccgtcgcgcggccgcctcgagcgcggggccgtgctgcgcggtatcggcgcgcaactggcgcgcgtcgatgccgggcgtggccgcgatttcgccggcgttggcgatcagccacggttcgaagcggtcggtgcggatttccggatggcattgcagcgccagcacgtgctggccccacgcgaatgcctggtggcggcaagccggtgtcgacgcgagatgaatcgcaccgcccggcaggtcgaacgtgtcgccatgccagtgcagcatcgacgtcgccgcgccatcgagatggcgcagcggcgatgcgcggccggcatcggtgagcgtcagcggcgtccagccgagttcgtgctgagcggccgggtagacgcgcgcgccgagcgcccgggcgatgaactgcgcgccgaggcagatgccgaggatcggcagcccggcgtcgatgcgcgtgcgcacgagcgccgcgagcggcgcgatcgtcggatactgcgcgtcgtcgtacacgctgagcggcccgccgagcacgacgatgagcgacggttcgagtacgtctagcacctcgaagcgcgacgacccgacgtcgacgtagcgcacccgccggccccgttcgccgagcacctgctcgaaactcccgagatcctcgaagtgcacgtggcggatcgccacgacttcagcgttcatcatcggcctcccggtcgatcgacggacgtcagccggcgaaaatcttccaggtcttcttctgcgtcgccgcgtcggcttcttcctgcaccgagcagtcgagacgcagatcgctgtcggacatcgagatgtcgagcgccgcgcaatgatgcacggtcttcttcgacagcttgcccggctggaagtgggcgcacgtcaagcacatgcgctgcggcggcgtcgcaccggccacctgcagttcgcgcagcgtcttcagcagcgcgcgatacagtgcgccctgctcgtccgcaccgagcttgccgacggctttcgtcaggaattcaggccattgcagcgccttcttcgcggccgtgcggccacgagccgacaggcgcacggccagtgcgcggccgtcgtccagcgcgcggcgcttctcgacgagccccttcgtctcgagcgtgctgaccgcatcgctcgtggtcgccgcggtcagctgcgtctcgcgcgcgatctcgccgagccgcatcgggcccttgcgctgcaacagcagcacgagaatctcgccctgcgtcggcgtgaggccagcgccttccgcccaatcccatgcctggcttcgcatggccgtactcaaccgcagcaggctgtgggtcacacgtcccgaagcctgattcccgtaaacgccttcgctcatagtcttttcgctttgccgccgcccggtttgccgagcggccgtagtgtggagatcgaatgtctatctcaaaacagacacgctcttgcgagtgcgtcagcacggccgtcgcgagggcacacgcggcggtcgcgttcgcggcgaccggtaagacacgcatcgttccggtgtccgcaaagccgacattctaagcgagagcggaaaatcgcacagctaagttatccccttcattctgtggaaaatcactggataaccaaaatttttcgttgtgcctgcaatgccgaacgcccgcgcagcggggtgtcgggacattttcctgttcggatcggccatcgggccgaccgcaatgatccaccgggttatcccgcgcacagatcgttgactttgcagcggaatatcgggttatccacagattttcaggacaaccggcaacgatttcggcgtcaatcgaggccgccagccattcagtgaatcgcgactcggtcgaccccgtaatctgcaaaacatttttcattcgcgccaacgtaagcactgctggcggaccgtctcgttgagcgatttttcctgtttgaaaacggttctcaaccacgaggcgtcgttcacgcgcgcctgggccagtgcgccgatctcgtcgagcgccgcgcgcgaaccgagcgcggccgcatgcggcgcgatccggtcgagcgtgtcgaggatgtcctcggcgatggtacggcgctcacccgtctgaggattcacgcaggtgccctcgagcccgaagcggcacgcctcgaaacggttgaacgtgtagacgaggtagtcgtcctccgacagcttcagcggccggtcggtcagcaggtagcgtgcgagcgtctggatgtagcaggcgatcgccgccgcgcggtcgaccgacagcggcgtgtccatcacgcgcacctcgatcgtcccgtagccgggtttcgggcggatgtcccagtagaagtccttcatcgagttgacgacacccgtgttcaccatcttcgtgaagtactcctcgaagctgtcccaggtcagcacgaacggcgcgcggcccgacagcgggaacgcgaacaccgaattcaggcgggccgaatggaagccggtgtcgacgttctgcacgaacggcgacgacgcggacagcgcgatgaaatgcggaatgaagcgcgacatcgagtgcagcaggaacagcgcactgtcgggatcggggcagccgatgtgcacgtgctggccgaacacggtgaactgtttggccaggtaaccgtacagttcggagatgtactggaagcgcggcgcatcgtagatctgccggtcgctccattgctggaacgcatgcgtgccgccgccggccagcccgacgttgagctggtcggccgccttcacgagcacgtcgcggatcgcgtgcagctcgctcaccgcctgctcgtgcgaatggcagatgccggtcgacagctcgatcatgctctcggtgatttccggcgtgatgttgcccggaaaggtctcgccctggatcaggcgcatcaggtcggatgccgctttggtcaggtcgtagttgtgcgtgttgacgacctggatctccagttcgacgccgaacgtgaacggctcggaattgacgaaggtttcgagtgccatggcaggttcggaatcagttgctgtcgctgcgctcaccgaccgccgacaggcagcggtagacgatgaacgggctgacgagctgcaggatcacgatcgtgcacatcacgatcgcgcgcaggtgcgggtcgaaattcggatagagctggtaggtgtcgtcgacgagcaggtacgacagcgcggacatcggcgtgagcgcgatgccgagcgcgatgccctgcttcatcccgatgccgctcggcttcgcgaacgcgacgacaccggccagcttcgcgacgagccgcgtgacgatcagcacgatcgcgagcaagccgccgagcgcgatgtcgccccacgtgaacgacgtgagcgtgagcacgaacaggaccaccgtcagcagccagccggccgtgccgaaatgctcgggccacagctgcgggcgcgcctcgaggttcttcacgatgatgccggcgagcagcagcgtgagcagcgtcgacagcttcagtgcctgggccaccgcgatcgcgagcatcacgagcccgaacagcgcgacgaacgaatgctcgtcgcgcatcgtcgacgtcatgtgacggaacaggaaattgcacgaacgcgcgacgagatacgcgacgatgaacgaaccggcgagcaggtagagcggctgcaggatcgtcgcgaaaacgttgccgtacgcttcctggtggagccagctcgtcacgagcttggtcagcacgatcgcatagacgctgttgagcgcggtgagcgtgatgaggcgttgcgacacctgcccttccgcgcgcagttcggtcttcagctggatcaccatcgatggcgatgtcgcaatcgcgatcgccgacagcacgagcgcgaccatccccgatacgccgagcgccagcatcacgaacagcaccagcacgaacgtcagcgtggcttcggcgaggctcgacgcgacgagccacggattgcgccggatccagcgcaggtcgagacggctgccgagctcgaacagcagcaggccgagcgcgacgtcgatcagcagccgcgaggtttcgtcggtgcttgcatcgatcacgccgaatccgaacgatccggcgacgagaccgatcaccgcataaccggtgatgcgcggcagccgccatgcgcgatagcacagctcgccgcacaggccggccgcgaacagcgcgagcccggcccagaacacggcatccggcgtaagcggccagttgggcaggaatgagaacgccgacttcatcgtggtgacttctcctttggaagcgaccgccagcgacacagggtcaagcgtcagaaatggatgcgcgccggctgggtatcgccccgaatgtgattgttgtgtcgacgacggcgggacatgggatccgcctgctccgccacagggcggaaagtcgctcaggttgccgatctggattgtcggcctggtgtgtgaacggactgcgcagtctcgaagattcagattcgaaatcgtgccgaccgttccattgaagcatgtccggcgcctggccggatgaacgcgaaggaaaccgattgtgccacagctttttcggtctggaacccattgattcgactcgcggcgctgtgcggcaccccaggtctttggtttcaaaggtttacttgtatatatacgtagtagaagttaacaaggcgcgcacagttctgtggataacttcggtttacgtcgacagatcaaggtgttggagagtccataacccgttgcacaggctgttcgtgcacagaagtttcgattgagcaactttcgggccgtttcacagctgtgccgagttgcccagtttacgtccactgtgattgcacacgaagtgcgcgcggattccgcgcagttatccacagcatcgagtggataaccttgcgcgaaaaaatcgggaaactgtgatcgtctcggggccggtcagccggcctggctgacgcggcgcgcgcgcaatgcgcggatcaggaagcgtgcgggatcgacggcatcggcgagttcgcgttcgagcggccacggctcgccttcgagttgcgatgcgatcagttcggcgccgagtgcggcccatacgaggccgcgcgaaccgaaaccgaatgcgccgtagagtccggtcatgcgcggcaggtcgcgtgcctgcgcgccgctcagcgcgcgtgctttggcgacggctcccgcttcgtccgcgagcgggccgatgagcggcagtcgatcgccgacaacccagcggaacgcaacgcggccgcgcagcgtgccgggatccggcacgtcgccgatcaggcccggcagcagacggcgcacgcgctcgaggttttcggcgtgaccggccgcgcgcatcgcgggatcgacgtcgtcgggctcgaacgtcgcgccgatcagcagcgtgccgtcgtcgagcggtaccgcgtaaccgtcgccgatcgccgggcacggcagcggtgccgtgctgccgggggcagcaacgtgagctggccacgcaccggttgcagcgcgacgtgctgcaacccggcgaggcgtgcggcatcgccggcattcgcgagcacgacgacgggcgcttcggccagtgtgccaccagcatcgtcgagcgcatgccaagcatcgccccgccgttcgagtcgtgccacggcggtggacgcgagcaagcgcacgcgctcgccggccgcctcgcactgggccgcgcaaaggccggccggccagacggcgccgccgtgcggaaacaacaggccgccgtgcgcgaccggcaggttcaggtgggcgcgcgcggcatcggcgtcgagcagcgatacgtagtcggacggtgcgccgaacgcatcgaaagcatcacgcatccgcgcgaagtcgtcggccgattcggcgagatgaatcatcccgtgcgtgctgcgcgcgaatgcatggcccgcgcgttcgagtgcgcgccagcgtgcgatcgcgtgcaggaagccgccgcgcgtgagccggctcgcgacgttgtcgtcgcgcgtcatcagcggatggaacacgccggccggattgcccgacgcctcgctcgcgatccgctcgtgccgttcgatcagtgtgacctcccagccgcgcgcggcgagacgttcgacgaccgcgcagcccgccaggcccgcaccgatcacgatcgcgcggcgtgccgcaacgggcaatgcgagcggcggctcgtgccggcgcgcgcgccagcgcggcgcgtattcaccgacgagcatcacgaacttgccggcaaacccgtcgaccttgcgatacgtgaaacccgcgtcggtgagcgcctgtttcacgacgcccgaactcgaatacgtcgcgaaggtcgcgccttcggcagcgaggcgtccgagggcgcggaacacgtcggccgaccacatgtccgggtttttcgccggcgcaaaaccgtccagataaaacgcatcggcacgtgcgacgagtttcggcagcatctcgcgcgcgtcgccgaatgcaagcgtgagcacgacccgaccgtcgtcgaattcgagccggtgcaaacccggcacgagcgtcggccatgcatcggcaagcatcgcggcttcggccgacatggttgtgttcgcaacgatatgggaaagcgccttgcgcaagtcgtcgcgcgagaacgggtgcttctcgaccgacacgaaatgcagccgctcgcagcgtgcaggatcctcgcgccacgcggcccaggtcgcgaggaagttggcgcccgtgccgaaccccgtctcgacgatcgtgaacgtgcggcggccttgccagcgcgccggcagccggttgcccgcgacggacacgtagttcgcctgcgcgagcgcgcccgcgacgttgtgatagatgtcgccgaactcgggcgacacgagcgtgccgtcgtcgcggatggcgaacgtggcgggaacaagtcggtcggtcatgcgaaacaaaaacgtggcagccaagcctggcaagggattgcgcggggccgtccgtccggccgttggaaaaagccaacggggcggcgcacgggcgaccgcgctgcgtatcctgtccggttggcgctggtcaaaaatgggcagtccgtgattcattcggcgaaataccgatgaaaatctttgaaacccttgtcgttattgggtttgcgctgcgctatcatagcaacgccgtaccgcggggtggccgccggcataccggagggcgcgtcgcgcgggccaggattcggcgctgtgtcgtcggagtctgactctcgacggcacggttcgcgcacgtataatcggcgcgttcgcgctgttcgtgtcaacctaacctgataaaggaaccttaatgaacaaacaggaactgatcgacgccgtcgccgcccaaacgggcgccagcaaggctcaaaccggcgaaacgctggacacgctgctcgaagtcatcaagaaggccgtgtcgaagggtgatgcggttcagctgatcggcttcggcagcttcggttcgggcaagcgcgcagcacgtacgggccgcaacccgaagacgggcgaaaccatcaagatcccggcagccaagacggtcaagttcacggctggcaaggcgttcaaggacgccgtcaacaagcgttaatccagcgcctgttccaagaaaaacccgcctttcggcgggttttgttgggcgcgcgcggcattttcgccacagtccgcgccactcttgcaagatttaacggttgtttttacaacgcgttacacgtgcacgatctgcgtgtcgccgtgatcgtcgtcgtcgtgcgaatcgatatcccacaccgggaacggatcgtcgaacgcgtgccatcccgccgcgccgagcgcgaattccgcatcggtcagcaggcacgcatcgagtttctcgcgccacgcatccgcgtcgagcgcgatgccgatcagtacgagttcctgccggcgatcgcccactgcgcgatcatcgagatcgccgtgccattcggcgcggatttccgcgagcagttcgtcgtcgtccggccattccgcgcgatcctgcgccgcccaccacagacccgccgggccatgccggcatacgccgcccgcctgcgacagcgagcccgcgatgtcgttgcgcgtcgcgagccagaagaagcccttgctgcgcagcacgcccggccactcctggtgcagcagcgcccagagccgtgccggatgaaacggccggcgcgcgcggtaaacaaaattgccgatgccgaattcgtcggcttcgccgtgcacgtgcgcatgatgttcgtcatggcagtccgggtcgtcgcaatgcgtgtgatcgtgatcgagcgatgcgagccagcccggcgcgttcgcggcctcgtcgaaatcgaaacggcccgtgttcagcacttcgtcgagcggcacgttgccgaacgtcgacacgacctggtgcgcgcgcgggttcaggcgcgcgaggatgtgctgcaggcgtgcgagttcgtcggcgccgacgaggtcggccttgttgatcaccagcacgtcgcagaattcgatctgctcgatcagcagctcgacgagcgtgcggtcgtcctcttccgaggcggcgatgccgcgggttgcgagcgcgtcgtccgagccgtagtcgcggaggaagttgtacgcgtcgaccacggtgacgagcgtgtcgagccgcgcgatcgcggacagcgacgtgccgtcgtcgtcgacgaacgtgaaggtttcggcgatcggcatcggctccgcgataccggtcgattcgatcatgatcgcgtcgaagcggccttcggacgcgaggttgcggatctcgacgagcaggtcgtcgcgcagcgtgcagcagatgcagccgttcgacatctcgacgaggcgttcctcgacgtgcgacagcgcctgcgcgtcacgcacgagcgatgcgtcgatgttgaccgcagcgagatcgttgacgatcacggcgactttcaggcccgcgcggttcgcgaggacatggttgagcagcgtggtcttgccggcgccgaggaaaccggacagcacggtgacgggcaacggctggttcatagccggattcatagcgatacgcaccaacggaaaaattgaacaagcggccgcggcgcccttccggggcgcgatcgtcccgcggacgggcgaacttgcggcgtgagatccgcattgtgcatcaaacgcgcgccggccggccggtacggcgtcaggccgcgccgggccgcagcgtcattgcacgggcggcaacagcttccactgcgtcaggatggcggcaatctgccgcgcgtacttgtcgcgcagcgacggtgtttccgaatgataggcgccgaccgcctgccacgtgttgccgtagcggttcatcttctgcttgagatgccacgcggcgatgtagacgttcttgcacggctccatcagcgtgtcgcggccgatcccgtagcgcgacagcgtcggcaggtggatcgaattgatctgcatcaggccgtagtcgaccgagccgttcgtgttcttgtttagcgcgccgggccggttgcgcgactcctgccacgcgatcgcgcgcaggatcagcggattgacctgctgatattttgccgcctcgtcgaaacagtccgcgcgagcgttcgcgctggcgaaacacgcgccggcggcgatcaacgcaatcgaggcgaaccgtctgttcatggtgcggaatcgataataaattgcgcgaaggtcgggaaaacccgtgcctgttattcgtgcgatgagaaacgcgccgcccgtatcataccgacagtccgtcagcttgcgacatacaggaatacggcagcccggttataccgcatttccgtgtcggttcatcgtgaaacgggggcgatggccgggatgcagagcatagcgccgaacattacatattgcatacggctcgcagaatacatgtcgtatgtgagacagtcctcgggtcaatgtgatatttcggacatgaaaaactgctaatgtcgcctctttaggacttggatcccagcactaccgccggaagtggcctgagccggcatcgacccattcatccatgacaagaaatcgcttcgttatgcggcgtgtcgccacgaccctgatcgtcgccggcctcatcgtttcgcaggccgcctacgctcaggtcacgctcaacttcgtgaatgcggatatcgaccaggtcgccaaggcgatcggtgccgcaaccggcaagaccatcatcgtcgacccccgcgtgaaggggcagctcaacctcgtggccgaacggccggtgccggaagaccaggcgctgaagacgctgcagtcggcgctgcggatgcagggcttcgcgctcgtgcaggatcacggcgtgctgaaggtcgtgcccgaggccgacgcgaagctgcagggcgtgccgacctacgtcggcaacgcgccgcaggcgcgcggcgaccaggtgatcacgcaggtgttcgagctgcacaacgaatcggcgaacaacctgctgcccgtgctgcggccgctgatctcgccgaacaacacggtgacggcctacccggcgaacaacacgatcgtcgtcaccgactacgcggacaacgtgcggcgcatcgcgcagatcatcgccggcgtcgacagcgctgcgggcgcgcaggtgcaggtcgttccgctgcgcaacgcgaacgcgatcgacctcgccgcgcagctgcagaaaatgctcgacccgggcgcgatcggcaacagcgacgcgacgctgaaggtgtcggtcacggccgacccgcgcaccaactcgctgctgctgcgcgcatcgagcgcgtcgcgcctcgcggccgcgaagcggctcgtgcagcagctcgacgcgccgagcggggtgcccggcaacatgcatgtcgtgccgctgcgcaatgccgatgcggtgaagctggcgaagacgctgcgcggcatgctcggcaagggagcggcagcgacagcggctcgtcggcatcgtccaacgatgcgaacagcttcaaccagaacggcggctcgtcgtcgagcggcaatttctcgaccggcacgtcgggcaccccgccgctgccgtcgggcggcctcggcggttcgtcgtcctcgtcggggtacggcggttcgtcgggcagcggcggcggtctcggcagcgccggcctgctcggcggcgacaaggacaaaggcgacgacaaccagccgggcggcatgatccaggccgacgcggcgaccaactcgctgatcatcaccgcgtcggatccggtgtaccggaacctgcgctcggtgatcgaccagctcgacgcgcggcgcgcgcaggtctatatcgaagcgctgatcgtcgagctgaactcgaatacgtccggcaacctcggtatccagtggcaggtcgcgagcggccagtttctcggcggcacgaacctgaaccccactggcggtctgggcaacagcatcatcaacctgacggcgggcggcgtggccaacgccgccggcggcatcaccggcggcgggctggccaacaatctcggggcgctgagccaggggctcaacatcggctggctgcacaacatgttcggcgtgcaggggctcggcgcactgctgcagtatttctcgggcgtgagcgacgcgaacgtgctgtcgacgccgaacctgatcacgctcgacaacgaggaagcaaagatcgtcgtcggccagaacgtgccgatcgcgaccggttcgtattcgaacctgacgagcggcaacacgaacaatgcgttcaacacctacgaccgtcgcgacgtcggcctgacgctgcacgtgaagccgcagatcaccgacggcgggatcctcaagcttcagctctacaccgaggattcggcggtcgtcgcgggtaccacgagcgcgcagaccggcccgaccttcacgaagcgctcgatccagtcgacgatcctcgcggacaacggcgagatcatcgtgctcggcggcttgatgcaggacaactaccaggtgtcgaacagcaaggtgccgctgctcggcgacattccgtggatcggccagctgttccgttccgaaacgaagctgcgccagaaaaccaacctgatggtattcctgcgcccggtgatcatttccgatcgcaataccgcgcaggaagtcacggccaatcgttacgactacatccagggcgtgacgggcgcgtacaagtccgacaacaacgtgatgcgcgacaaggacgatccggtcgtcccgccgatgccgatcggcccgagccagggtggcacggccgcgggcaacctgttcgatctcgacaagatgcgtcgccagcaggtacagcgccaggtggtgccggtgccggcccagccgttgccggaggcgacgcccgcgcagccgcagagcgtgccgcagcaggccgtgccgcaacagccgctgaccgccacgccgggagcctcgcagtgagcgacgtgctcgcctcttccgcccacgacggcgcgccgggcgaacgccagccgccgtcgccgctcgccgcgcggctgctgccgtacggcttcgcgaagagcggccaggtgctgatcgcgcaccagctcgacgacacgctcgaggtgtggatcagcgaacgcacgagcgatgccgcgctcgcggagatcgcgcgcaacttcggctcgatctccgtgcatcgcgtgccggccgacgagctcgcgcaggcgatcaaccacgcgtacgcgcgccaggacggcagcgccgcgcaggtggtcggcgaggtcgaaggcgaagtcgacctgtcgcggctgatgcaggacatccccgaagtcgaggatctgctcgaatcggaggacgacgcgccgatcatccggatgatcaacgcgctgctcacgcaagcggcgcgcgaacaggcgtcggacatccacatcgagccgttcgagaatgcttccgtcgtgcgctttcgcgtcgacggcacgctgcgtgacgtcgtgcggccgaagaaggcgctgcacggtgcgctgatctcgcggatcaagatcatggcgcagctcgacatcgcggagaagcgcctgccgcaggacggccgcatcacgctgcgcgtcggcggccggccggtggacgtgcgcgtgtcgacgctgccgacgggccacggcgagcgtgcggtgctgcgtctgctggaaaaggatgcgcagcggctgaacctcgaggcgctcgggatgggccgcgacacgctcgtccagttcgacaagctgatcgctcgcccgcacggcatcgtgctcgtcacgggcccgaccggttcgggcaagacgaccacgctgtatgcgtcgatgtcgcggctcgaaaccgcgacgaccaacatcatgaccgtcgaggacccgatcgaatacgacctcggcggcatcggccagacgcaggtgaacgagcggatcgggatgacctttgcccgtgcgctgcgctcgatcctgcgccaggatccggacgtgatcatgatcggcgaaatccgcgacctcgaaaccgcgcagatcgcggtgcaggcgtcgctgacgggccacctcgtgctcgcgacgctgcacacgaacgatgcggcatcggccgtcacgcgtctgaccgacatgggcgtcgaaccctacctgctcgcgtcgtcgctgctcggcgtgctcgcacagcggctcgtgcgccagctctgccccgtctgcaaggaagaacgccaggaagaaggccgcaccgtgtggcatccggtcggctgcgacaagtgcgggcattcgggttattcgggccggcgcggggtgtacgaactgctgctggtcgacgagtcgatccgctcgctgatccaccgcaacgcggccgacgcggagattctcgccgccggtcgtgcggaagggatgcgcacgctgcgcgacgacgccgagcgctggctcgcgtccggtgcgacgtcgctcgaggaagtgttgcgcgtgacgggaggcgcatagcgcgatgccggcattccgtttcgaagcaatcgattcggcgggacgcgcgcagaagggcgtcatcgacgccgacagcgcgcgtgccgcgcgcggccagctacgcaggggctgacgccgctcgtcgtcgagccggccgccagcgcgacgcgcggggcgcggtcgcagcggctcgcgttcggccgcaagctgtcgcagcgcgaacaggcgatcctgacgcgccagctcgcgagcctgctgatcgcggggctcccgctcgacgaggcgctcggcgtgctgaccgagcaggccgagcgcgactacatccgcgaactgatggccgcgatccgcgcggaagtgctcggcggccattcgctcgcgaatgcgctgggccagcatccgcgcgacttcccgaaatctatcgcgcgctcgtcgcggccggcgagcacaccggcaagctcggcatcgtgctgtcgcgcctcgccgactacatcgagcaaagcaacgcgctgaagcagaagatcctgctggcgttcacgtatccggggatcgtcacgctgatcgcattcggcatcgtcacgttcctgctgagctatgtcgtgccccaggtcgtcaacgtgttcgcgagcacgaagcagcaactgcccgtgctgacgatcgtgatgatggcgctgtcggatttcgtgcggcactggtggtgggcgatcctgatcgcggtcgtgctcgtcgtgtggttcgtgaaggcgacgctgtcgcgtgacggcccgcggctgcgcttcgaccgctgggtgctgaccgcgccgctggcaggcaagctcgtgcgcggctacaacacggtgcggttcgcgagcacgctcggcatcctcaccgcggcgggcgtgccgatcctgcgcgcgttgcaggcggccggcgagacgctgtcgaaccgcgcgatgcgcgcgaacatcgacgacgcgatcgtgcgcgtgcgcgaaggctccgcgctgtcgcgcgcgctgaacaacgtgaagacgtttccgccggtgctcgtgcacctgatccgttccggcgaagcgacgggcgacgtgacgacgatgctggatcgcgcggccgaaggcgaagcgcgcgagctcgagcgccgcacgatgttcctgacgagcctgctcgagccgctcctgatcctggcgatgggcggcatcgtgctcgtgatcgtgctggccgtgatgctgccgatcatcgagctgaacaacatggtgcagtaacggcccgacagtcgatcgggccgctaccgttcagcgcatgtagatcgcggggacggcgtgttcgccggcagctggatttcggcgcgggcgccgttgcggtcgacgacgatcgagcgggggcggacttcggcgagcttcgcgccgggcgtgacctccgcaccgagcgacacggcgcgcggcggttcgccgccgacgccgacgatcgcggcggcaccgcgatcgagcgagaggatgccgaacaggtggatgtcctgcacgggattcttgtcgagctgaccgccgaagagcgccgcggcgtcctcggtacggatcggcagccgcgcggcggcggcgggcagcggcgcttcacgggctgacagcgtgacgacccagtaggtggccgtcgcgcacaaacccgcgaagagggctaggagaggatccggatcgagagcgcgttcatgcgcgctattgtacggatctatgtgaaatttgcgttgggtgaaagccctcggcaatgcgcgccttacaatgcgtgctccgcgcccgcgggtccggaaggttgccgtcaggcaatcgtccggtgcaccgggcgcgtcacgcaaccaacgacatttttggaaagaggtagtcagtcatgcaaacgtggatcactcgccgcaacgcggccgtgcgtcgtcagcgcggtttcacgctgatcgagatcatggtggtggtcgcgatcctcgggatcctggcggcgctgatcgtgccgaagatcatgagccgcccggacgaggcgcgccgcatcgccgcgaaacaggacatcggcacgatcatgcaggcgctcaagctgtaccgtctcgacaacggccgctacccgacccaggatcagggcctgaacgcactgatccagaagccgtccaccgatccgatcccgaacaactggaaggacggtggttatctcgagcgcctgccgaacgatccgtggggcaacgggtacaagtacctgaacccgggcgtgcacggcgagatcgacgtgttcagctacggcgccgacggcaaggaaggcggcgacggcaacgataccgacatcggttcgtggcaataagcgctcactgaccggcccgacgcttcgttcccgttcttcatgctcgccattcgcacgacctcccgctgcggtcgcgaccgccgtgtgcgttgcggcgcggcttcgtccgtgccggcgcatgccgacggcgggccgacgaagcacggtgcgcggcggcgtcgcacgcgcggcttcacgctgctcgaaatgctggtcgtgctcgtgatcgcggggctgctcgtgtcgctcgcgtcgctgtcgctcacgcgcaatccgcgtaccgacctgcgcgaggaagcgcagcgcatcgcgctgctgttcgagaccgccggcgacgaggcgcaggtgcgtgcccggccgatcgcatggcagccgaccgcacacggcttccgtttcgacgtgagctcgcccgacggctggcgcacgctgcgcgacgacctgctgcgcccgcgtgactgggatggcggcgtcacgggcgccgacatcgactatccggggtccgacacgcgcgcgagccgcgtcgtgttcggcaccgagagcatcgacacgccggtgcgcgtgacgctgcattcggccgccggcagcgcgacgatcgtcggcaccggcaacggccgctacgaggtgcaatgacgatgcgtcgtcgcctgcccttccccgttgcttcatcgcaccgccatgccccaacgggacttcatgcgcggcgcggtttcacgatgatcgaggtgctggtcgcgctcgcgatcatcgcggtcgcgctcgccgcgtcgatccgcgcggtcgggacgatggcgaccaacgcctccgatcttcatcgccggctgctcgccggctggagcgccgacaacgcgctcgcgcagatgcggctcacgcatgcgtggccggagatcggcgagcagagtttcgactgctcgcaaggcaacgtgcagctcgtctgcacgcagcgcgtgagcaccacgcccaacccggtgttccggcgcgtccggatttcggtgagcacgcccgggcaggccggcgtgcttgcgcagatggtgacggtggtcgcgaatgaaaccagccgtccgctctgacgcgccgatgcgacgcccgttcgcccgccccgcccgcggcttcacgctgatcgagctgatgatcgcgatcgcgatcctcgcggtggtcgcgatcctcgcgtggcgcgggctcgaccagatcatgcgcggtcgcgacaaggtcgcggccgcgatggaagacgaacgcgtgttcgcgcagatgttcgaccagatgcgcatcgacgcgcggctcgccgcgaccgacgacgaagccggccagccggcgatcggcgtcgccggcaacacgctgcagatcgtccgcgaactcgaggtgccgggcgtcgcgccgcggctgcaggtggtccgctaccggatcgccggcgggcgggtcgtgcgctacgcgtcgccgccgatcgacgacgcgaaccggctgcgcggcatgctgaaggacagcagcgtcgaaggctggagctgggtcgcgctgatgggcggcgtcggcgcgatcgacgcgaagctgtacgtgccgcgcgtgggctggaccaccaacctgcagacggccgacgacgcgctcgcgcagaacaacgatgcgctcaaggtgccgcagctcggcaacgcgccgccgacgcgcgcggtgacggggctgcaggtcagcatcggtgcgacgtcgctgcgcgtgccggtcacgcgcatcttcctcgtcggggaatgacgatgcgcgcgcgccctcccgttcattgcctgccgcccgtgctgccggtcacgcacgggcacgcggccgccagcgcggcgcggcgatcatcaccgcgctgctcgtcgtcgcgctgtcggcgatcctcgtctcggggatgctgtggcgccagcaggtgcagatccgccgcatcgagaaccagcgcgagatcgcgcaggcgcagtgggtcgcgcgcggcgcgctcgactggacgcggatgatcctgcgctccgaaggcgatacggcgcccggcatcacgtacctcggcggcatctggggcgtgccgatcgcgaagacgaaactgtcggacttcctcgggcggatcggcgcgcccaacgacaccggcggcgaagacacctatatctccgggtcgatcgaggacgcccaggcgaagttcaacctgcgcaacctcgtggcatcgccggcgcccggcgtgctgcagttgaacgtcacgcaggtccaggcattccagcgcctgctgacgacactcggctacgacggcgcgttcgcgaaacgcgtcgcgctgcaggtgcgcgcgggcctgctgaattcggcgacgcgtttccagatgcccacgctgccgggcggcggcacggcgccgccggtcaccgcgccggtggcgaccgatcagcagggcggcggcggcttcaccgacgatcccggcatgacgggcggcgaccgcgggcccgcgccgctgatgatgacggggtcgacagcctgctcgacgtcgacggcgtgacgcccgagatggtcgcgcggctgcgcccgttcgtcaccgtgctgccgaccacgacgcccgtgaacatgaacaccgcgccggccgaggtgatcgcggcgctgatcccggggatgagcgtgtcgtccgcgcaggcgctcgtgtcgcgccgcgagaccgtgtttttccgcaacgtcgccgatgtgcagctcgcgctgcgcggcgccggtgcgccgccgaacgtgacgctcgactcgagtctcgtcgacgtcaattcgagctatttcatcgtgcatggccggatccagcacgaacgcgcggaggtcgatcgcacctcgctcgtgtatcgtgatccgaccacgcattcgacacgggtcgtgcgcattcgcgaccagctataacgacgccattcgggagaggagctcttgtgagcacgttgattgtttctttgccgccgcgcgagcctgccgtgccgttgcaggaatggcagtggcccgagctgccgttcacgctcgtcgacaaggccggccacgtgcagcgcgcgggccgcgccgcgctggcgctgctgccgcgcgcgaatgcgacggtgctgatcgtcgccgcgcgcgacgtgctgctgctggccgcgaccgtgccgccgctcaagggtccgaagctgcgccaggcgctgcccaacatcgtcgaggatcagctgatccaggatccgctcggctgtcacatcgcgctcgatccggatgcgctgcccgacgggcgccgcgtgctggccgtcgtcgatcgcgcgtggttccgcacgatctgtgaagcgttcacggcggccggccaccggcacctgagcgcggtgcccgcgacacgctgcctgccggcgccgcacgcacccgccgcgccggccgacggcgaggtcgacgttgcggcggttgccgcggacgccgtcgacacgccgccggcccgcccggcgacggtggccgcggtgctcggcctcgcggcgccggtcgaaccggtgctcgtcgaggccggcgcgctgccggccgcggccggtgcgccgcgcctcgaactcgcggtcgcgcgcggtgcgctcggcgaaggcttcgcggcgcccgcgtcgcgcgcggccggcacgctggccgcgctcgcgggcggcggcgacgtcgaactgtacgaactcggcgagccgggcgcggagccgcggctcgcgtcggtcggccgcgccgacggcccgctgctgccgggtgccgcgccgctgtcgttcgacgcgttcgcgcggcgcgcgctgaccgagaagttcgacctctgccagttcgaattcgaatcgcagccgtggcgcttcgaccgcgcgacggtgaagcgcctgcgcgtgccgctcgcactcgccgcggcgacgctcggcgtggcggtgatcgggatgaacctgcactggtggaagctgtcgcgcgagcgcgatgcgctgtcggcgcagatcaccgaaacgctgctgtccgcattcccgaagacgacgacggtgctcgatccgcccgcgcagatgcagcgccagctcgaccagttgcgcgtggcggccggcgagctgtcgccgaacgatttcctcgcgctgtcgagcgggctgtcgcgatcgatgggtgcgctgccgctgaacggcatcgcgtcgctcgactatcacgaccggcggctcgacgtcggcttcaagccggaggtcaaggtcgatcccgatttcacgcagcgcctcgcgcgtaacggactgtccggcgaagtcgacagcaacacgggcaaatggacgatccggagccgctcatgaagacggaacaactgaaccagacgctggcccagttctggggcgaacgctcgccgcgcgaaaaatgctgctcggctggggtggcgccgtgctggcggtcgcgatcgcgtattcggtgctgtggtcgcccgcgcaggaaggccgcgcgcggatccagcgcgagctgccgacgatgcgccgcgagcttgcgcagatgaccgcgcaggcgaacgaggcgaagtcgctggcggccgccgcgcaaggcgtggcaccgaccggcctcgcgctgaaggatgcgctgaccgcatcgctgtccgatcacgggatgcagggtgcgcaggtgcagatcgtcggcaacggcgtgcagatccagatgaagaacgtgtcgttcccggcgtggacgcagtggctcgacgatgcgcgccggcagttcaaggtgcaggtcggcgaggcgcatgccactgcactgaaggacgacggccaggtcgacctgacggccgtgatgcaaccgtctacgcagaaatgacgcagtggatgacgcaagtggcggtcggccgatgaggccggggatgaagcggctcgccaccgcattgccgtgggtactggcgggcggactggcgacggcggtgacgctcgtcgcgctcgcgccggccgcgtggatcgcgccgcagttcgcgcgcgcgaccggcgggcacgtgaatctcgtcgatccggacgggtcgctgtggcacggttcgggcacgctgatgctcgcgccggggccgaccagagcgcggcgacgctgctgccgggccgggtcgaatggaccacgggcttctggccgctcctgaccgggcgcgtgcagatgcgcatgcggcagaccgacgcgatgccggatgcggtcacgctcgatgcgacgtggcgcggcgcggtgttgtcggcgggcacgatggccgtgccggcgtcgctgctcgcggggctcggcacgccgttcaacacgctcgacctgcaaggcgacgtgcggctcggctggagcgactggcgcctgatcggcaacaacgcgttcggccagctgacggtgacgatcgactcgatgagttcgcgcatttcgcgcgtgaagccgctcggttcgtaccgcgcggtgctgcaggcgaaggggccggcgccgatctcgacctgtcgacgacgcagggcccgctgtttctcgacggccacggcaacttcggccccggccaggatcgttccgcggcaccgcgcattcggcgcccgagcagcaggcgaacctcgccgggctcctgaacctgctcggccacccgatcgggaacaacgaggtttcgctgatcttcggcgacgcgcagcgctgacgcgcgcgtcgccctttccttcctacttctgcgcgagcggcgcggcgaccgacggcgcggtggccgccggcgcggccgcaccgaacgccggcacgggtgcgggcgcggccatgtcgccgttctcgcgcgccatctccgcgacgttccacccgccgccgagcgctttcacgagcccgaccgacgacaccatccgctgcccggcgatcgtcgcgagcttctgctgcgcggtgaacgcggtggtctgcgcggtcagcacgttcaggtaggcgaccgtgccggccttgtactggttcgtgacgatcgcgagcgcgtgctcggcgctgtcgacggcctgtcgctgcacgtcgatttcctgcgcgaggatgcgttgcgacgcgaggttgtcctcgacgtcctggaatgcggtgagcaccgcgaggcggtatgcggcgacgtcctggtcgtaggtcgcacgcgcggcgtcggtctgcgcggcgcgcagccctgcgtcgaacagcgtggccgcgagctgcgggccgaccgtccagaagcgggccggcagcgtgaacagctgcgaccacaccgagctctggacgccgccggtggccgacagcgtgagggtcgggaagaatgccgagatcgcgacgccgatctgctcgttcgcggccgccgcacggcgctcggccgccgcgatgtcgggccggcgctcgaggatcgcggacggcacgtcgaccggcgtgatcggcggctcggctgcgagcggattcggcggcagcgagaaggtcgacgccggttcgccgatcagcgtcgcgatcgcatgctcgtactgcgcgcgtgcgacgccattgtcgatcgacgccgcctgcgcgctctgcagttgcgtctgcgcctggatcacgtccgcgcgcgcggcgacgccctgcgcgtactggttctgcgtgagcgtcagcgaccgctggtacgacttcacggtgtcgtcgagcagcttctgcagcgcatcggacgtgcgcagctggtaataggtttgcgcgagcagcgcctgctgcgacagccgcgcgttcgcgagatcggccgcggcggccgcttcgccggcgcgctgcgcgctgacggtacggctcaccttgccccacaggtcgggttcccagctcgcgtcgaggccgacgctgtagctgttgttgatcgaaccggacgaaccgctgccgaaacccgacgacgaacccgacgatatcgacgtgcgcggcgtgcgggcgcgcgagcccgacgcggtcagcccgacggtcgggaaatacgcggcacgcacctcggtgacgagcgcgcgcgcctgccggtaagcggccgccgattgcgcgatggtctggttcgaggcgttgagcttgctgatcagcgcatcgagctgcggatcgttgtagaccgtccaccacgggccgcgatcggtgcggtcggcgggttgcgcaaccttccagccggccggcgcttccttgtatgcggcggggatcgacgtgtcgggccggtgatagtcgggcccgacggcgcagccggcgagcagcacggccgtcgcgacggcgacggcggcgctcagcgggcgaagggcgcgcgggagggaggcgtacggcatggtgatattcctgtctgggcgcgacgtccggcgagcggcgtcgcgcgatgcggtcgtcgtgccgctggcggacaaatggtaactgacggcgggatagctgcgcagcccaaagggtacggtgcgcggcgacaggaatgtgttaccggcgcgagcggccggtttaccggccattacggctcgccggccggaagacgggcgggcgatgccggccgtgcggggctgcggccggggttcggacggaacagtcaggaagacaggcgggagggtgcgccgtcagtggcagcgtgcgggcagcgggagcggttcggcggcgggccgccatgtcgacggctccgtcgcggccggctggcccgtgcggcgcgcaccgtctttcgcgttgcgctgccggcgatgatcgaaccatgccaccccgagcgccgcgagcgagccgcccggcaccaccagcatcgtcacgtacagcgcgatcttccagccgcggtgcggcccggaaaacacatggtgagcggtatcggtcaggttgcggcgcagcgcgccggcggcattttcaggaacagcatcgcgaacatcctcgggtgcccggcagcgcgggcgaatcggtcagaacatagtctccggcagtgcaacatgcacgtcgtaactggtagtctcgaataatattgactaagcaatcaattttcaagatactgggcgcgtccaaatccgaaacgcactattgctgcgcgcgcaatcgcatgaccggcggcctctacgatcccgagaacatcacgctggaaacgagcctcggctattacctgtcgaaggcgaagcaggcgctcgtcgagcggatggatcgcgcgctcgagccgctcgacctcaccgcgcagcagatcggcgtgatcctgctgctggcacgtggttatgcgcgtacgccgttcgagctgtcccgcaagatgtcgtacgacagcggctcgatgacccgaatgctcgaccggctcgaacgcaaggggctgattgcccgttcgcgcagcgagcaggaccgccggatgatcgagctgacgctgaccgaacgcggcgccgaagccgcccgtgcgctgccgtcgctgatcgcgaccgcgctcaacgcgcagctcgacggtttctcggccgacgagcttgcgacgctcaccggcctgctgcaacgcttcatcgccaacgggcccggcacggccggctgcccgaaacccgacgacgaagcggactgctgatgtgcgcggaggcccccatgtctaggttaagcgttcgcttatttatctgtctgggcagaagatgacagggcacgcgctccccttttccctttatccgttccacccggccgggctgcgctgcggcgcacacccgtgcgttgtgccggcgcgtcgcgcgcgccgcgtctaggagatttcgatgtccgccaccacggcatccgccgcctccccgccgccgaacccgcgccgctgtccggcggtgcactcgcgctgctcaccgtcgggctggcgctcggcaccttcatggaagtgctcgacacgtcgatcgcgaacgtcgcggtgccgaccatctcgggcagcctcggcgtcgcgacgagcgaaggcacctgggtgatctcgtcgtactcggtcgcgtccgcgatcgcggtgccgcttaccggctggctcgcgcggcgggtcggcgaggtgcggctgttcacgctgtcggtgctcgcgttcacgatcgcgtcggcgctgtgcggcctcgcgaccaacttcgagacgctgatcgcgttccggctgctgcagggcctcgtgtcggggccgatggtgccgctgtcgcagacgatcctgatgcgcagctacccgcccgcgaagcgcgggctcgcactcgggttatgggcgatgacggtgatcgtcgcgccgatcttcggcccgctgctgggcggctggatcagcgacaactacacgtggccgtggatcttctacatcaacctgccgatcggcatcttctcggcgacctgcgcgtatttcctgctgcgcggccgcgagacgaagacgacgaagcagcggatcgacgcgatcggcctcgcgctgctcgtgatcggcgtgtcgtgcctgcagatgatgctcgacctcggcaaggaccgcgactggttcaactcgacgttcatcgtcgcgctcgcgctgatcgcggtcgtgtcgctcgcgttcatgctcgtgtgggaggcgaccgagaaggagccggtggtcgacctgtcgctcttcaaggaccgcaacttcgcgctcggcgcgctgatcatctcgttcggcttcatggcgttcttcggctcggtcgtgatcttcccgctgtggctgcagacggtgatgggctacacggcgggcaaggccggcctcgcgaccgcgccggtcgggctgctcgcgctcgtgctgtcgccgctgatcggccgcaacatgcaccggctcgacctgcggatggtcgcgagcttcgcgttcatcgtgttcgccggcgtgtcgatctggaactcgacgtttacgctcgacgtgccgttcaaccatgtgatcctgccgcgtctcgtgcaggggatcggcgtggcgtgcttcttcgtgccgatgacgacgatcacgctgtcgagcatctccgacgagcggctcgcgagcgcgtcggggctgtcgaacttcctgcgcacgctgtcgggcgcgatcggcaccgcggccagctcgacgttctgggagaacgacgcgatctaccaccacgcgcggctgtcggaatcggtgagcgtgtatgcgcagagcacgaccgactaccagggcgcgctgtcgcagctcggcatcgtcggccagacggccaacgcgcagctcaaccagctcgtcacgcagcagggcttcatgatggcgaccaacgacttcttcctgctgtcggccttcatgttcggcgcgctcgcggcgctcgtgtggatcacgaagccgaggaaggggcggggccggcgatggggcattgaaatcggcaagcggttcgagggtgacgcatgaagttgctgctcgacacacgcctgcttcttcgggcggcagccggtgcggccgagctgcccgccccgcgccggtgcgctcatcgaggatcccgcctgtacaccgcttttcagcgtcgcgagcctctgggagatcgtcatcaagcgtggcctggatcgcgacgatttccaggtggacccaaacgtgctccgtcgcaatctcctcgatgtcggctacgtggaattgccgatcacgagcgcacacgcacttgcagtcgaacaactgccgccgatccatcgaaatccgtttgaccgtctcctggtcgcgcaggcgatctcggaaggcattacgctgcttgcgcacgaccctgccgtcgcccgctatccgggcccgatcaggcacgtccgagtgcgccgggcatcgcccggccgtcacgccctcgcccgcaacccgccgaacgccagatcgtcgccgggcgcgatgggcagcgtcgcccgcgcgacgtcgagccacgcgcgcgccgcgtgcgacagataccccttcttcagccagccgagcgcgatcgcccacgtgatttccggctcgacgatcggccggcacgtgaactggcccgcgtcgagccgccggcagtacggctcgggcagcagcgcgatgccgaccccgcatgcacgagcgcggccatgaaatcccagtggccgctgcggctcacgatcgacggcgtgaagccggcctgccggcacgcgtccagcaccgcgtcgtgcagcgcgaggctttccgcgtagaacacgaacgactcgcgcgcgagatccgcgagcggcacggccgcgtgatcctcccagcgcgactcgcgcggcgcgacgagccacaacggcgcacgcaccatcggcagccgctcgaaggtgccgggatccaccggctccagcagcccgccgagctccagttcacccgacgtcagcgcggcctcgatcatccgcgcgccctgctcgaacagcttcagctcgatgttcgggtagcgctgcttgtacgcggcgatgatcggcgtgaacagcgagccgccgagcggcgggatgccgatcgtcagctcgccgcgcccgagcgtgccgagatcgttcagctccgactgcagctgcgcctgtgcggcgagcacgtcctggccgcgctggaacacgatccgcccggcgtcggtcagcaccatctgccggccgtcccgcagcagcagcggcgaaccgatctcgtcctccagcgccttcaccatcttgctgatggtcggctgggtcacgaacagcctgtcggcggccgccgtgaagctctgctggcgaaccacctcgacgaagtaccgcagtgcgcgcaattccatcgatcactccccagattggtgcaacaaactcaatcagaattccgaattggaatgataaggatagagacaagtcattttatttatggttagggaaaccctatactcctcccatcgacgcaatatctgtatggagcctgccatgaccaagacgaccgctaccgccgccgcccgccccgccgcttcgggcagcatcgcgcacacgggccggatcgtgctgcaggccgccgcgctcggcgtgctgtggatggcggtcgactgggccgtgcgcaggatcgggctgccgattccgtccggcgtgatcggcctcgcggtgctcctcgtgctgctgttctcgggccgcgtcgcgcctgcgtgggtgaaggacggcgcgaactggctgctgtccgacatgctgctgttcttcgtgccggccgccgtcgcggccgtgcagtacggcgggttgttccgcgaggacggctggcgcatcgcgctggtgatgctcgccggcaccgctttcgtgatggtcgcggtggccgtcgcggtcgacctcgccgcgaagctcgagcgccggctcgccgcgcagcgcgtgttcgccgaacgccgccgcgcgcgcctcgccaccgtgtccgcccactgagccggagcctgccatgttgccgctgctgtcgagcctgtccgccgaccaggtgaataccgcgatctccgtcggctgcttcgtgctgacggtcgcgctgtatttcgcgtcgaagcggctctacgcgtacaggaagacgctgctgttctcgccgctcgtgttcgtgccgggcgtgctggtgctgctcgtgctgctgaccggcatcccgtattcggtctacttccgcgacacgcgctggctgatgtggctgctcggcccggcgacgatcgcgttcgcggtgccgatctacgactatcgcgacctgatccgccgccactggctgtcgctgtcggtcggcgtcgcggtcgggatcggcgcgggcgtatgcggctcgctgctgctcgcgaagctgctgcacctgtcgcccgagctgcagcgctcgctgatgacgcgctcggtctcgaccccgttcgcgctcgccgtctccgacaagatccatgcgccgaaggacctcaccgccctcttcgtgatcgcgaccggcatctgcgggatgctgctcggcgagatcgtgctcgcgctggtgccgatgcgcactcggctcgcgcgcggtgcgctgttcggcgcggccgcccacggcgtgggcaccgcgaaggcgcgcgagatcggcagcgaggaaggcgtcgtgtcgagtctcacgatgatgatcgcgggcgtcgcgatggtgctgatcgcgccgctgctgtcgctgttgccgatctgacgttgtccgggcgggcgccacggctcgcccgccccaccgctcctcgcctttcccgcccgacggagcgccggcccgccgcccccggccggtttcccccgccgttcccgccctgcaccgagccgcgccggccgacaatcggctgagatagccgcaaatccccctcttttccgcccatcaggctcggcccggatgccgaacaatgcatgctacgagacatcacgcacgcatccacatggcctccacgaccgcaaacccgaccgccgacaagccggcttcgtccggcaagttcaagcgcatcgcgctcatcgccgtcatcgcgctgggcgcggcggccgccgcagccggcggcatgtacgtgttcctgagcaaggaaggcgtcggccatgcgagcgcgcccgccgagccggcgccctcgccgcgccggtgttcttcccgctcgacccgctgaccgtgaacctgcagtccgacgacggcgcgcagcactacctgcgtgtcggcctgtcgctgaagctcaccgacccgaaggcgcaggagcaactgaccgcgcggatgccggagatccgcagccggatcctgctcgcgctgtcgaacaagcatcccgaggatctggcgacgccggacggcaaacgttcgctcgcgaaggaactgcgggaactgatcgaacagccgacgcagccgggcaaccagcgcgcgaaggtcgacgacgtgctgttcaccgaattcgtcgtccagtaacgcggccgcgaaaggagcgcgtatgggccaccaggagttcatgtcccaggaggaggtcgatgccctcctcaagggcgtcacgggcgaaaccgatgcagtcgacgagcagcgcgacacgtcgggcgtccgcccctacaacatcgcgacgcaggagcggatcgtccgcggccggatgcccggcctcgagatcatcaacgaccgcttcgcgcgcctgttgcggatcggcatcttcaacttcatgcggcgcacggcggaaatctccgtcagccaggtgaaggtgcagaagtacagcgagttcacccgcaacctgccgatcccgacgaacctgaacctcgtgcacgtgaagccgctgcgcggcacgtcgctgttcgtgttcgacccgaacctcgtgttcttcgtcgtcgacaacctgttcggcggcgacgggcgcttccacacgcgcgtcgagggccgcgatttcacggccaccgagcagcggatcatcggcaagctgctgaacctcgtgttcgagcactacacgaccgcgtggaagagcgtgcggccgctgcagttcgaattcgtgcgctcggagatgcacacgcagttcgcgaacgtcgcgacgccgaacgagatcgtgatcgtcacgcagttctcgatcgagttcgggccgacgggcggcacgctgcacatctgcatgccgtactcgatggtcgagccgatccgcgacgtgctcgcatcgccgatccagggcgaggcgctcgaagtcgaccgccgctgggtgcgcgtgctgtcgcagcaggtgcaggccgccgaggtcgagctgaccgcgaatctcgccgagatctcgtcgaccttcgagaagatcctgaacctgcgcgcgggtgacgtgctgccgctggagatcgaggacacgatcaccgcgaaggtcgacggcgtgccggtgatggaatgcggctacggaattttcaatggtcaatatgcgttgcgcgtgcagaagatgatcagcgcgggcgactcgatgaaggaaggtggatatgagtgagctgaaccagacgcccgaggacgacgcgcaagcgatggccgacgcggccctcgcggcctcggccgccgccgcgcaggcggcgccggccgcagcggaggaagatccgggcatggacgactgggccgccgcgctcgccgagcagaaccagcagccggtgcagccgggcgcgacgggcgccggcgtgttccagccgctgtcgaaggccgcggccagctcgacgcacaacgacatcgagatgatcctcgacatcccggtcaagatgaccgtggagctcggccgcacgaagatcgcgatccgcaacctgctgcagctcgcgcagggttcggtcgtcgagctggacggcatggccggcgagccgatggacgtgctcgtgaacggctgcctgatcgcgcagggcgaggtggtggtcgtcaacgacaagttcggcatccgcctgaccgacatcatcacgccggccgaacgcatccggaagctgaatcgatgaacgtggcgaagcccggccgccgtgcgcgcgtcgcgagcgcggtggcggctgtcgcggccatcgcggcgtcgctcgcgtgcgcaccggccggtgccgccgacatgaacgcggtgaacaacgccggggcgatcgcgtcgagcgtgaccgtcggttcggccgcgccgtcgctgggcatcggcgcggtgctgcagaccctcgtcgggctcgcggtcgtgatcggtctcgtgttcgcgtgcgcgtggctcgcgcgccgcttcggctttcagcacgtgcgccgcggcggcccgctgaaggtcgtgtcgagcgtcgcggtgggcgccaaggaaagcgcgacgatcgtcgagatcggcgacacctggctcgtgctcggcgtcgcgccgggcaacgtgcggctgctgcatgcgctgccggccggttccgcggcggccggcgcgacgaccgcctcgaccggcgcaccttccggcgccgcaccgtccgaaggcggcctgcccggcacgttcggctcgcggtttcgcgacgcgctcgcgggcgaagccgcgaagcgcctcggtcgcggcaaggaccgctgacatggcgccgcgccctctttccgatcccgcatttcgatgaaacacgcattcctgcatcgcgcggcgcgcttcgcgcccgtgctgatcctctgcctcgcccccgcgctcgcgtgcgcgcaggcgaacggcctgcccgcgttcaacgcgagcccggcccgcacggcggcaccacctattcgctgagcgtgcagacgatgctgctgctcacgatgctgtcgttcctgccggcgatgctgctgatgatgacgagcttcacgcgcatcatcatcgtgctgtcgctgctgcgccaggcgctcggcaccgcgacgacgccgccgaaccaggtgctcgtcggcctcgcgatgttcctcaccttcttcgtgatgtcgccggtgctcgaccgggcctacaacgacggctacaagccgttttccgacggctcgatgccgatggagcaggccgtgcagcgcggcgtcgcgccgttcaagaccttcatgctgaagcagacccgcgagaccgatctcgcgctgttcgcgaagatctcgaaggccgcgccgatgcagggtccggaagacgtgccgctgtcgctgctggtgcccgcgttcgtcacgagcgagctgaagaccggtttccagatcggcttcacggtcttcatcccgttcctgatcatcgacatggtcgtcgcgagcgtgctgatgtcgatggggatgatgatggtgtcgccgtccaccgtgtcgctgccgttcaagctgatgctgttcgtgctggtcgacggctggcagctgctgatcggctcgctcgcgcagagcttcacgtaagccgggaggaaacgcacgatgacgcccgaacaggtgatgaccctcgcgcaccaggccatgatggtcggcctgctgctctccgccccgctgctgctggtcgcgctcgcggtcggcctcgtcgtgagcctgttccaggccgcgacgcagatcaacgaagcgacgctgtcgttcatcccgaagctgctcgcggtggccgcgacgctcgtgatcgccggtccgtggatgatgacgacgatgctcgactacctgcggcagacgctgctgcacgtcgcgacgctcggcgtcggctgagccgcgcgcgcacgatccggcggcgatgttctcggttacctacgcgcagctcaacggctggctcacggcgttcctgtggccgttcgtgcggatgctcgcgctcgtcgcgaccgcgcccgtcgtgggccacgcgtcggtgcccgcgcgcgtgaagatcggcctggccgcattcatggcgctggtcgtcgcgccgacgctcggcgcgatgccggacgtcaccgtgttttccgcgcagggcatctggatcctcgtcacgcagttcctgatcggcgccgcgatgggcttcacgatgcagatcgtgttcgcggccgtcgaggcggccggcgacttcatcgggttgtcgatggggctcggctttgccaccttcttcgatccgcacacgagcggcgcgacgcccgtgatgggccgcttcctgaacgcggtcgcgatgctcgcgttcctcgcggtggacggccacctgcaggtgttcgccgcgctcaccgcgtcgttccagtcgctgccggtgtcggccgacctgctgcacgcgcccggctggcgcacgctcgccgcgttcggcacgacggtattcgagatggggctgctgctctcgctgccggtggtcgcggcgctcctgatcacgaacctcgcgctcggcatcctgaaccgcgcggcaccgcagatcggcgtgttccagatcggctttcccgtcacgatgctcgtcgggctgttgctcgtgcagctgatggtgccgaacctcgtgccgttcgtgtcgcacctgttcgacatggggatcgatgcgatggggcgggtgttgaccggctggcgctgagcgcatcccgcccccgtcggccgcctgttccggcccccgttgctggaaaacccctaaaggttccactgtcccgcgaaaggttgcggaaggtttcacgtccctatactcgtcgcaacgatgcagcaagcatcgcgcctgacgaatacaacgaacggagacaacccgatgcgacccatcctgcgcaccctcgccgtggcagccagcctgagctgcgcgcttgccgcccaccccgccctcgccgatgacggcggcaagatcacgatcatggtcggcgggatcgcgaagctcatctacctgcccgcgcggctcacgcaggaactcggctacttcaaggacgaagggctcgacgtcgagctgctgtcgcagccggccggcgtcgacgcggaaaacgagctgctcgcgggcgcggtgcagggcgtcgtcggcttctacgaccacacgatcgacctgcagagcaagggcaaggacgtgaaggcgatcgccgtgttcggccaggtgccgggcgaagtcgagatggtgtcgaccaaggccgcgccgaccttcaagtcgatggccgattcgaagggcaagacgctcggcgtgacgggcctcggctcgtcgaccagcttcctcacgcaatatctcgcgctgcagcacggcgtgccgtcgacgcagtacacgatgctgccggtcggcgccgacgcgagcttcatcgccgcgatcaagcagggccgcatcgacgccggcatgacgaccgaaccgacggtatccgcgctcgagaagatgggcgacgcgaaggtgctggtcgacctgcgcacgctggaaggcacgcgcgcggcgctcggcggcacctacccggccgcgagcctgtacgtgcagtcggcctgggccgattcgcacaaggcgcaggcgaccaggctggcgcatgcgttcgcgaagacgatgcagttcatccacacgcacagcgccgaggaaatcgccgcgaagatgccggccgactaccagaaggacaaggcgctgtacgtgagcgcgctgaaggcgtcgctgccgatgtacaccgccgacggcaagatgccggccgacggaccggccaccgtgctgaaggtgctgtcggcattcaacccgtcggtgaagggcaagcatatcgacctggcgcgcacctacacgaacgatttcgtgaatgcgaagtgatcgatcccgatagcggcgcgggcggcggcgatcccgccgccttgcgtgccccgttccggcccggttgaccggcccggcgtcgccacggtgcggcgccatcctcacccgcaggacgaatgcgatgaaccaggcagtctccccgagcacaccggcgatcgagtttcgcaacgtgtcgtgccgcttcatttcgccggaaggcaaggccaccgtcgcgctgcgcgacttcagcatgagcgtcgcgcgcggcgagttcatcgcgatcgtcgggccgaccgggtgcggcaagtcgacgacgctgaacctgatcaccgggctgctcaagcccgcgtcgggcgaagtgcgcgtgatgggccgcccggtcgacgggatcgacccgcgcatcggcttcgtgttccaggccgacgcggtgttcccgtggcgcaacgtgatcgacaacgtcgcggcgggcccgctgtttcgcggccgctcgaaggacgtcgcgtatgcgcaggccgaggaatggatccgcaaggtcggcctcgacaagttcacgaagcactacccgcaccagctctccggcgggatgagaaagcgcgtcgcgctcgcgcagaccttcatcaaccagccggaaatcctgctgatggacgagccgttctccgcgctcgacatgcagacgcgcacgctgatgcaggacgagctgctgcagctctggtccgcgaacaagggctcggtcgtgttcgtcacgcacgatctcgaggaggcgatcgcgctcgccgaccgcgtgttcgtgctgaccgcgcgccccgcgacgctcaagcgcgtgtacgagatcgacctgccgcgcccgcgcgtcacgtcggagatccgctacgacacgcgcttcatcgaaatttccaaggacatctggcacgacctgcgcgaagaagtgcagatcggctgacgcatacgccgcacggcaaggacagcaaggacaggagcatgaccgacatgacgcttccccaccgccatcccggcgaagtcgctcgacgacgagtcgcgcgccgcgcaaacccggctgcgccgccgccggcaactgatcatcggcctgcggatcgcggtgctcgtcgtcgtgctcggcggctgggaactcgccgcgcggctcaagtggatcgacccgttcttcttctcgcagccgacgctgatcttcgcgcagatccaggactggttcgtcaacggcacgtcgcaagggccgctgctcacgcaggtgtgggtgacgctcgaggaaaccacgatcggcttcctgatcggctcggtggccggcgtgatctgcgggatcgtgctcggccgcaacaagctgatggccgacgtgttcggcctgtacatccagatcgcgaactcgattccgcgcgtcgtgcttggctcgatcttcgtgatcgcgctcggcctcgggatggcgtcgaagatcgcgctggccgtcgtgatggtgttcttcgtcgtgttcggcaacgcgttccagggcgtgcgcgaagccgaccgctacctgatcgcgaacgcgcagatcctcggcgcgtcgcgccggcagatcaccacgtcggtcgtgatcccgtccgcgctctcgtggattctcgcgagcctgcacgtgagcttcggtttcgcgctggtcggcgcggtcgtcggcgaattcctgggttccaagcagggcatcggtttgctaatctccaccgcccagggcgcgttcaacgcgagcggcgtgttcgcggcgatgatcgtgctggccgtggtcgcgctggccgccgactacctgctgacctggctcgagaagcggctgctgaagtggcggcccgcggcgttctgaacgccgccggcgcacgcctgacatgacacttccgaccgcgccggcgctcccggcgcggttcggcattccggaaaaggagcgcaacaggatggcgcacagcctgcgcgggcgattgctgtggtggctgctgctgccgctcgcggtgttcgtgctgatcgcgggcgcgatgtcgtacgacaccgcgcggaccacggccgcgctcgtgcaggacagcgcgctcgtcgcatccgcgcgcacgatcggcgaggacgtcgaatggcgcaacgggctgccggtcgccgacgtgccgccggccgcgctggagatcttcgaatcgccgtcgcgcgattcggtgttctacaaggtgatcgacgggcacgaccgcctgctcgccggcacgccggcgctcgacgtgcccgcgcggcacggcgtcgagccgacgctgtacgacacgtcgctcgacggcgtgccgctgcgcgcggtggcctacgatcgccagctgtacgacgaagggcaggtcgagacggtcacggtggtcgtcgcgaagacgacgcgctcgcatcgcgcgatggtcgccacgatctggcggccgcagctcgtgcgcctgtcgctgatgctgatgctcgcgatggggctcgtgtacctcggcctcaccttcgagatgcgcccgctgatgaagctgaaggacgacgtggccgaccgcgggccgatggagctggagccgatccgccccgagcggctgcagaacgagctgcggccgatcgtcgatgcgatcaaccagtgcatcgcgcggctgaacatgcacacggccacgcagcgccgcttcatcgcggacgccgcacaccagttgcgcacgccgatcgcggtgctcgacacgcagatccagtacgcgcagcggcgcgggcacgacgatccggagctcgcgtcggtgctcgacagcatgcagcgcagcagccgcaagatggccgacgtgaccgacaagctgctgctgctcgcgcatgcggaggccacgccgtcgacgctgctgacccagcgcgtcgatctcgcggtcgtggtatcgagcgtgctcgaggaaacgatcgtgctcgcgcagcggcgcaatatcgatctcggcgccgatctcggcgaacggctcgacgtcgcgggcagcgacagcctgctgaccgcgctggtgatgaacctcgtcgacaacgcggtgcgctacacgcagcccggcggctgcgtgacggtggccgcacgccgcgacggcgacgcgatcgtgctcgacgtgatcgacaacggccccggcatcccggccgaagcgcggccgcacgtgttcaagcggttctaccgcgtgtcggccgacaccgaaggctcgggcctcgggctcgcgatcgtccgcgaaatcgcgcaggcgcacggcggcagcgcgtcgctcgcgccgggggccggcaatcgcggtatcgtcgtgaccgtgcggctgcccgcctacgcctgaagagaagtcgccatgaaactcctgctggtcgaagacaacgccgaactcgcgcactggatcgtgaacctgctgcgcggcgaggacttcgcggtcgattccgtcggcgacggcgagcgcgccgacacggtgctgaagaccgaacgctacgacgcggtgctgctcgacatgcgcctgccgggcatcagcggcaaggaagtgctcgcgcggctgcggcgccgcaacgacaacgtgccggtgctgatgctgaccgcgcacggttcggtcgacgacaaggtcgactgtttcggcgcaggcgccgacgactacgtcgtgaagccgttcgaatcgcgcgaactggtcgcacggattcgcgcactgatccgccggcaggccggcgtcggcacgacgcagctcgtgtgcggcgatctcgtctatgcgttcggcacgcgcgaattccgctgcggcgaaacggtgctcgcgctgcgccgccgcgagcacgcgatcctcgagacgctgatgctgcagcagaacaagacggtatcgaaggcgcggctgatggacagcgtgttcgcgctcgacgacgagcccagcgccgacgcgatcgacatctatattcaccggctgcgcaagcatctcgcgggcagcacggccgagatcatcacgctgcgcgggctgggttacatcctgcgcatgaagagcgcgcacgactgacgggcacgcacccgccgctccggacgtcgattcgtagcacgaaaggttgaccaggccagccggacaccccgcaggcccgcttgcgcacgcctgcccgcgccgtgatcgttgcgcgttcggtgttttcaccgatccgattcccgagtccgggaaagcggcgtgaaggattgccctctacgatgctagatgtcggccccctcgctgtggccgtcaacatccggcatacattgcgtactgccaacgaacagatttcaatgcggcagctcggaggagacgatcttgaaacgaaaaacccttgccctttccatcgcggcggcaggcctgtgcgccggtacccaggcacatgcgcagtcgagcgtgcagctctacggcctgatggacctgagctttccgacctaccggacccacgccgacgcgaacggcaagcatgtgatcgggatgggcaacgaaggcgagccgtggttcagcggcagccgctggggcctgcgcggcgcggaagacatcggcggcggcacgaagatcatcttccgcctcgaaagcgaattcgtggtcgcgaacggccagatggaagacgaaggccagatcttcgaccgcgacgcatgggtgggcgtcgaggacgagcgcttcggcaagctgacggccggcttccagaacacgatcgcgcgcgactcggcggcgatctacggcgatgcgtacggctccgcgaggctgtcgaccgaggaaggcggctggaccaactcgaacaacttcaagcagatgatcttctacgcggccggcccgaccggcacgcgctacaacaacggcgtcgcgtggaagaagctgttcagcaacggcatcttcgcgagcgccggctaccagttcagcaactcgacctcgttcgcgaccggctccgcgtaccaggccgcgctcggctacaacggcggcccgttcaacgtgtcgggcttctacaaccacgtgaaccacaacggcttcaggaaccagacattctcggtcggcggcaactacacgttcgacatcgtgcgcctgaacgccggctacttccgctacaacggcgaccagggcccgctcggccagcgtcacgacgattcgtggacggtgtcgatgaagatcgcgccgaagggcgcgctcgactacgagctcggctaccagcagatgcgcatcaagaacgccgcgaacaatgcggacggcttcacgccgaacgcgaacctcggcgcgttcagcctgaccaacggcgtcgccaacggcttcaaggagacgatctacgggtcggtgttctatcacctgagcaagcgcaccgaggtgtacctggccggcgactacatgaagctgcacggcggctacacggtgtcgtcgacgttcggcgcgaagaaccagctcgaactgacgtcgggcatccgcacgcgtttctgacctgcgggccggccatccgggcggggcgtgcggtacccgcctttccctccctccgggatgtctccatgcgggcacgccggcacttcgcgccgaccgtgccctttttcgtcctttccgcggcgctccggggtgcccggacaacggccgccggccgcccgtgcgacaaccggcccgaagccgcttgcggcccgtggggcgggcgatcgcggccgatgcccgcacgctcgggccacatcggcgcttgacctcggccggtcgactcgatagcgtttcgggtttgcccgggtggccattgccgccggtgccgtgagcgcgcccgacgtcctggcgcgcgcggccgggctccgatggaaaagacgatgcagaaactcgatgcggccagcccgcaggcgatgtcgaccgatttcaccgccgacaacgtcgcgcgcctgaaggcgctgttccccgaactcgtgaccgaaggccccggcggcgcgtcggtcgacatcgacgtgctgaaggcgctggtcggcgaacgcacggtcggcgacgccgaagaacgctacggcttccactggcatggcaagcgcagcgcgcgccaggccgcgctcacgccgtcgaccggcacgctgcggccctgccccgacgacagcgtcgcgtgggacgacacgcgccatctcgtgatcgagggcgacaacctcgacgtgatgaagctgctgcacaagagttacgccggcaaggtgaagctcgtctacatcgacccgccgtacaacaccggcagcgatttcgtctatccggacgacttcagcgacagcatccgccactacctggcgatgaccgggcagacccagggcggcgtgaagcgcagcaccaacaccgaggcgaacggccggttccacaccgactggctgaacatgatgtatccgcgcctgaagctcgcgcacgcgctgctgtccgacgaagggctgatcgcggtgcacatcgacgagcacgaagtgcacgcgctggtgctgatgctgcgcgagatcttcggcgaggagaacgagctcggcgtcgccgtgtgggacaagcgcaacccgaagggcgacgcacgcggcgtcgcgtaccagcacgaatcgctggtgctgttcgcgcgcaatgccgagacgctgctcgaacgggcgccgctcaagcgcccgaagcgcaatgcgcagcgcatgctcgacgccgcgcacgacgccgtgtaccgcagcggcaacgcgaaggacgcgcagaaggcgtaccgtgcgtggatgaaggcgcagaccaacctgtcgggcggcgaggtgatgtacgaccggctatcggccgacgggcgcgtgtaccgtctcgtgtcgatggcctggccgaacaagaagaaggcgccggaagagtatttcacgccgctgatccacccggtcaccggcaagccgtgcgcgatgccggcgcgcggctggcgcaacccgcccgcgacgatgcaggcgctgatcgagcgcggccagatcgagttcggcgcggatgaaaccacgcagccgcagcggatctactacctcgacgagaacatgtacgagaacgtgccgtcggtgctgccgttcgccggctccgacgacgcgctcctgaagacgctcggcatcccgttcgacctgccgaagccggtcgatttcgcggcggccgtgatcggctggtgcacgcgcggcgacgacatcgtgctcgactgcttcgcgggctccggctcgaccggccacgcggtgatgcaggtgaacgcgaccgacggcggcgcgcgccgctacgtgctcgtgcaattacccgaagcgctcgaccgccgcgacaagacgcagctggcggccgccgatttctgcgcgaagctgaaaaagccgctgacgctcgccgaaatcaccaaggaacgcctgcgccgcgccgcgcagcaggtcgcgcgcgattacccggaaagctatggcgacctcggtttccgcgtgtaccggctcgacacgaccaacgtgatcgagtgggacccgcgccgcgacgacttcgaccacgcgctgttcgcatccgtcgagcacgtgaagaccggccgcaccgaagacgacctgctcgccgaactgacgctgaagctcggcctcgacctgtgcacgccggtcgagcatcaccaggtggcgggcaagaccgtgcacctgatcggccgcgcgatcgtcgcgtgcttcgatgcgcgcatctcgcgcgacgatgcgggcccgctcgccgacggcatcgtcgacctgctcgacgcgaccggcacgacgcacgacgtcacgtgcctgttccgcgacagcggcttcgtcgacgacgttgcgaagctcaatctcgccgcgctgctcgaacagcacggcgtgaagcgcgtgcggagcctgtgatgcggctgcatttcgaagcggatctcgactaccagcgcgaggcgatcgacgccgtctgcgacctgtttcgcggccaggaatcgtatcgcggcgacttcagcgtgctcgcgaacgccgcgcccggcacgacggccgccgcgcaaggctcgctcggcttcgcggtgtcggaacagggcgtcggcaaccggctgtcgctgaccgacgacgcgctcgcgcgcaatctcgccgacgtgcagctgcgcggcgggctgccgccgtccggcctgcccggctcgcgcgacttcaccgtcgagatggagaccggcaccggcaagacctacgtatacctgcgcacgatcttcgagctcaaccgccgctacggcttcacgaagttcgtgatcgtcgtgccgtcgatcgcgatcaaggaaggcgtgcacaagacgctttccatcaccgaggatcacttccgcgcgctgtacgcaggcgtgccgtacgactacttcctgtacgactccgcgaagctcggccaggtgcgccacttcgcggcgagcgcggcgatccagatcatggtgatgacggttgccgcgatcaacaagaaggaaatcaacaacctctacaaggacagcgagaagaccggcggcgagaagccgatcgacctgatccgcgcgacgcggccgatcgtgatcgtcgacgagccgcaaagcgtcgacggcgggctcgagggcgcgggcgcgaagcgctcgccgcgatggcaccgctctgcacgctgcgctattcggccacgcacgtcgatcgccatcacatggtgtaccggctcgacgcggtcgacgcctacgaacgcaagctcgtgaagcagatcgagatcgcgtcggcgatcgtcgaggatgcgcacaacaagccgtatgtgcggctcgtcggcgtgtcgaaccggcgcggcgcgatcagcgcgcgcgtcgagctcgacgtcgcgacggcggccggcgtgaagcgccagatcgtgacggccaccgacggcgacgatctcgaacgcctgacccggcgcgcgctgtatgcggggctgcggatcggcgaggtgcatgcggtgaagggcgccgagtacgtcgagctgcgccatccggaaggcgaggcgttcctgtcgctcggcgaggcgttcggcgacatcgacacgctcgccgtgcagcgcgagatgatccgccgcacgatccgcgagcatctcgacaggaactgcgcctcgcggagcgcggcgtgaaggtgctgtcgctgttcttcgtcgattcggtcgagcgctatcgccgctacgacgagaacggtgtgcccgcgaagggcgactacgcgctgatcttcgaagaggaatatgcgcgcgcggcgcgcgtgccggcctaccgtgcgctgttcgacggcgtcgacgtcgcactcgaagtcgagcgtgcgcacaacggctacttctcgatcgaccgcaagggcggctggaccgacacgagcgaaagcagcgcggcggcccgcgagaacgcggaacgcgcgtacggcctgatcatgcgcgagaaggaagcgctgctgtcgttcgacacgccgctgaagttcatcttctcgcactcggcgctgaaggaaggctgggacaacccgaacgtgttccagatctgcacgctgcgcgacatccagaccgagcgcgagcgccgccagacgctcggccgcgggttgcgcctcgccgtcgaccaggacggcgaacgcgtgcgcgacccgggcgtgaacacgctcaccgtgatcgcgaccgagcgctacgagtcgttcgcggagaacctgcagaaggaaatcgaggccgatacgggcatccgtttcgggatcgtcgaggaacaccagttcgcggcgctgcccgtacaggacggcgacgcgcccgcgcatgcgctcggcatcgagctgtcgcgcgtgctgtggaatcatctgcacgagcagggttacgtcgatgcgcagggcaaggtgctcgaccggctgaaggatgcgctgcgccagagcgcgctggtgctgcccgaggcgttcgagatgctgcgcgcgccgatcgtcgcgacgctgcgcaagctgtcgggccgttttgccgtgcgcaacgcggacgagcgccgtgcgatcgcgctgcggcgcgatgcgtcgggcaaagccgtcgtgttcggcgaggatttccgcgcgttgtgggaccgcatccgtcatcgcaccgtgtaccgcgtcgaattcgacaacgcgaagctcgtgcgcgactgcgcggccgcgctgcacgacgcgccggacatcgcgcgcgcccggctgcagtggcgcaaggccgagatcgatatcggcaaggccggcatcgaggcgatcgaggtggccggcgccggtacggtgctgctcgacgaaggcgagctgccgctgcccgacctgctcaccgagctgcaggaccgcacgcagctcacgcgccgttcgcttgcgacgatcctggccgacagcggccggctcgacgattttcgcgtgaatccgcagcagttcatcgcggtcgcggccgatgcgatcaaccgctgcaagcggctcgcgctcgtcgcgggcatcgcgtatcgcaagctcggcgagcgccatgtgcatgcgctcgaatcgttcgaaagcgaggcgctgacgggttacctgcgcaacctgcggcccgacgcgcagaagtcgatccacgaagcggtcgtgtgcgagacggacgcggagcgtgcgttcgccgatgcgctcgaggcgcacgacggcgtgaagctgtacgcgaagctgcccgcgtggttccgcgtgcagacaccgctcggcagctatcacccggactgggccgtgctcgcggagcaggacggcggcgagcggctgtacttcgtcgtcgatacgccgaatacggacggccatgtgccgagcgagcacgagcgtgcgaagctcgcgtgcggcgaagcgcatttccgtgcactggtggacggcgacggcgcggcgcgcttcgtgcgcgtcaggcaggccgatgcgttgttcgaacctgcggtgccgctggcaggcgccgggcggtgatacgaagggcggcgatgagccgccctttttctgcgttggtgaacgtgccggacaccctcgcggcgccctcttcacgcgacggtttctcttccgtcatccgcgtgaaggcgatccgtgttcctgcgcgagtatgacgcggttacggctggttgcaaatcgggtcggcacgacgtttccgcgcgacggcggcgatgcgttgcctcgatgaaaaagggcgccgaagcgcccttctcccgcatgcgtgcgccgcgcttacagcgtgcggccgaatgcgttgtgatgcgaacgatgcgtggatgtcgacgcatgcgcggcatggccatgcgtttgcccgtgcgtgtggccgcggcccggctgcacgccggcgcgatcggcgatcgtatccgagcggtcggctgcgcgcgacaggcccttgtcgcggtccccgcgtgcatgccgttcgagttactcagcgcctggccgctcatgtggccgccggacatgccgcccgcgttgccgcccgagccgcctgcgccatgaccgccaccgttgccaccgccattgccgccggccgccgcgtaggcggacaccgagccgagcgcgagcagcgcggccgtcaatacggacagatatcgttgctgtttcatcttgtgctccctggagcgcgttcgtgtgactgcattctatgaacgcgccaaatttgcgccacacgacgttgtaaatgatcgtaacggtgcgcgcggcgcacattcgtcggatcaatccggggttgcatgaacggggaacgaagcaggcggtggcggcgcgtgggcgccgccccggtggtggagtgcttactgcggcggctgcatgccctgcgcggcggccttgtgctgcgcggcctgctcctgtgcctgcttcttcgccatgtggtggccgacgatacagccgccgaccgcaccgacgaccgcgtggtgccccgcgtagtggccggcgaccccgccgaccaccgcacccttcatgcagcccgccgcatgcgcgctgccgatcgttgcgagcgccacgacagcggcggcggcacacagcctgatgtgacgaatgggcatcatgttgtcactctcctctcgtggtgatcagccgggccgcttagtcccagcggccgccgcgccagccgccgcggtcgcgccactcgtgctcgcgccattcacggcggcgccattcgtgttcgcgccattcgcgccgacgccagccatcgtcacgccagccgtcatcgcggtagccgaccggcgcgtacatgacaggcggcggcggcgcgacgtagaccggtgccggcgccgcgtagacgcccggcacgccgatgccgaccgacaggtcgacgtgggccgacgcgacgcccgaagctgccagcgccgctacaccgagaactgcaccgagaataagtttcttgctcatctcgcgactccctgcacgtgtcgtgcgtcatgtgaatacggttcggagtctaggcaccggacacagacacaggtgaaacgggtatgcgagaccggtaacggacgtttacggatgcccgcaaagccttgcgggacaagggagaggccgtgttcgaaacaccgttgcagcgatgcatcgggccggtaaaagggcgtttcggcacgaaaccgggcgattcgatcgggctcgccgacgtgcgcgggacgcgaaccgcccgcaccgcgcggcgcgagcggttcgcaacagcaggcgttacgcgcggatatcgtcgacgctgcgcagccagtgcacgctgaacaggttgtccgcgtcggtccacacggtatcgggcgcgaatcccgcgcggcgcgcgatcgcatggaagccgtcgatcgtgaacttgtgcgaattctccgtgtggatgcgctctccggcgtcgaagcggaacgcgtggccgcgcacgtgcaccgtctgcgcgacatcgctgacgagatgcatctcgatgcgctgccgctcgctgtcgtaaaacgcgcaatgcgagaacgcgtcgacgtcgaaatccgcgccgagctccgcgttcgcgcgcaccagcaggttcaggttgaactgcgcggtgacgccctgcgcatcgttgtacgcgtcgtgcagcgtgcgcgcgtccttcacgagatcggcgccgaccagcaggccgccgccgcgcagcagccgtgcggcatcgcgcaggaatgcgtcggcttcgtcccgcgagaaattgccgatcgtcgagccgggaaagaaaccgatgcgccgcgccggtgtcgcggtcagcgcggccagttgctcggccttcgtgtagtcggcggcgatcggcgcgacgtcgagccacggataggccgaccgcagccgcgcggccgcaccgtgcaggtagtccgccgagatgtcgaccggcacgtagcgcgccggcgcgttcgcatagttgcccgcgaacgcgtcgagcagcacgcggatcttctcgagcgagccggcgccgaattcgacgagttccgcatgcgggccgacgcgccgcacgatctcggccgcgcgatcgcgcaggatgccgagctcggtacgggtcgggtaatactcgggcagttcgcagatgcgatcgaacagcgcggagccggccgcatcgtagaagtatttcggcggaatgctgcgcggcgtacgcgacagtccgtcgatcaggtcgcgctcgaacgcgctcggccgcgaatcgcgggcgggttgctggccaccgctcgtggccgtctggtcagacgtctcgcgcaagtcgcaccccgtgaattgccagcgcgcggccggcggaaagaaattgcggtacgtcggccgttcgtgcccgggcggcgtcgcgatgctgctgccgcgcaggacctgctggccgaccatgaacttgccgttgtattcggcggcgacgcccgcgagcggccgaaagccggggtacggctcgtaggacgagcgcgtccattgccacacgtgcccgagcatctgccggatgccttcggcggggaacgcggcttcccattcgaattcggtcggcaggcgggcgccggcccattccgcgtacgcggccgcttcgtagaagctcacgtggcacaccggtgcgtcgggcgcgagcggttcgatgccgtgcaggccgaacgtgcgacggatgcgcgtggcggccgcatcgtcgtcgtcgggcagccagtacgcgggcccttgccacccttcccgctgcaccgtggcccagccgtcggacagccagaactcggggcgtgtgtagccgccgtcggcgacgaacgccgcgaactccgcgttcgtcacgaggcggttcgcgatctcgtacggccgcacgagcgccgtatgacgcggccgttcgttgtcgaacgagaacgcatcgccgtcgtggccgatctcgacgagcccgcccggctggtgaagccagtgcagcgcacccgcatcgcccgcggccatcgcgtccgcgtccgcccgttgcgcggccggaacgccggcttcagcgggttgcacgagaacgcgtgcagcatgtcggtgacgatcagttcctggtgctgctgctcgtgatgcaggccgagcacgatctcgggcgcgatcgtatcgagcagcgccgcatcggcgccggccagcgcgcgcagcatcgcgtcgtcgacgtattgccggtacgcatgcacctcgtcgagcgacgggcgcgtgagcagcccgcgctgcggccgcggatggcgcgggccgagcgcttcgtaataggaattgaagaggaactggaatgcgtcgtcgaacggcgcgtagccgggcacgcggcgcatcagcacgacggtttcgaagaaccaggtcgtatgcgcgagatgccatttcgtcggactcgcgtcgggcatcgactgcacggcctggtcttcggcggacagcgtcgcggtcaacgcgacgctatgggtgcgcacgtcctggtaacggcgctgaagctgtgatgcaaggaggctcatcggtttaccgtccacgtcgcgattcgctgcgttgcgttgccggaaaagggaaagccttgcgcgtgatgcgcgcggctgacgtgcgacctgctgctgcgtcgacgggcagccggcgcgcgcgccgggccgcgaatgcggcgtcacttcatctgcccgtgcagaacagtatggtccagaaatgtgaatgctgcgaatcgggatgccggtgaaacgcgaacgaaagagaaatgaaagtgttggctgcgcgcatgtcgcacgcgtgacacgccggacaggcctgccggttcgggcgtaaacgccgtgcacgacgcgctggtccgcgcaggcgggctgctgacgccccatgacatccgcgcagcgatcgtgagtgaatgccccgagatgcccggatttgtctgacgaacgtgtgcgtgcgccgcaaccggcacggagatgaaccgccccgcccttcgtccgggtccgcggccaaacgcgcttcgaaaaaatttttcgccgatgtcacacacgcgggggctcgctcgtcatgtcatcggaacccacacgaaaggagaaggtccatgactgcgaaactcaatccgtttgccgccgcccccgcactgatgaagaactggatgaccgtatcggtcgccgctgccgggagcctcgagccgacgctgatcgagctcgtcaagatccgcgcatcgcagatcaacgcgtgcgcgaactgcattaacatgcacacggccgaggcgcgcgagcaaggcgagaccgagcagcgcatctatctgcttgccgcgtggcgcgaagcgccctgctacaccgaccgcgaacgcgcggcgctcggctggaccgaagcgctcacgcggctgtcggagggccacgccgcacacgaagcagcctacgcggcgctgaacgaccacttcagccaggaggaacaggtgaagctcacgctgatgatcaacgtgatcaacggctggaaccggctcgccgtcggcttcgggctgtggatcgacccggccgacgcgaaggccgccgccgcgaagatggtggcctgatggcgaccctcgacccggccaggggcagcgccgaagcacaggccgacgcggcggcgagcttcgacccgctgcgtcgcacgctgattcgcgttgcgtaccggatgctcggttccgtcgcggatgccgaggacatggtgcaggaagcgttcatccgctggatggacgtcgaccgtaccgaggtgcgcgtgcccgaggcgttcctgcgccgcatggtgatgcgcatgtgcctcgaccagctgaagtccgcacggcaccagcgcgagacctatatcggcccgtggctgcccgagccggtcgtcgaggaagacgaacaggaagacgtcacgctgccgctgctgctcgcgctcgaacggctctcgccgctcgaacgcgcggctttcctgctgcacgacgtgttcggcctcgagttcgacgaagtggccacgacgatccagcgcgaccctgccgcgtgccggcagctcgccgcgcgggcccgcacgcatgtgcgcgaggcgcggccgcgctttcatgtcgagaaacagcgcgggatcgaattggcggaagcgtttttgccgcgtcacgcagcggcgacatgcgcacgctcggcgcgatgctcgccgaggacgtgagcctgcattcggacggtggcggcaagcgctcggcggcgggcaagccggtgttcggcttcgaacgcgtgatgaaggtgcacgagtatctggccgagctgtttgcgacacatgcatcgaagctcgtgcgtgccgggttcatcaacgggctgccgggtttcgtcacgctggaatccgatggcgagctgcagaccacggcgctcgagatcgaggacggaaagatcgtcgcgatctatgtcgtgcgcaatcctgacaagttgaagcacctgcattgagggcggcgggatcgcgcgccgggtgccgtgcgcaggcacggccgcgatgcgcgctgttcaccgccctgccgccctgctttaccggccgccggttcgtgctcgcgctcgtactcgcgctcgtactcgtgcgatcaatacgtgccgaccacgacgttgcggatcacgatcatcaggaagccgagcaatggcgtcgcgatcgcgaaaccggtcgccgcgagccagttcgtgccgccctgcgcttccagcaacgcgagaaacgattcgcgcgacgtcgcgttcgggcgcagcttgtcgatccggtgctcgacgtgcgccttgtagaggccgttcccgtaccagccgagcgaaaccgcgatcccgatcgtgaccggatcgagcgtgctcgattcgaagtatgtcgggaagaacagcagctcgaccagcgtgatcgcgagcgacgcgccgaggacggccgcggcctgccagtacatgcatcgatacgccatccagaccgggcccaggaaacaggctgcccagttccatgactgccggttcttgcgcgacgcggcgatcgtccatttccgctcgaaccaggcagccttcttgccaacataagcggcgatttcgtcgttgctcgcgagcgatgcggcggtcgtgacgttggacatggtcggggttctcagtcgcgcgggtcgcgcgttgttgttttgatgtggtcgggtgcggtgaaaatcgaacggcgcagccgcttcggtcgcacacgattctacctgccgtgcagcgcaggtcgtagcgtcacgggccaggatgtcggtggagatgcgatgccgtggatcgcgcaacgcatcggggcgatatgcgtcgtttcgcgttgtttcggccgggaagaaaaacgccacgcgaggttgccgcgtggcgtttgtatgtttggcgagccgcgttgcctgtaggcaatttgcgctgccggaccccttcattttgttcgttggtaggctcgattggattcgaaccaacgacccccaccatgtcaaggtggtgctctaaccaactgagctacgagcctaagaagccgcgaattatagagagggttttgaggagcacaagccctttcgtgaaaatttttgaatcggcgcgtgcgggggcaaacgatcgatggcgcctggcgatgccgggcacgtcgccttcaccgcttcgcatcacagcaaaacgcgtcgatgcgcggtgatgttatccacattgccctctggataaccgtccggcaagcctctggattcacagtggaacgattgaggatatgtcggcgagtctgtgaatcgacgaaaagttgttctgtgctgcgcggagctgttcacgtgcgacacccatggttatgcatcccgcttcgcgctgaaaattcagtgcgttacagaggttatccactgtgaagcacagcgcttgttaactatcactacgtatatatacgaaccctgttaacacctttggataagcacagtccgtcgactgtgatccgcccgggagatgcactgcgtgcggcgaacagaagaacgaatcgggaagctgtgaagcgcgtgggtgatgtgcggaccgtcatgtctgtagaatcgccggcattcaggatgcaaaggcccgtcggacaggctcacgacacatgaccgattcttcgttgcccaggctcgacacgctcgatatcgacacagtcgtgcatcgaatgcagcaacatccgggcgacatcgtgttcgagcaacgcgtgtcgatcccggaagccgacgtcctgtgctgccgctacaaaggcgagcgattcaacgtgaagttcgatctcgactacggggtgtttgtcgatcgcgtcggaaagctgtctcgccaagacatcgaagacatcgtcggatggctcgcaacggtgtgaaccggatgacgagaggcacaggcacatgattgattctttgactgcgctgcagcgctggtacgaatcgcgttgcgatggcgtctgggaacacgcgcacggcatcgaggtcgtcacgctggacaatccgggatggaaggtgaagctcgacggcgcgacgtccggcaaggtgatcgatctgtcgatcgagcgcaacgagtcggactggatatccgtgcgtgcgaccagcgctgaattcgccggctacggcggcccgggcaatttgccggagctcctcgcgctcgcggtcgagtggattgactggcgcgcgacgaacgacgaaggtcgaagcgatcgatgaaggcacctgtcgacgaaatgctggcgacggagattgccggccatgttgcggttgtcgtgaccaaggtggtggccgccgccgatgggctggcacggttgggcttcgctcggcaatccggtcgcggggaatgtgcgatcgcctggcgcgggccgagacagtgcgtcatcgaaacgcgatgaatgcggtgtgcgatcgctcgatgtcttccacggcgcgacgaaaccgaagaaagaacagggcgacgcaagcggcgctcgcaactggagtgagtaatgggaccgatcgtttgccatcgacacggacgcgcttccacggcgacaacatcgaagggtgtggacgcacgcatcaggttgcgcgggcagtgtgtgcccggtgaactcgtgaaggtctcgctcgaccggccgagatacagccgggagatgtggatgttgcgcggcgagctcgacgagcacgaggtcgatgcgatcttcgtcgatcgggtcgcgcacgtgaaggcatttccgaagatcgcggcattggagcgcttgcgcgcgtatgtctgtctggcgtgtctggacgaactgctcgtgcgttccggcgaggtgccccatcaaccgacgacgaaagagcaggcgttcgacacgtccgtcgtcgcggcgaatgcaaagtggccgagcgatttcgcgcgatgcgaacttcacgggctgatccggccgacgcggtcgtcgccggatatcgaaacggcgattctcacgatcgatgtgatccgtgattgtcacgtcgtgcgggtgatcgatgcccgtgtgaagcacgagcccaagtattggttcgacgaagcgtttttgcgcaaggtgctcgggccggatatcgacatcgtcgattcgacgttccggatcgacgatccggccatgttcgtgcggctgcgggacgccggtgagtatgtgtgtccggtgtgcctgcgggaggtgttgaaacgcagcggcctgggcgatgacgctgcgccggcgtgaacgcaaaggagagggcatgacgggcaggcaaccggtgccgttgcgagacgatcaatgatgaccgacacgatcgagcagtacgacatgacggacgacgccacccggcgcaagattttctggctgctgcaacgcgtgacgagcctgtcgctctggacgcgcaagcgcgaggcattcgagcgcttcgcgaacgcgtacgagcatgcagtgaacacgtggcccgatgacgatccggatggcattcatgacaagcactttccgctcattgccgagattctcgctgcttatgatcgagggctgaccgagctggcccgagggaaccggattggctggcggagcggtgggccgttcaagcacgtgtaccggcaataccgccttctggacgcgtatttctaccctaatcccgattactgggatcgcggtgggcaggttgccccatacccgccgaagatcgacgcgctggcccgactgctgcacgcatcggaataccagatggagtatgcgccgttcgatccggacgatcgattcggcaacctcgcacgtctgcgctcggcaagacagctgttgtccccggatgcccatgagcgcaacttccacgcgctttcgtatccggtgtttccggaggagctgcccgcggttccgcaagctgtgggcccgatcatctggaccggccggaaagtgccttgcgacggcatctgggagcctgtcgtcgtcaaatggtcgaggcggccgggcctcgtgccgatcgtcatgcccggtttgcgtaatggaggttgcttcaattacttcactcggggcacgcgtgcgccgaacctgacggacgatttgccgggattgttcatcccgacgtgctggcgattgttatgggaagaccggcgttacgtgaacggcgtcattcccgacgaatcgcagtatttcctcgagccgcggcaagcgccgcagacgaacccgtgatatccggagaacaccatgagcaagctgaatttcggcgaggtcgatcgatgttccgtccggctcaataccgcgacgctgctcggcctgaaggccgcctatgacgacttcgcgaaaaccgggcaggatctgcacaacttcgagatctgcatcacggacgaaagtgccgcgagggtcgatccgaaaccgggcgaccgcgtcatcggcgtgacgtttctggcgaagatgcctcccggcatgcgcgggctcggcaatgcaagtccgctcgggacgtcgacgggatacgtcatctcccggagaccggcgagattctcaaggttcatctgaccaagtgacctgggcggcggtgaaggcggtcagccttcgtatgtgggtaaccgcggcgcaaatgacgtgaaatgctgtgcgggcaataggtgagcatgcgctcggatcgcaagcgggggcggatcccggcgaattctgatcgtgacaagccgatccggatacgtgagcccgcgactgagtgcagaaatgccggctccacgatgcgagcgcggggaaagtgcatcacgttcgtgcgcttgccgaagtgccgcatgtggacaacctgcacgcccaaccagtcgaatcgctgtgcctcggacaggtgagcgccatgcactcgaccatgtgaatcagcccgaatgccttgttggacagggattgtccggaatagagcaggtgatgggaagaatgttcgcgcgatccgccgtgatcgagtgccatgtggatatcgagcagccaagacactcgaaatcctgtgcattcaacgggtgagggtacgcgaatgtggtgaggatgtttgcgtcacctcccgggttgtggatatcacgcttccacgcaactcgaaacgctgtgcagacccaaggtgagcgaaccgaacgatatcagcatgtagcgtcaccacgatcaagctgaccggcctccacgattcccggtgcggttcagacactgactcgaccggcgtcgcgagagaaggcggcatataccaggacaaagtcgcacggcgaggatgatcgttcgctatgctgccggtgacaacgcacctatccatcggatacacatgagcgcaactgcgcggatcattctcaaagccatgctgagcgtccccattgcctttgggctcgcctatccccttatctatccttcagaagacggtggcgttctcggcgaaatggggagccttgggacaatcggcggcatcgtcgtcatcacggttttcctggctctggtctatgcctacgcgagcgacctgaggactaccctgaaatcggtcaaccaaggatcgcgtgcggccaaacccgacagcgtctggctcatgttcctcttgccgtacaacttcatcgaggatttcttcattatttccaacgttgcgaagtccctggaagcggagtcccgtatcaatccggcgctgtcgggtctgcgctcgttcggccggatcagtggcatcgggtggtgtcttgcgcaggttgtttcgttgatacccgatacccttggctccatcgccggtggcgttgcagttttcctctgggtttggcactgggtgttcgtgcgtcgagcgaacaagatgcttgccggcagccaggtctcggtggcgactctacctggacggacaggatcgtagccatccttggaagccggatcgcttacccgtgatcgatgtggacatcctgttccgcagcgactcgaaaccctgtgattcccaaaggtgagggcgccgaagtggcttcgatgtgcataacagccagggaaagtcagtcgaaacactgtgcaagcgagtggtgagcgtgcgcccgttcaagcccaccgggccgcgccacaaaacacaaaacgcgctggcggccgccccaaccgccgaccgggcgcgcatcctgctacttcaagtctgccgatcgagcgcctgcacgaccgctttctccgcgaggctcccggccggcccgaccaccgcatagttgagcccgttcaccgacccgtaccgtgcgagcaacgcgccatccacacgttgcccggccggcagcaggcgatgtttcgattctgccggccggagatagaagctcagcgtccgcccggcctcgtcttcatagagcaccatcgcagccgtggccccgctgtccgtcgtgaacaaccgcccaccgaccggcctgaaccccgcagcgctcagatccggcagccgcgccgatgccccgacgcgccgggtgagccaccctgcaaatcgcccgcaccggttggccggtaatccaccttggccgtctgatcgaccaccatcatccggtaagcctcgactgcatcgctcatcggtgcgatgggcggcgccgcgttccatccacgcgcctgccatccgccgaatgtccccagcccgacgcagaacacgaacgaagccgcgatcgcgaaccgcatccgtgtgcgctccgcctgcctgccgcgaatggcggcaggatccagcgcaaggttatccgccggcatccgcacgctttccagcgcggcccgcaaccgctgcgcatcctgctgccattgcttcacctgttccgcgcgcgccggatgcagcgcgagataacgctcgaccgcggcgcgcgcatcgtcgtcgagctggccgtcgacgtaggactggaggtcgtgttcgttcggaggcgtgttcatttcttcatcaatcgcaaagaaggagcaggaagctcgccgtcgctgagctggcgcagcgcctggcgcgcgcgggagagccgcgacatcacggtgccgatcggcacctcgagcaggtcggcgacctcctgataggtgaagccctcgaccgcgacgagcagcagcaggctgcgctgctcgtcggagagccggccgaacgcttcgagcgtcgcgcgcgccgcgaattcgcgttcggcggacggccagtgcgcttcgtcgtcgtcgcggatgcgcccgagcagccacgcgtagcgtttcgcgctgcgtttgccgtcgagaaactgccggtacaggatcgtgaagagccagctgcgcagcgacgcgtcgtcgcgacggctcgtccagcgcgacagtgcgcgctcgagcgtcgactggacgagatcgtcggcggcgtggacgtcgcgcgcgagccagagcgcgaagcgtcgcagcctggggatgagttcgcgcagtacgtcgtcgtcgagggcggtagagggcatggccgggccggttgccgaatgggtcgggatgcagcgtaggacgccggtgggcgccgcgtattccatcagcataggaaaaaattttcgtggaataaagcggcgcgggtggcgtcctacgcgggttcgacaatgacctgatggtcgggagcacattcatggagcgatcttcttcctcttcttcgccgcagcgcgagcccgggcgcgggtggtggcgctgggccgcgatcggcggcgcggtggccggcgtggccgtggcgttcgggtatgtcggcggatggcttgcgccggcgcgtctgaccccgcaccggatcgtcgacgcattgcagacggccggcggcggcattcacccgggcttccggcgcaatcacgcgaagggcgtgtgcgtgaccggttacttcgaaggcaacggcgccgcgagcgcgtattcggtcgcgccgttcttcaaggcggtgcgcacgccggtggtcgggcgcttcgcgttgccgggcgggaacccgtacgcgcccgacagcagcgtgccgatccgcagcctcgcgctgaagctcaccgcgcccgatggcgagcaatggcgaaccgggatgaacgcgatgcccgtgtttccggtggcgacgccgcaggcgttctacgcgcaattgatggcgacccggcccgatccgaagacgggcaagcccgacccggcgaaggtaaaggcgttttcggcgcgcacccggaggcgggcgcgttcctgcaatgggtgaagggtgcgaagccgagcgcgagctacgtcaccgaaagctattacggattgaacgcgttttacttcgtcgacgcggccggcaagcgccaggcggtgcggtggcgtgtcgtgccggagcagacggccggcgccggcgacgtcgcgacggcggcggacccgaacgtgttgcagcaggacgtgacgcagcgcatcgcggcgggcgcgcagaagtggaagctgctggtcacgctggcggagcccggcgatccggtggacgacgccacgaaggtctggcccgcgcagcgcacgacgatcgacgcgggcacgctcgtgctcgaccgcgtggaggcgcaggacagcgggccgtgccgggatgtgaattacgacccgacggtgctgccgcaggggattcaggtgtcggggatccgttgctggcggcgcgttcggctgcctatgcggattcgtatctgcgcaggacgagtgaagaggccggtgtggcgggcgtggccaggttgagttcggagggacggtgatgaagacttctgcgacgtttggtttgcccgcgagggtgctgcactgggtgatggccgcgatgatcatcgcgatgctgttcatcggggtggggatggtggcgtccgtttccgggcggcacgaggttctggtggcgattcacaagccgctgggtgtggccgtgctggtgctggtgtgcgtgcggatcgtggtgcgggtgttgtcgaagccgccggcgttgcccgaggatctgccgtggtggcagaaggtggccgcgcacggatcgcatcttgtgctgtatgcgctgatggtcgcgatgccgctgatcgggtgggcgatgctgtcggcgggcgggtatccggtgacgttgggcggcggcgtgcagctgccggcgctggtgtcggctgatccggtgacgttcgcctggctcagggtcgcgcatcgcgtgctggcctatctgttcttcttgacgttcctcgcgcactttgcggcggcgctgtatcacggactgattcggcgggacggtgtggtgagggcgatggtggggcggtaactgacgggaaggtcgagttcgcggcggcggggctgtacacgggcgaccggggcagctcttgcagtgccgcttatatatgaccactgggtaggctcggctgctcccggcatagcatgtcaaaaatatttcacgaaaggggttgcggagaccggggcaggtgcttagaatcacgcctctttcgcgctaacggaaacgcagcgcgggagaagaagggaagcggtgctgttgaagttggttttagcaactccagtacatacgaaattaaaccgcagtcgtcgcaacgaagtagttaaaaagttgttgacgagttttaaaaacggttaataatctcgcttctctgctgctgaaaacgcagcgctgccgggaaacacgaagttcctcgcagattgctctttaaaaattaacagccgataagtgtgggcgcttgatggaagcgagctgatcctcggatcagatagcaaaagtatcaagagtctcacactaaagtaagtcaggtttatgaagtgattcatattcctgtcagctttgagtgagcgaccggttcttaaccgaaccgaaaacagtaacaggtttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtggggatagcccggcgaaagccggattaataccgcatacgatctacggatgaaagcggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagagggggtagaattccacgtgtagcagtgaaatgcgtagagatgtggaggaataccgatggcgaaggcagcccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgaggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccagagcttctcgcacaagttgagcgctcacgcttatcggctgttgattaagacagactagctgtctgcggtataaaccggttataatgccggccgctttcaataatcttcaatgacaaacattcgaatgaagtttggttcgagtttttctcattggcgattgagccagtcagagcggtacgaaagtatcggctgtcgttctttaacaatctggaagaagtaagtaatttggatggcggaagcgtcttgagatggacgtggaaactatccgggttgtgattgtatcgatgtatctcaagatgattcgaactctaagtttgactcaattggaatacggcacaacgcgagaactcaacctgtagcgactgtcgatgagacagactcgttatagggtcaagcgaacaagtgcatgtggtggatgccttggcgatcacaggcgatgaaggacgcggtagcctgcgaaaagctacggggagctggcaaacgagctttgatccgtagatgtccgaatggggaaacccactccttttggagtatccatggctgaatacataggccatgtgaagcgaacgcggtgaactgaaacatctaagtaaccgcaggaaaagaaatcaaccgagattcccaaagtagtggcgagcgaaatgggatgagccttgcactctttatttgtattgttagccgaacgctctggaaagtgcggccatagcaggtgatagccctgtaggcgaaaacagtatgaaagaactaggtgtgcgacaagtagggcgggacacgtgaaatcctgtctgaagatgggggaccatcctccaaggctaaatactcgtgatcgaccgatagtgaaccagtaccgtgagggaaaggcgaaaagaaccccgggaggggagtgaaatagatcctgaaaccgcatgcatacaaacagtcggagcctcgtaaggggtgacggcgtacctttgtataatgggtcagcgacttacgttcagtagcaagcttaaccgtatagggcaggcgtagcgaaagcgagtccgaatagggcgttcagttgctgggcgtagacccgaaaccaggtgatctatccatggccaggatgaaggtgcggtaacacgtactggaggtccgaacccactaacgttgaaaagttaggggatgagctgtggataggggtgaaaggctaaacaaacctggaaatagctggttctctccgaaaactatttaggtagtgcctcgtgtctcaccttcggggtagagcactgtcatggttgggggtctattgcagattaccccgccatagcaaactccgaataccgaagagtgcaatcacgggagacagacatcgggtgctaacgtccggtgtcaagagggaaacaacccagaccgccagctaaggtccccaaatatagctaagtgggaaacgaagtgggaaggctaaaacagtcaggaggttggcttagaagcagccaccctttaaagaaagcgtaatagctcactgatcgagtcgtcctgcgcggaagatgtaacggggctaagctatataccgaagctgcggatgcgtgcttagcacgcatggtaggagagcgttccgtaagcctgcgaaggtgccttgtaaagggtgctggaggtatcggaagtgcgaatgctgacatgagtagcgataaaggggtgaaaggcccctcgccgtaagcccaaggtttcctacgcaacgttcatcggcgtagggtgagtcggcccctaaggcgaggcagaaatgcgtagctgatgggaagcaggtcaatattcctgcaccattgttagatgcgatgggggacggatcgcggaaggttgtccgggtgttggaagtcccggtcgctgcattggagaaggcacttaggcaaatccgggtgcgcaattcaagggtgtggcgcgagcttcttcggaagcgaagcaattggaagtggttccaagaaaagcctctaagcttcagtctaatgatgaccgtaccgcaaaccgacacaggtgggcgagatgagtattctaaggcgcttgagagaactcgggagaaggaactcggcaaattggtaccgtaacttcgggataaggtacgcccttgtagcttgactggcctgcgccaggagggtgaaggggttgcaataaactggtggctgcgactgtttaataaaaacacagcactctgcaaacacgaaagtggacgtatagggtgtgacgcctgcccggtgccggaagattaaatgatggggtgcaagctcttgattgaagtcccggtaaacggcggccgtaactataacggtcctaaggtagcgaaattccttgtcgggtaagttccgacctgcacgaatggcgtaacgatggccacactgtctcctcccgagactcagcgaagttgaagtgtttgtgatgatgcaatctacccgcggctagacggaaagaccccatgaacctttactgtagctttgcattggactttgaaccgatctgtgtaggataggtgggaggctatgaaaccggaacgctagtttcggtggagccgtccttgaaataccaccctggtttgtttgaggttctaaccttggcccgtgatccgggtcggggacagtgcatggtaggcagtttgactggggcggtctcctcccaaagcgtaacggaggagtacgaaggtacgctaggtacggtcggaaatcgtgctgatagtgcaatggcataagcgtgcttaactgcgagaccgacaagtcgagcaggtgcgaaagcaggtcatagtgatccggtggttctgtatggaagggccatcgctcaacggataaaaggtactctggggataacaggctgataccgcccaagagttcatatcgacggcggtgtttggcacctcgatgtcggctcatctcatcctggggctgtagccggtcccaagggtatggctgttcgccatttaaagaggtacgtgagctgggtttaaaacgtcgtgagacagtttggtccctatctgccgtgggcgttggatatttgaaggggctgctcctagtacgagaggaccggagtggacgaacctctggtgtaccggttgtcacgccagtggcatcgccgggtagctatgttcggaagagataaccgctgaaagcatctaagcgggaaactcgccttaagatgagatatccctggggactagatccccttgaagggtcgttcgagaccaggacgttgataggtcaggtgtgtaagcgcagtaatgcgttcagctaactgatactaattgcccgtaaggcttgatcctataacaagtctgccttgtagatcggcgccgtgcgacagcaccggccgcaagatccagagcgacaagttggattctcgtgtgtgatacacacaacctaattactgcttcttccaagattggttctgttggccacgccagcaggacaaccctctttgcctgatgaccatagcgagtcggtcccaccccttcccatcccgaacaggaccgtgaaacgactctacgccgatgatagtgcggattcccgtgtgaaagtaggtaatcgtcaggctcccctcaagttaagaaccccgcccgatcaggcggggtttttgcattggcgtggcggaaatgcgcgagtgatcgggatcgatggccaggacgctgctcgagctggggccggggtgacctgcccccttcaatatggccaatgggcttctagaaaagtccctttaaaccaactcctggaaagcggcaggagcatccgcggtcgctcggtgtttcgccgcaaactctgacggcgcaaggtagttcagtgcactgtgcggcctttgctcgttgtagtcctgacgccatgccgcgatgacagcccgagcgtgcgcgagcgtcgtgaaccagtgctcgttaaggcattcgtcgcggaacttgccgttgaacgattcgatgtacgcattctgcgttggcttgcccgcctgaatcaacttcagagtgacgccgttcgcatacgcccactggtcaagcgcgcggctcgtaaattcgggtccctggtctgttcgcaccgccttggggtagccgcgaaagcgagctgcacggtccaatgcccgagcgacatataaacctgagatgccatggtcgacgacgatgtcgacagcctctttcgtgaagtcgtcgacgacggtcaggcacttcacgcgccggccgttagaaagcgcatccatcacgaaatcgattgaccacacctcgttgggtgcgcccggcaataccagttgctcgcgctcaatcattacgccgtggcgcctgcgacggcgccgcacagctagccctgcctcacggtacaggcgatagatgcgcttgtgattggcgtgcgtgccttcgcgtgccaccagggcgtgcagtcggcggtagccgaatcgacgacgttcgtgcgccaactccaccagacgcgccgctagcacctcattctcgtggtccggcttcgcgtcgtaatgcagcacgctgcgagaaagcccgacaagccggcaggcgcggcgctcggagatgttgaccttctcccgaatcgccgacactgcttcgcgtttggcttgcgggctcagggctttcccttgacgacgaccttcaacgcttccatatcgagcattgcttcggccagcagtttcttcagccgggcattctccatctcgagatccttgagccggcgggcttccgagacttccatgccgccgaacttcgcgcgccaggtgtagaacgacgcgtcactgaatccgtgcttcctgcacagttccttgaccggcataccggcctcggcttccttcagaaacccgatgatttgctgttccgtaaagcgcttcttcatgttcgtcttcttctccgaaaacgaactttactagactccagctgcccctgtttgcagggggcaggtcagataaaatcgtgcccgatttcatatgacagaacccctgaatccccatttagattcatataagcaggcatttattaccttcgtggccaagggtgtgggatagttagtaatgaaagatggaacagtttgagaagattctcacgagaccatcgtcgaaatttcgggggcgcctggagagcatatcggatcatgcgcagcaaacatgatgcatctttttagataccacacaacttgcatatgacgacaactactctcacctcatcggccaacccgaaacgataggctgctccgtccgtccaactaacgccgtctgcttttggatgcgcgcgccttctgtttgcgcaaaacggccttctcaagcttgacgtgccgattccactgctgagctgcgcgagccgcctcagcgtagattccagggctgaacttcatgctggaaaacatgcgcagcaagacgggcgatagctcgatcttgccctgcttcagcatgaaggggatttgccgcgcgaaaatcatcgccgacaggccgccgcaaaatatgctgatttggtaccaaagcgcttcgtactgcggcatcgtttttgattgcacgttcaacaagatcaacaatgtaatggcatacagtacggcaaacagagcgcacaggacgatacgcaagcgcaatggaagattgcggccagccactttgattgtcgcgcattcgcggatagcaaagaccgcatataggtagaatggcgagcccagaaacgccaaatctaggctgtaccagctatatcgctcggacgacagtgaatataatagaaccaacgtcaatcctgcgaggccgcagacatatagatccgccttgttatcatcgtagaatttttgccagtatggtgaattgcgtcccgccaacgcaactgcgaaatcgcaaaggtacagggtcgctgttcccaagacaccgcgccaaagcccaatttatacgtggcctcgagcagatccctcgacggtaggaataaccccatattgtgccgataagcagaacgaaaacgactaggtacttcgtggcgttaaatgggtatatcagatcgcgcaagatagccgcagcagcacgcggcacgatccacgaccaaagcatgcaaatggctacggccgtcatgacgcccatcagcgcgaaacccaaaaccagattgactaatacggtttgcgcggttatcccgtggcgactggagaggccggcgacgagagccccgccacgactgctgtcccagtgcgcgtatgtgccaatcgctgccgcacgcacagcacctgcgagcatcgttagcatgagctgtgatgaaaactttttccgcatcgctggtagatcgacagactggcacgcaatcagagccaacaagacggaacagacgaagcctgccgacagcccaaggtttaaaccgagttgcgctgcctgtcgccatgtcgctgaaccgttcgcgcctgccgcaaaggcgctagagatgaaccaacacaacgacgctataagaccgaagtacaaagtgctcactgcggtaccacaaatcacgcacagtgctgtaacgcctatcgttggcaaaactggtttcatctgctcctcccgatcttcacggtgacccgattacgattatcgacttctccggaggttcgcacgacgactcgactacgttgacttagcgaatggcctcgggattgcacagatggcaccgctatgggcggacctttctcagagcctaaatctcgtgcgaggtaaggaggtgctacagcgattccgtgaccgcgtgagtgagctatatagcgtatccgcaacggaggcaaaaattattgatgcaatgcggcttgatgaaatcgctgatgacatgaaggggcctttgcgacaactggaacagttccgcactcaaattgtctagctcgaatgcgccttcaagcgtgccttgccgcgcgtcaaattacgggcatcccggcgatatggtgcgccggcgaccaaagaggccgcggtatatgaaatatggggctatcgcagcccaaatcgcttcccgaacaccgccccgcagcacagggcggaccgcgggccagagacggtgacagaactcgggctgaaaaagcccgctgatcgttgccgcgaatgagagaacgaaggctacctaaaccgccgcagccctcattctgtcggctttggcgctagccacacgccgtcattgagatatcggagcgcacccatcgacaaatgtcccaacggatgcctcccaaaatctcaccttattgctcctgctgcagcgccttcaaacgtcaatattccccgcccgcaacgcattcgactcgataaatgcccgccgcggctcgacatcatccccatgagggtagtaaagatcccatccgccgcaatcgcgtcttcgatctgcacacgcagcagtcgccgcactgccggatccatcgtcgtttcccacagctgctcggggttcatctcgccgagccccttatagcgttgtttggagacgttgcgttcagcatccgccagcagccacttcatcgcgctcttgaagtccgccacggccatgctgcgctcaccgcgcttgatgaccgcaccttccccaatcagccccttgaacgtattcgccgtcgtcacgagctgctgataatccgccgtgtgctggaattcctggtcgatgaccgaaacccgcacgttgccgtgatgcgtccgctcgacatgcagcgctcgctgttcgcgaaccgcgtcatacgaaggcaccacgcgcacttcgttcttcagcgcttcatcatgcaacgcagcgtgcagcgccttagccgaagcctcggtcgactcttcgttggaaagatcgatcaccaccccgtccatgaccgcttccagcgccgccgggtcatacaaccggctcaaccgctcgatcacgctctgcgacagcagatacgaccttgccagctccccaagtgcatcaccggaaatcgccgcagcattctcacccggcaccagctccgagccttgcagcgccaaccgcagcatgtgcgcgttgagctccacgtcgtccttcagataccgctcgtccttgcccgccttgatcttgtaaagcggcggctgcgcgatatacacgtacccgcgctcgatcatgtccggcatctggcgatagaggaacgtgagcagcagcgtccggatatgcgcaccgtcgacgtccgcgtcggtcatgatgatgatgcggtgatagcggagcttgtcgaggttgtagtcttccttgccgatcccgcacccaagcgcggtcacgagcgtgacgatctgttccgacgacagcagcttgtcgtaacgagccttctcgacgttcagcaccttgccgcgcagcggcagaatcgcctggaacttgcgatcacgcccttgcttggccgacccgcctgccgagtcaccctcgacgatgtagatttcgcacttcgccgggtctttctcctggcagtccgcgagcttgccgggcaggccgacgccgtcgagcacacccttgcgccgcgtcatctcacgcgccttccgcgcagcatcccgcgcccgagcagcttcaacaatcttcccgcagatgatcttcgcgtcgatcggcgtttcgagcaggaattcttccagcgccttcgccaccacttcctcaaccggcgcacgaacctcggaagaaaccagcttgtccttcgtctgcgagctgaacttcggctccggcaccttcacggacagcacgcacgacagcccttcgcgcatgtcgtcgccggtcgtctcgaccttcgccttcttcgcgatttcgttgtcggtgatgtacttgttgatgacgcgcgtcatcgcggcccgcaggccggtcaggtgcgtgccgccgtcgcgctgcggaatgttgttcgtgaagcacagcacgttctcgttgtagctgtcgttccactgcattgcgacttcgacgcccacgccgtccttctcgccgttggcgaagaacaccgtcgggtgcaggttggtcttcgtcttgttgatgtactcgacgaagcccttcacaccgccggcgaacgcgaaatcgtcttccttgcccgagcgcaggtcggtgagacgaatccgcacgccgttgttcaggaacgaaagctcgcgcatccgcttcgcgaggatgtcgtagtgatactcgaccgtgccgaaaatggtcggatcggccatgaaatgcacttcggtgccgcggttctcggtgtcgccggtcacgagcatcggcgacacttctacgccgtccaccacctcgagcacgcgatcctgcgcgacgccgcggtggaactccatgaagcgcttcttgccgtcgcggcgcacggtgaggcgcagccagctcgacagcgcgttcacgcacgacacgcccacgccgtgcaggccgcccgacaccttgtagctgttctggtcgaacttgccgccggcgtgcagctcggtcatcacgatctcggcggcgctgcgcttcggctcgtgcttgtcgttcatcttcacgtcggtcggaatcccgcggccgttgtcggtcacggaaatcgagttgtcggcgtgaatcgtcacgtggatgtcgttgcagtacccggccaacgcttcgtcgatcgagttgtcgagcacctcgaacacgaggtggtgcagaccggtgccgtccgacgtgtcgccgatgtacatcccggggcgcttgcgcaccgcttccagaccttcgaggatctggatcgacgaggcgccgtagctgctgttatcgggttgcgaattgtgctgttcactcatggatatcttccggttctgcggggccactctcgtggcggcgcggtgcgtttcagcgagggaaatcgccggccgctccagtttcctggcccgccccaagtgccgaaaaggcactaaaagggcgggttgtcggttcgccataaaaacgccaaaggggcttgccgccccctggtgtgtgtcgcgatgtcgagcgcgtcagatgcgcatcggcatcacgacatacttgaactcgtcgttctcgggcacggtgatcagcgcgctcgagctggcgtcgccgaggctcacctgcacggtgtcgaccttcaggttcgcgagcacgtcgagcagatacgtgacgttgaagccgatgtcgacggtatcgccctggtaggcgatttcgagttcttcctgcgcctcttcctgatcggcgttggtcgacatgatcttcagctggcccggcgcgatgatgcagcgcacgcccttgaacttgtccgaggtcaggatcgccgcgcgctgcagcgaacgctgcagttcttcacggccgatctcgaacgtgttcttgtgcgccttcgggatcacgcgctggaagtcggggaacttgccctcgacgagtttcgacacgagctcgacctggccgaacgtgaacttggcctgggtttgcgcgatgtcgatggtgacggtgtcgtcgatgtcctcgagcaggcgttgcagctcgagaatcgtcttgcgcggcacgatgacttcctggcggccgaacgtgccgccttcgagcttcatcgacgagaacgcgaggcggtggccgtcggtggccacggccatcagctggtcgccgtcgacgacgagcagcatgccgttcaggtagtagcggatgtcctgctgcgccatcgcgaagtggaccatgccgagcagctggcggaacgacttctgcgggacggtgagcgtggcgccgaaatccttcgcctgcgcgacggtcgggaactcgtcggccgccagcgtctgcagtgcgaaacggctcttgccggattgaacggtgaggcgcttgtcggcgagcgacagcgtgacctggccgtcaggcatcgcgcgcaggatgtcgagcagcttgcgggcggcgacggtggtcgcgacctggtcgccgccgacgccgaaatcggcgcgcgtggtgatctgcagctccaggtcggtcgacaggaatgaaacgtccgggccgttcttggtgatcagcaggttggcgaggatcggcaacgtatggcggcgttcgacgatgccgctgaccgtttgcagcggcctgaggagggtgtctcgttcggtcttgaccagttgcatagagttccttcgttgagtaacggcctgcagcgcagcagcctcgcagcgccccgccggccgggctcttggcccgccaccaccggggcggtcaaaccagtattgtgcctcaaaaccgaaccgcccccttaaattggggcggaggccgaattatcaagcgcgccgcgcgctcagcccttcagcgtttgttccagcacgtgcagctcgtggttgagctgcgcgtccttgctgcgctcgtcggcgatcttgcgcaccgcgtgcagcacggtggtgtgatcgcgcccgccgaacagctcgccgatttccggcaggctcttctgcgtgagttccttcgcgagatacatcgcaatctgtcgcggccgcgcgatgttcgcggggcgcttcttcgagtacatatccgcgaccttgatgttgtagaagtcggcgacggtcttctggatgttctcgaccgaaatctgccggttctgcacggtcagcaggtccttcagcgcttccttggtcagctcgatcgagatctcgcggccgtggaacttcgaatacgcgaggatcttgcgcagcgcgccttcgagttcgcgcacgttcgagcgcaggtgcttcgcgacgaagaacgcgacgtcttccgagagattcacaccttccgactgcgccttgcgcatcaggatcgcgacgcgcatttccagctcgggcggctcgatcgcgacggtgaggcccgagtcgaagcgcgagatcaggcgatcgtcgatgcccgagatttccttcggatacgtgtcgctggtgatgatcacctgcgccttgttcgcgacgagcgcctcgaacgcgtagaaaaattcctcttgcgtgcgcgacttgccggagaagaattgaatatcgtcgatcagcagcaggtcgagcgagtggtagtagcgcttgaagtcgtcgaacgccttgcgctggtacgccttcaccacgtcggacacgtactgttccgcatggatgtagcggatccgcgcgccggccttgtcgagcagcagctggttgccgatcgcgtggatcaggtgggtcttgccgaggccgacgccgccgtacaggaacagcgggttgtacgagatgcccgggttgtccgcaacctggatcgcggcggcgcgcgcgagctggttcgccttaccggtcacgaagttgtcgaacgtgagcacggggttcagcttcgaacgctcgtacatcgaatcggcttcgccgccgttcgcgggtgcggcacccgggcccgggcgccacgtgcggcggccggcggccgcttcgtgcgcgggcaggctcggcaggtcgatgtcggcgtcgtcggcgttcaggtggtgcgcggcagccgccgacggcgtcatcggcacgtcggccggcgcggcgggcgcagcgccggcgttcgcggccaggttggcggcgatcgcggccaccgtggcggccgggccgctcggtgcgagcggcgcgcgcggggcggctgcgcccgatgcggcgctggccgcggtgctgcgcatgcctgccttgggatcgaggacgaactggacttcgatcggcgtgttccagaattcgcgggccagatcggagatccgtcccgaaaactggctcttgacccagtccagcttgaagcggttcggcgcggcgatggacagcgtgttcgccgacgcatcgaaggccaccggggccaagggtttgatccacgtcacgtactgctggggcgtcagctcgcgctccagcagtgcggaacagtgttgccagaaatcgttcatcaagtaactgtcgtttttgcgtgcacagcgcggctcgccggcgcccttgtcgcggttgcgcaacaaggcccgaagcggtcgtgcgagcgtgcctcggacgcctgcgtcacagtgttggaggggcaggcgcgggccgaggcggcgtgcgggattcttggagataaggcgagattctaccgccaaacgcgaccacagcgcgagttatccacaggccgggattgtgggtcgcggggccggatcggcgcgggccggcacaggcgagcgactcctaaagtattgaccgtcaagagaaaaacggtttaaatagcgggttccgcgaaaaccaatcctgtattcccggcgattgcgttcgcccgaatgcctacggttaagggcacgcggtcccctgaatttcgacattctcgaacaagtgagaacatcatgaaacgtacttaccaaccgtccgtgacgcgccgcaagcgcacccatggcttccgtgtccgcatgaagacggcaggtggccgcaaggtcatcaacgctcgccgcgcgaagggccgcaagcgcctcgccatctaaggcaggttgcgcgctgtgtccgccgtccgcagtcctgcggaaggtgccgtcgagccgggtgcgaatccgtcgcagacgaaagccgccttcccgaaagctgcgcgacttctgaaaacggatgaattttcatccgtttttcgtttgcgccctggcggcgctccgcgcacttcgtgatttacggcaagccgaccggtcagcccgcgcgtctggggctcgtcgtcggcaagaagtatgcgccgcgtgcggtaacacgtaacctcgtgaagcggctggcgcgcgatgcgtttcgcctgcgccgggccgagttcgccggttacgacctgctgctgcggcagcacacgcgcttcgacaagaaagcgctgccgagcgcggcttccgccccgctcgcggcgatgtgcgcggccgagatccgcgagctgctcgacagggcagtccgggaaatcgcccgccgtgcgtcgaagcccgcgtccgagtgacgcatccgtgcccggtgcggcgttcgcgcctgcccggccggttttgacgcggcgtcgtacggcgccgcccaaggtatggaaacggtattgatcgccttgctgcgcttctacaaggttgccgtgagcccgatgctcggcaaccgttgccgtttttatccttcctgttcggattacgcgcgcgaggcaatccagtatcatggcgccgcgcgcggcacgtatctcgccgtcaggcgcgtgtgccgatgccatccgttttccgcgggcggcatcgacctcgtcccgccgcccaactccgacactcgcgctcgcggcgaagccgacgcgcggtcccatcgactctgagacaacgcatggatatcaaacgcaccgtcctatgggtgatcttcttcatgtcagctgtcatgctgtacgacaactggcagcggtcccatggacgcccgtcgatgttcttcccgagcgccacgcagacggcccccgcggccgctgccggcggtgcatcgggcacgggcgcgacgacgaccgcaggtgaagtgcctgccgccgcagccggcgccgccccgtcgaccactgctccggccgcccaggcgcagctcgtgaagttctcgaccgacgtgtacgacggcgaaatcgacacgcgcggcggcacgctcgcgaagctgacgctgaagaagcagggcgacggcaagcagcccgacctgtacatcacgctgttcgaccacacggccggccatacgtatctcgcacgctcgggcctgctcggcggcgatttcccgaaccacaacgacgtctacacgcagctgaaccccggctcgacgtcgctgacgggtgaccagaacgcgctgaagctgtcgttcgaatcgccggtgaagggcggcgtgaaggtcgtgaagacctacacgttcacgcgcggcagctacgtgatcggcgtcgacaccaagatcgacaacgtcggcacggcacctgtcacgccgacggtctacatggaactggtgcgcgacaacacggccgtcgaaacgccgatgttctcgcatacgttcctcgggccggcggtctacacggacgcgaagcacttccagaagatcaacttcagcgacctcgacaagaacaaggccgactacgtgacctccgccgacaacggctgggtcgcgatggtgcagcactacttcgcgtcggcctggattccgcagcagggcgtaaagcgcgacatctacgctgaaagatcgatccgacgctgtaccgcgtcggcgtgaagcagccggtcgccgcgatcgcgccgggccagtcggccgacgtgcaggcacgcctgttcgccggtccggaagaggagcgcatgctcgaaggcatcgcgccgggcctggaactcgtgaaggactacggctgggtgacgatcatcgcgaagccgctgttctggctgcttgagaagatccacggctacatcggcaactggggctggtcgatcgtgctgctcacgatcctgatcaaggccgtgttcttcccgctgtcggctgcgagctacaagtcgatggcgcgcatgaaggaaatcacgccgcgcatgcaggcgctgcgcgaacgcttcaagagcgatccgcagaagatgaacgccgcgctgatggagctgtacaagaccgagaaggtcaatccgttcggcggctgcctgccggtcgtgatccagatcccggtgttcatctcgctgtactgggtgttgctcgcctcggtcgaaatgcgcggcgcgccgtgggttctgtggattcacgacctgtcgcagcgcgatccgttcttcatcctgccggtgctgatggccgtgtcgatgtacgtgcagacgagcctgaacccgaccccgccggacccggtccaggcgaagatgatgaagttcatgccgatcgcgttctcggtgatgttcttcttcttcccggccggcctcgtgctgtactacgtcgtgaacaacgtgctgtcgatcgcacagcagtactacatcacgcgcaagctcggcggggccaagaagaaaccggcctgacgcccgttgcacacgcgggcggcgagccgcccgcgatgcacgcaaaaaagccgcatggttcgcgccatgcggctttttgctttgcggttccggtgcggattcagcctttcttcgattcgcccgagtcgccgtagaactgctcgaccagttcctgcacgaggtagcgatgatgtggcgacagcgcttcaatcttcgacgcgagttcgatcgtctcgggcgtcggcggatagcgctcgtcgcgcggcagcggttgcggcgtcggatgttcgatcacgctcggcgacgggccgtaatgcaaccagtggagttcgacgcgcagccattcggcgagcgtggcgagtttgtccgacgtcggaatcgtgcgacccgtcagccacttatgcgcggtttgcggcgaaacgggttgcgctccgcggtgacgcagattgaatcggttcgccagttcggtcgcaccggtgatcttctccgggctgcgccgcagggcgaatttcaggcgttccgagaacgcggctttttcttcggatgtcggcatggggagattgtgcaattccaccaccacgtttcagacaaccattcgggctaaacgtatctcgttcagacgaatcccgatctcgatcggagtgggatgcaaaattgagggccacagtgttaggccgctccagcaggcatactcgtccgaaacggcggctgtgacattgcgctggactgatacttggcttatccccggcgggataaattcgggcgcgtccgaatccagcgcggcgaccgatggcgtgtgagccggcacgctacaatgccggcgttccgatgcccgaactgttgcgcgggcgcaccatattcactgatcacccgactcaaccgattcccatgctcgctaccgattccgatccgatcgtcgccattgccactgctgccggccggggtggcatcggggtcgtccgtgtctcgttcgggcgcggcggcgaggcggccgcgttgccgctgatcgacgcgttgtgcgggcagaagctcgcgccgcgccatgcgagctacgtgccgttcctcgacgagcacggcgcgccgctcgaccgcgggatcgcgctgtatttcccggcgccgcattcgtacaccggcgagcacgtgctcgagctgcaggggcacggcgggccgatcgtgatgcagctgctgctgcagcgctgcctggatgcggggcgcggtttcgggctgcggctcgcggagccgggcgaattcacgcgacgcgcgtttctgaacgacaagctcgatctcgcgcaggccgaggccgtcgccgacctgatcgaggcgagcaccgaagcggcggcgcgttcggccgggcgctcgctcgacggcgcgttctcgcggcagatccatgcgctcgtcgacgacgtgatcacgctgcggatgctggtcgaggcgacgctcgattttccggaagaggagatcgatttcctggaagcggccgatgcgcgcggcaagctcgcgaagattcgcgcgcagctcgcgcacgtgctgggtgatgcgcggcaaggtgcgctgctgcgcgaaggattgtcggtcgtgctcgcggggcagccgaacgtcggcaagtcgtcgctgctgaacgcgctggccggcgcggagctggcgatcgtcacgccgatcgcgggcacgacgcgcgacaaggtcgcgcagacgatccaggtcgaagggattccgctgcacatcatcgatacggccgggttgcgcgagacggaggacgaggtcgagcggatcggcattgcgcgtacgtggagcgagatcgagcgtgcggacgtcgtgctgcatctgctggattcgcgcaccgggatgacggcggatgacgagacgatcgccgcgcggtttccgggtggcgtgccggtggtgcgtgtgctgaacaagacggatttgaccggcgtggcggcgtgcgtcgagcatccggcggcggaaggcgacctcaccgaggtgcatctgtcggcgaagctcggcgacgggatcgacatgctgcgcgcggagctgctgcggatcgccgggtggcaggcgggggcggagggcgtgtatctcgcgcgggagcggcatctgatcgcgctgcgggccgcgcaggagcatctcgcgcaggcggcggatcacgcggagcaacgcgctcagtcgctcgatctgtttgccgaggagctgcggctcgcgcaggagcaactcaattcgattaccgggagttcacttcggatgatctgctggggtgattttcagcaggttttgtatcgggaagtgatgcccgcggattcgacgttcgaaagcgctttacggctcgtcattcgctgttgatcggccaccctgatcacgatcgatccccgtgcacgtcacgcggcctgccgtaaaatcggccggccgggacatttcgacacaacgcccccggtccaaaaacaaagagagggcacgcatgggattcggattcggaaaacgcagcgaatcaaccggcaactcgacggccgacatggcgaaaagccaacggtcgcgagcgaacgacaacttcaccacggagctcgagctgcgtcgggcatttgcgatattcaaatgctgtgcatcgcacggcacatacgtcgacctcaacgatgtggataccggctggcgccatctgcgggaagaaggccgggtgtcgtccgatctggaagccgcgtggaaagagctggacggcattctgctgacctatgccaatgccggagtgcttgccaaaccggacaaggcgctcgcccggaacctgacggatgacatcgaggcacaactcgatgccgtacagggcaaggtggacggcatggtcgatgccgttgtcgcaatcaacgttgcgcggctcaaatacccttcgaagagctggatcgtcgatggcatattcgcggccatgttcggcgtgataggcggtgcgatcctgggtaccctggccggcaagtttgccgaccatacgccggccgtcgggaacgccgtcttcggtctcgtgataatcggttcggtactcgtggcgcgttatcgccatcggcggaaaatcgtcgcggccgacgagaaaattgcgcaggcacaagccgaacttgaccgcatggtcattcgaaacctgtcgccttccgcgtatccgccgccgatgacggctgcgggcacgacctgagttcgcgtttcggatacggcgacgtcagtctcaaacctctgccggaggtgaatcccgtcgcgctgccgatgtttgccgcgcgccacaccgagtgctccgatgcctgaccattcgatcgaacgtcacgccattcttcgcgccgtctttgccgacgatgcgccaatatcccgacctgacgccgcgtcatgtcgcgctgatgaggcggcttcaggtcatgtggcttccgatcgaatccggtgcgccgggcattgttcccgagccgccactgagggaaacggcacgacgatcgatctcgccaaggcgatcctcgaaaccggtgacgacgtgctggccattcgcacgctggcagaactcggccacgtcgtgcccgaattcgtcacggtctcgggcacgttgtcaccggggcaatacgcgatcccggcggaactgcgcgaggcgttcgattttccggaaagcggcgttgacgcatcggggcgttttgaatttcgcgccgagcatctcgcgatactgcaagggaccgtctggagaacgctcgacgattactcgatcgatgcggtgctgaagcgcgatgacttctggccgctgtcctacatcgacggcaagcggccctatggggagtgcacgtacttccagatcgacatggccgagctgctggggagccctaccggttcgatgccgaacgcaatctgatcgaagacgcggagaaggatgcgcgcctcgaacgtctccactacgaaacgctcgctgcgctacaagtatttctgatgcatgccgagctgactgcgccggcttgatggcgcgaaggtccggatcgatgcagccggaccgtcacccacgtcaatcccaatgccggtgatggtaatacccgccaccaccgtaatacccgccgccgtcaggcaccacgatacagccgctcagcaacacggcgacgccggcaatcagcaaagggtcttcttcatcgggttcacctgctcgggttcaatatgaaacccagcatagcgagcgcccgcaacaccggctgtaagcgatcgtttcccggctccgcaatccgtaacggcggattattccggtcacaatgaccgtaacaaatctccaaacagcagacgttttcaggcagtgacgaccctgtttcgccccgtatccttcgcacgataaagcgcggcatcggcggcttcgatcaacgcatcgggtgtcgagagatcgtcggccgccacggtcgcgcagccgacgctcacgctcacgcgtccggcgggtgatgtcggcatcgcgagatcgagccgaagtaccgcctcgcgggcttcctcggcgaccactcgcgcgccgcgcgcgcccgtgttcggcagcacgatcgcgaactcctcgccgccgtaacgcgcgaccatgtccgcgggccgcctcaccgcgccggccaacgcgttcgcgacggcaatcaggcatgcgtcgcccttcacgtgaccgaacgcgtcgttgtatgccttgaagtggtcgacgtcgaccatcagcagcgacagcggttcgccttgccgtcgcgactgcaggaacagcgtgtggaagtgatcgttgaagtgcatgcggttgaatgcgcccgtcaggccgtcgcgcgcggacgaacggatcagcgtcgcgtgcgcctcgaacagccgctgatacagcatcgtcacttcccatgcgagcacgcacacgagcacgcccggcgtgaacatgctgaacacgcgcgcgagataccagccgaccgtgaatcgattggtgctcatcaggttcagcgtggtgtcggtgaggcacgcgagcaccgcgatcgcgagccacaggtcgagggtcgtgcgcagccggccggtggccagcacggcaacgagcgccagcgcattgagcagccacacgaccagcgcgacggcgttgacgggcagcacggccgcgtcgcccggcggatgaaacgcgggcggcagcgacacgttcagcgcgaacaggcacagcaatcccgcgacgacagccggcccgccgatcagtgcgagcgtccaccaccgtgtctgccgtgcgccgaccggtgcgcgcgccagccgcgcgcgcgcgagcagcgcgaccatcacgaaactcgggaagccggcatgccagaagatccacatccacgcggcgctttgcggttgcgcaccgaacagcccgtgcggcgcgaatacgccgggaaaggtgagcaactgcagcgcgacggcgagcgcggtgaacgcgtaggcgccgccgagtgcgccgagcaccggctggcgggtcacggtgaactgcgcgccgagaaagaacgccgcgatgctcgcggtggtgaacacggtgagcgcgcacatcggcatgaacggctcgacggccggcagcgcgacgttcgcgtgcggtgcggcgatcccgagcgcgagcacgatgacgagcgccgtcagtgtgccgaaccagagctgacggcgtgtcgtgtgctggatcaggatgccttccatggagttcccgggcacgtacgcggaaacgcccggtcttgcgccgggcgacaggcagccggccgctgcgcgaccggtgcggcctgatcctatcgcgttatggttttgcgctcaaaccccgaggccgggaccgaagttgccggcaacccagtgcgtgacggcgtcgacgtccgcgtagtcctgttcgggcaggccgtcgagcattgacagcacttcgttgctggcgcccgcgtcgcgcgcggcatcgacgatcgcatccttgttggccggatagcggacggccgccagcacgtcggcgatctgcaggtcgatcgtttcgttgggaatgtcgtgcggaggctgggcgggctggtcgttcacggcggcgtctcgctgagtgagcgggttgagcgggaatcggatcgaggcggaattcgggcgtgtaaccggatgcgtaccggggcgcgtcatgcgttcacacgccagggcggccaggccggcgcgccacgcggatgaacgccagtcgactcaatgcccgcgtcgcacgcggcgccacggatgcttccagtcgatgtgcggcgcgttttcgtcgcgcggatgctggcgccgatgttcctgccacagttcgtcggaaaacagcgccgccacgatcacgagcggcagcacgaggaaaattccgagtatcacttgctcgatcacgatagcctccttgcggtggcaggaacccttgctcccattctaggctctgaacttcgcccgcgttcaacttcttacagtgcggaacaggcctggaagcggccttgcccgcacgtgcgccggcatcaaaaggacatgaacatgcaactccagaacgataccaacacgcttgcgctgcggccgctggagcgccaggacctgcgcttcgtccacgaactgaacaacgacgcaaagatcatgcgctactggttcgaggagccgtacgaaaccttctcggaactgtcacaactgtacgaccgtcacgtgcacgaccagcgcgagcgccgtttcgtcgcggtcgacgcgcaaggcgaactggtcggcctcgtcgaactgatcgagctcgactacatccatcgccgcggcgagttccagatcatcatcgcgccgcaatgccaggggcgcggttatgcgggccaggcgacgcgcctcgcgatcgagtacgcgttcaaggtgctgaacatgcgcaagctgtacctgatcgtcgatacgtcgaatgcggcggcgattcatgtgtacgaaaaatgcggattccagcacgaggccgaattgaaggaagaatttttcggaaacggcgcgtatcacaacgcatatcgcatgtgcatctttcaacgcgattatttcgaacgccagcaatccagtccgaacaaggcagggtaaacgcgctggcgaaaggcgcttgcagcgggttttcgcgggcaccgaatacattcggggaactacggataaatacggattcgcttatacctggcatttttcttgtatcaggtatttgcgattccgcgctgcggtaaagtcgattcgtttcgaatgactttatgtgcggcgcatcaaaatgatccggatgacgaaatggattatccaaaccgttcaatcgcagcaatgtaacttggatgaaagccctgccgaataacgctttccgcccggcgtgacgggcctgtccgccacgcaacgggtgttgcccgccgcgcgtgccgcgcgaaaaacaggctgcgcacggggtgcgacaatccgccgctattgcggtcgcacaacaaatgtgcttgctatcgcttgccggtcttctaaagtgaaaaacgcgggttcacgatcacctttaaacacatagctaacccaagcctggtgcccgcaagcctggagacagaacatgatgaagcgtaccggtatcctttttgccctcgtcggcgcattttgcgcggtgtcgattgcccaggcgggcggcgattcggccgtcaagccgacgcaggaaatccagttgacgaagaatgcatggggctgcctgtcgaaagacaatctggattccgtactgagtcacgaacgtgacggcaagtcgcaggcgaagcagcaatacttcgacgactaccgttgcctgtcggtaccggaaggccagcgtttccgcgtcgtgtcggtcgaccagggcgacgtgcagttcgtcagcgccgacaacagcgaccagcagggtctctggaccgattcgcgcttcgtcaagcagtaaccgtccattcaccgcgcagtcgcacgacgcgcaagcgcgccggcccgatgagccggcggcgcgaaccgaacacggcccggcacatgccgggccgttgcgctgtgggtgacgcatgacacgcgccggacggcgcgcattcggtatcatcacggcccgaccgaaccgaatgcccgcccgggccgcatccgcatggcgctgaaatccacgatctacaaagccgaactgcaaatcgccgacatggatcggcattactacgccgatcacgcgctgacggtggcgcgccatccgtcggaaaccgacgaccggatgatggtgcgcatcgtcgcgttcgcgctgttcgcgcacgagcggctcgaattctgcaaggggctgtcggacgtcgacgagcccgatctgtggcagaaggacctgacgggcgcgatcgacgtctggatcgaagccggccagcccgacgagcggcgcatctcgaaggcggccggccgcgccgggcaggtcaccgtgatcgcgtacggcggcaagacatcggatatctggtggcagggcgtgcgcagcaggtcgagcggctgcgcaacgtgcaggtgctgtcgctggccgacggcgtcgcggccgcgctcgggcggctcgcggagcgctcgatgcgcctgcagtgcacggtgcaggacggcaccgcgtggatctcgagcgccgaccacgatccggtcgcggtcgaatggacggtgctgaaggcgcgcgcggacgcatgacggcccgcgcgccggccgcgttcagccgatcacggccggcggccccttgaattcgagcatgttgccttccgggtcgaacaggtagatcgacggcccgtagccgccggcgccgtagcgttccgcaggcgcgcccggctgtgcgccgtgtgcggcgaaatgggcggtcaatgcgtcgggatcgaacggctcgacgcgcaggcacaggtgatcgagattgcgcccgtgccgggcgggccgctgtcagggcggtcgatcgggccgccgaccgacagcaggtcgatcagtgcatcacctgcgcgcagctgcacgaggcccaggtcgggctgttccttttccacatggcagccgacggcgttgcagtaaaagcgcgtcatcgcggccatgtcggtcacgcgcagcacgatgtgatcgatcgcgcggatggtgggtttcatggacaggcgctccttcgcagtcgacgagcatcgagtgtagacgcatcgcgcctgcgccgcccgccggaacgcggcacaatcgacggacgaaaaagcccgttcacgcggagcggaacgggcttaatccatatcaggaggagacatggaggagacagttccaactatacacacggcgatggtgcggcgcaatattccgaatgcaaaaacgtcaggacggcgatttgtcgcatccgcggtgcagcaaaagggtgacgggacgatgacgaaaaccgcgctgcagccggcgcgcgtgtttcgccggacttatttccgggtgatgcgcccctgattatccggggcgaatcacagagcaagattcagggcgcgacggcacgtgccgatgtctagagtaggcaccatctacactagagagtgcgaggttcagatgaaaaccgcctatccgaccgatgatgcccgctggggcgccgtgaccgagcgcgatccgcatgcggatggcgcgttcttctacgccgtgagcacgaccggcgtgttctgccgtccgacctgtgcgtcgcggctgccgcgtcgcgaaaatgtgtccttcttcgccgatccggccgccgcgcgcgcggccggcttccggccttgcaagcgctgccagccggaagggctgccgcgcgagctcgagatcgtcaaccgcgcgtgcgcggtgctcgacgcgcatgccgagcggctcacgctgcagcagctgagcgatgccgtgcacgtgagcccgtttcatcttcagcggctcttcaagcgcgtggtcggcgtgtcgccgcggcagtaccaggccgcgcagcgcggcgccgcgctgcggcaggcactgcaaagcgggcagccggtcacgcaggcggcggtcgacgcgggtttcaactcgccgtcgcgactctatgcgtcggtgccgcgcgagctcgggatggcgccgtcggcgttccgccgccagggcgccggcctgcggatcgactttgcgaccgcctcgacgtcgctcggcacggtgctcgtcgcggcgaccgggcagggcatctgccggatcgcgttcggcgacgaaccggccgcgctcgtcggcgagctgaaggacgcgttcgcgcgcgccgagctggtcgaagcgtcggcacggctcgcgccgttcgtcgcgcagatccgcgcgtacctggacggcacgcggcacgcgttcgacctgccgctcgacatcgcgccgaccgccttccagcagcgcgtgtgggaagcgctgacgcatattccgtacggcgaaacacgcagctactcggagatcgccgaggcgctgggcgcgccgcgcgcggtgcgcgccgtcgcgtccgcgtgcgcgtcgaacccggtcgcgctcgcgatcccgtgccaccgcgtcgtacaaagggcggcgcgctgtccgggtatcgttggggcgtgcgccgcaaggcgacgctgctcgctgccgaggcgcgtcacgtgcacgacgatgaaaccgaatccgtcgcggagggcagcgcagtttgagcatcgcaagaacgacaattacgtccatcgtgaacggcggccgtgtgccgccgtccgcgcaaatggaactgcgcttcaatgcgccttacgactgggcgcgcgtcctgcgcttcttcagcgggcgcgcgattccgggcgtcgagcaggtggcggacggcgtgtatcgccgcatcgtcgacctgcacggcgacgccggccggctcacggtcgcgaaacatccgcgcaagcattgcctggtcgcgacggtcgaaggcgcggtcgcgcgtcatgtcgacgacgcgttcgccgcgcgcgtcgcgacgatgttcgacctcggcgccgatccgaccgccatcggcagcgggctggcgcgcgatccgtggttcgcgccgctcgtcgaggccgcaccggggctgcgcgtgccgggtgcatggtcggggttcgagctggccgtgcgcgcgatcgtcggccagcaggtgagtgtgaaggccgcgacgacgatcgtcggccggcttgtcgagcgggccggcgagcgcgtggttcatgaagacgacggtgcgcccgcatggcgttttccgacgccggaggcgctggccgcctgtgatctcgacaagatcgggatgcccggcaagcgggtggcggcactgacgggcacggcgcgcgcggtggcggccggcgacgtgccggtcgatcgcgagcacgccgatctcgcgacgctgcgcggcgcgtggctcgatctgcccggcatcggcccgtggaccgtcgaatacatcgcgatgcgcgcgtggcgcgatccggatgcctggccggcctccgatctcgtgctgatgcagtcgatcgccgcgcgcgatccggcgctcgaccggctcgcgacccagaagcgccgcaccgaaggctggcgaccgtggcgcgcgtacgcggcgctgcatttgtggaacgaagtggccgaccgggcgggcggcgcgcgcggcgggtgagggcaactgccgatcaccgagtttcgcggccgggtgcgacccggcgaagccgcgatgcaacccgtcgcgcgggccgtgccggtgttcgtgggcgacccgccggacttcggccatcacggccatttctcgaatccgtcgtgcgcccgatgcagggcgcacgacgcacactcgcctctctccgcggccgattcggcggcacggttgcacctgccgtcacccgttcgcgcgtcacgttccgtcggacgaatgcgctcaaccggcgtgcccgtcgtcgccgcctggaaccgtcgggagatgcggcgatcgccgcggccggcccgtccggcggcccgctccggcccgcgcaccatgcccggcgccacctcaagcgcgggtttcggcgagatgttaaagtgcccgctaccaacgaagcgaccaacaatccagccggccgcgcgcggcgttctgcgcgcggccgtcacgcacttgcgtctccatgtcgaacaccatgactcaccgccagtccgaactgctgctgaatcgcctcgaagcactgagctcgggcccgacgcggcagcatctgcccgacggcctgcgcggcatcgaaaggaaagcctgcgcgtgacgcgcgacggcatgatcgcgttcacgccgcatccgcgcgcgctcggttcggcgctcacgcatccggcactgacgaccgactattccgaagcgctgatcgagctgatcacgcccgcggaacgcgacgccgcgatcacgctcgaacgcctcgacgatctgcatcgctacgtctatgcgtcgctcggcgacgagatgctgtggaacgactcgatgccgggcctgctgccggccgacgaccagatcccgatcgccgactacggcacgtcgaacatcggccgcctgaagacggtgtaccggcgcggcctcgcgtatcgctacggccgcacgatgcagtgcatcgccggcatccactacaactactcgctgcacgaggaagtgtggcggcgcctgcatgcggaagaagggtcgacggctacgctcgtcgattaccagtcggagcgctatctcgcgcagatccgcaacttccgtcgccgcagctggctgctgatgtacctgttcggcgcatcgcccgcgctcgacacgaagttcctgcgcggcaagccgcacaggctcgacacgttcgacgccgatacgctgtacctgccgtatgcgacgagtctgcggatgagcgatctcggctactcgaacacgaccgcccaggccgcgctccacgtcgactacaacacgctgcccggttatctcgacgcgctgtcgaaggccgtgagcgagccgtatccggcgtacgaggccatcggcacgcatcgcgacggcgagtggatccagatcaacacgaacgtcctgcagatcgaaaacgagttctattcgacgatccggccgaagcgcgtcacgtattcgggcgagcgtccgctgcatgcgctcgcgtcgcgcggcgtgcagtacatcgaggtgcgctgtctcgacatcgatccgttcgagccgaccggcatcgcactggaaaccgcgcgcttcatcgacgccttcctgctcgcgtgcgcgctcgacgagagcccggtgctcgactgccccgcgtaccaggaggcgaacgcgaacttcggcagcgtgacgatggaagggcgcaagcccgggctcacgctgcagcgcgacggcgcgccgatcacgctgcaggcgtgggcggacgagctgatgaccgatatcgaaaccgtcggccgccgtctcgacgaaatccgcggcggcgacgaacatgcgcgcgcgatcgccgcgcagcgcgagaagctcgccgatccggagcgcacgccgtccgcacgcgtgctgcgcacgatgcgcgagcgcgggcaatcgttcctcgggttcgcgctggcacagagcgaagcgcatgccgcgcatttccgcgcgcacccgccgtcggcggagacgctgcgcaccgagcaggcgctcgccgcgaagtcgctcgccgagcaggccgagctcgaagcgaaggaggccggatcgttcgacgcattcgtcgcggcctatcgcgcatatacgctgaaccgcttcagcgtgtgatgcctggcgcacgcgcaccgcgtcggtcggcgcggtgcgcgatgcgtcctccgtcgccggtcggtgtgcgccgtggcgccccgatccggggcgatccaccgtcagtggtgtgcgtacgtgccgcgatcgatcgcgtgcggcagcgccggcttgcccgattccacgtttgccctgccgtcgctgccgtagccggtgtccccgccgcgtgcctgcgcggcacggtgcatgatcgcctgcatcttttccggaaagtcgggactgcttgccaggctcgtccggtagccggcggcctgcagctccacgagttcctggcggacctcggcgcgcgtcagcgtcgacgcggcctgcgcgtgcgcggcgaaggccgcgccgatcagcacgcatgcgcatacggcttgtttcatcgtcttcatcgtgttcactccgtgaggttccggtgccgtgccgtggccggcgcgggcggaatcgatgcagccagtctaggcttcggacgccagacgaaacatcccgcccgccgtcaggcacctttgccgcatgtgcaacattgcgcgggtgagccgcgcgtgacgggcatcctgtcgaacgcgacagcggcccgcccgctgcctgtcagcctgcggcggcaggcccgtatcgggtcggcacgcatcgggcttgtcctccttgtacaagcgccccgcgcctcctaacctcttttaagcgaccgatcggttggccgtgcgacgtcgttgcgtgcacaagcgcctgagcgccgtcgcgattgcggaaggaccgctttgcaccgaatccgggcgccgccgcgccagccccgggtcgactttggagacgcgatgaatcccaccgacgccctgccgcccggcattgtcttcgcgcagccgttgacgccggtcgccaactcgctgctgctgtccttcctcgtcgccgcgattccgatcgccgtcgcgctgatcgcgctcggcgtgctgcgccgccccgcgtggcaggcgtcgctcgccgggctggtcgccggcctcgcggtcgcgatcggcgcatggggatgccggccgggctcgcgttcaacgcggtcggcgcgggcatggcgctcgcggtcgtgccggtgatgtggatcgtcttcaacgcgctgctgctgtacaacatcgcggtgaagtcgggccgcttcgaccagttccggcagtggatgctcgacaacctgcccgacgatcggcgcctcgtgctgctcgtcgtcgcgttctcgttcggctgcctgctcgaagggatatcgggattcggcacgccggtcgcgatcacgagcgcactcctgatcgcgctcggcttcccgcgctcgaagcgctcacctatacgctgctgttcaacacggcgccggttgcgttcggcgcgctcggcgtgccgatcaccgtgctcggcgcggtgacgtcgctgccgcccgcgacactcgcgcagatggtcggccgccagttgccgttcttcgcgctgctgttgccgttctacgtggtcggcgcgtacggcgggctgcgctcgatctcgaagctgtggcccgcgctgctcgtgtcgggcggcagtttcgcgatcgcgcagttcgtcacgtcgaacttcctcggctaccagctcaccgacgtgctgtcgtcgctcacgtcgctgatcgtcacgatcggtttcctccaggtgtggaagccgcaacccgatccgcaatacgcgctcgcgcgcagcgtgcctgcaacagccggtgccgcccgcgcgggtttcggcggctggctgccgtggctcgtcgtgtcggtggtcgtgatcgtgtgggtgcacgcgaacgtcgcggcgatcggcgacgtgaagatcaagtggccgggcctgcacaacgcggtgttcgtgtcgctgtaccacaagccgtatgcggcgatctgggacttccagccgctcggcaccggcaccgcgatcctgctctcggcgatcatcacggccgcgctgacgcgcaccggcgccggcgcgttcctcgaatgcgtggtcaagacctggcggcagacgtggatcgcgatcgtcacggtgatgatgatcgtcgggctcgcgtacctgctgaactactcgggaatcagctatacgctcggcaccggcgtcgcgtcgacgggggcgctgttcccgctggtgtccgcgtcgctcggctggatcgccgtgttcctgtccggcagcgacacgtcgggcaacgcgctgttcggcaacctgcaggtcgtggccgcgcggcagctcggcctcgatccggtgctgatggccgcgaccaactcgtcgggcggcgtgatgggcaagatgatctcgccgcagaacatcgcgacgggcgtgtcgacgacggacctgaaagggcaggaaggtgtcgtgtttgcgcgcaccttctggcacagcgtgatcctcacgctgctgctcggcgtgctggtgttcctgcagcagcacgtgctgacgtggatgattccggcactgccgaaatgaggtgagcgcaacgacagaaggaaggcacgaggaaaacgagggaaggcgcgggaaaagcgccggcaaagtgcggaaccggcgaacgcgcggcacgtcagcgcgcgttcgcccgccgcgccgttcgtcctgcttcatccgccccggctgccgaggccgccgcggccgtgttgcggtcggccggcaggatgcacgcgagaaacgcgtcgatcgcggggctctggcggcgcgccttcaggtagtacacgtattcgtcgatcgtcgtgtccacgccgcgcagcgcgatcacgcgcaggtcgggatggcgctcggcctcgccgagcggaaacaggctgccgcccacgccgtgcaggatcgcctcgcggatcgcttcgcggctgccgatctcggccatcgatacggccgcgacaccggccgccgcgaggatcgtctccgtgcagcggcgcgtcaccgagccttcctcgcgaatcagcagccgcacgtcggcgagctgcgccggatcgatcgcggcgaaacgcgcgagcggatgcgtacgatgcacgacaagcacgagcgggtcggtcgagatcaccttgcgttcgaggccttcggcgtcgttgcgctgcgacgataccgcgagatcgatgcggaattcctgcagcgcctgcaggatttcctcggagttgccgatccggcacgcgagcgcgatcgacggatgcgcgttcgagaagcggccgaccgcgtccatgatgtagtacggccccgtcgcaccgatccgcagatgaccttcgaacaggccgccgacgttgcgcagcatgatatcggcctgcgcctcgagcgcgatcatcttctcgacgagcggcagcagctcgatacccgtctcggtgacctcgagcttgcggccgctgcggtagaacagctcgacgccgtacagctgctcgacctgccggatctgcgcggcaatcgtcggctggctcacgcccaggtggcgcgcggcgcgcgtgatgctgccctgccggacggtcgcgtggaacgccttcagctgatcgaacacgactcggcttctccctcttcatcgcgcgtcagcgtagcgcatgcgtgtgtcggccccatgaaaggcgcgtcgtgcgccgcttcgaaaaagctggggtgagcgcaagaaacctgctggaaccggtcacggccgggacatgccggtgcggggtaatagcgcgtaacacaccgaccgccggccccgctcgaccggcgccccactcctaccgacaacagggttcccttcatgtcttcgaacaatcgacgcgatttcctgcgcctcgccgcgcagtcggccggtgcgatggccgcctacgcgggcttcccgcccgcgatccgcaatgcgctggcgatgccggccgcctaccgcacgggcacgatccgcgacgtcgagcacgtcgtgatcttcatgcaggaaaaccgttcgttcgaccattacttcggcgggctgcgcggcgtgcgcggcttcaacgacccgcgcccgcacctgctgccgagcggcgcaccggtgtggcagcagccgccggcatcggtgttcacgaagaactaccattcgcgcggcctcgatccgtcggcgccgtacgtgctgccgttctacctcgacccgaagcagacgaccgaattccagcctggcaccaaccacggctggagcagcggccacctgtcctggaacaacggccagtgggaccagtgggtgaaccagaagcaggacgtgctgacgatgggctacctgaagcgccaggacctcacgtaccactacgcactggccgacgcgttcacgatctgcgattcgtacttctgctccgcgcacgccgacaccgcgccgaaccgcatctacctgtggaccggcacggtcgacccgcgcaacatctacggcaccccgccgaacggcccgggcatcggcgagcgcgacgacgtgaacggctacacgtggacgacctacgccgagcgcctcgagcacgcgaagatcagctggaaggtgtaccagggcggcacgggcatcccgggcgacccgaccgacaactacaccgacaactcgctgatgttcttcaagaagttccaggtgaaggaaggcgcgagcggcccgctggtcgacaagggcgcgtcggaccacacgctcgccgagctgaaggccgacgtgcaggcgaaccggctgccgcaggtgtcgtggatcgtcgcgccgtacaagtacagcgagcacccgcaggcgtcgccgaccgacggcgcgttctacatcaacatggtgctcgaggcgctgacgtcgaacccggaggtgtgggcgaagacggtgttcatcctcaactacgacgagaacgacgggctgttcgaccacgtcgtgccgccggtgccgccggtgccgccggtcacgagcggcgtgggcggccagggcatcgtgtcgtcgaacctgctgtcgaacctcggcgacgagctgctcgacctgaacaagtacccgggcgaaatgagcccgctcgtgccgggcgcggacccgggcggcatccagccgatcggcctcgggccgcgcgtgccgctgatcatcatctcgccgtggacgaagggcggctgggtctgctcggagacgttcgaccatacgtcggtgctgcgtttcctcgaagcgcgcttcggcgtgaaggagccgaacatcagcgcgtggcgccgctcgatctgcggcgacctcacgtcggcgttcgacttctccgcgcgccccgacacgcgcacggtgagcttcacggtgccgcagcacatcgcgaccgccggccaggcgtaccaggtgcctgcgcagcaggcgatgccggcacaggaacccggcacgcggccggcgcgggcgctgccgtacgagctgttcgtgcacagccgcgtgagcggccatgacgacagcgtgtcgctcgacttcgcgaacaccggcgatgcgggtgcggcgttctacgtgtacgaccgccgcaatccggcaacgccgccgcgtcgttatgcagtgtccgcgcacgatcgcttcgtcgacacgtggaacacgtcggctgcgcgcggcgattaccatctcgcggcatacggcccgaacggctatctgtgcgagttccagggcaacacgcggctcgcggccgacgggcggcacgcgaaccccgaagcgcggatcggctacgacgtgcgcaaccgtcacgtgtacctgcaactgcgcaacagcgggcgcgcaacctgccgcgtgacggtcgacaacgcgtacagccatgcgcatgcgcgcacttacacgctggagccgggcgaacgcgtcgaggatcacttcgcgctgtcgtcgagccacggttggtacgatctgacgattactgcgacgacgctgcgcggcggcgacgacaaggtcgtgcgccgcttcgcgggccacgtcgagacgggccggccgagccacagcgatccggggccggtgaagcacgcgacggcctgacggccgtcacgcgtcgcgcgatgcgggcgaggtcggcccgccgcgcgagcaccgcctgccggctgcatcccgattgcatcccggtaagtggaattggctttggaaactgaaaactgttgacaatgtgtcgggccgaggatatacaaggatcattcgccgatatggcgccctcgttccctaccgcagccttgctgcctgcccgaccatgacagccccgaacgcgctcagcgccatcgaactcctgcaaagccagtcgctcgcgatgatcgtccaggacatgctcgagcgcgcgatcgtctccggcgaatacgcacccggcgagaagctcaacgaagtcgagatcgcgacccggctgaacgtgtcgcgcggccccgtgcgcgaagcgttccgggcgctcgaacaggccggcctgctgcgtaacgagaagaaccgcggcgtgacggtgcgcgtcgtgcgctgcgcgaggccgaggagatctacgaagtgcgcgcgatgctcgacgagtcggtcgcgcgcgcgctcgcgaagcgcatctcgcccgacacgctgaaggtgctgaagggcatcatccagtcgatgaaggacgccgcgaagtcccacgacgtcacgcgctatacggagctgaacgtgcagttccacgacgcgatggtcgccggcgtcggcaatacgcacctcaccgatacctaccgccggctggtgcgccagctcgggctgctgcgccaggccgcgatcgaggccgaggaagacgcgatcgcggtgtccgccgccgagcacgacaagatcgtgcaggcgctcgcgcggggcgacgaggagcaggcagtcgcgctggtgcgcgagcacgtttcgcatggccttgcgcggatgcgccgtacgcacgagcaggggctgcccgcgacgggcaaggcggcgcgggagaaggccggcgcgtgagtggggcggtgcgcgtcatcgcacattgatgacgaaagagcgttgaccgggcgctcaccgccttccgttcttgcatggcgagtttcggctggcttgcttgtcgcatcggacaggcgtagctccggtcgaaatcgagggcgcgcgggctgaatgcaaggatcgccggcaggcgatcatttgccgcgtcgtttatcaaaggcatcgtccagaacccagcccgtgccggattcgcagtgcacttgtgtgtatgcgtaaattttggcaacacgatccgtcaatggaacacaggattcacctttcctgaccgtaaagatcggctgggttctatcgtcgtttggctcggcaaacgcaggcatgttctgacgcactgtccacttctcgtctttatatttcgagcacgcaccgatcgtcatggtgagtgcggcgaataacagaaggcgcatcatttttgggatatcgtcggattccaatcaggcgtttcgagtggcgcaggcggcgcgtgcccatcgcgtcggcggcctcgtagagccggccgtcggccagcgacagcgcggtgacgaggatcatcagcacgtgcgggaatgacgcggacaccctgctcagcacgatgcccggcagcccgtagatcgaatggccgtgcagcagcggcttcagcagccccgcgttgccgaaccggtagatgaacaacgtcgaggacaacagcgtcggcgcgagcagcggcaagagcgcgatcgggcgcgcggcgttcttcagcggcatgtacgagcgcgccagcgcatacgcgaacgtgaacatgaacgccatcggcacgacgatcatcgtgacgagcgcgccgaccgtcagcgaatgcagcatcgagcgcagcacgccgccgtcctcgaggtaatcgacgaaattgtgcgcgccgacgaatcggccgtcggcatcgacgaagcatttctgcacgacgagcgcgagcggcaggagcaggaacagcgacatcagcgtggccagcgcgagacgggccgcgcccgccggccatgcatccaaacgcctgtttaccggcacttcgttcatcttcagaccccttgacagtggcgccgcggccacggcggatgactggaggccagccctcttgccgctccgttgttttgctttctgtcgtctgcatgttgttgacaatcaacagatcatcaattttaatgtcgagcatggaaagcacctccttcggcgcggcgcgggcgccgacggctctacccttcgaaccgaaaggaatgaacgtcatgactgaaacgcctgtatccgtggaagtgaacggccgccgctacaactggatgcgccggccggtggtggtcgtgtgcgtcgacggctgcgcatacgaatacctagaggaagccgccggggccggcgtcgcgccgttcctgcgcacgctgctgaaaccgggcacggcgctcaagggcgagtgcgtggtgccgagcttcacgaacccgaacaacctgtcgatcgtgacgggcgtgccgccggccgtgcacgggataagcggcaactatttctacgatcgcgacaccggcgccgaggtgctgatgaacgatccgaagtacctggtcgcccccaccgtgctcgcgaccttcgccgagcaggggcgcgcgtcgcggtcgtcaccgcgaaggacaagctgcgccgcctcctcggcaaggggctgaagggcatctgcttctcgtcggaaaaggccgacgaggcgaccgtcgaggaaaacggcatcgacaacgtgctcgagctggtcggcaagcccgtgccgagcgtgtacagcgcggacctgtcggaattcgtgttcgcggccggcgtgcgcctgctcgagacgcgcccgatcgacctgatgtacctgtcgaccaccgactacgtgcagcacaagtgcgcgcccggcacggaaggcgcaaacgcgttctacgcgatgatggacacgtacctgcagcgcctcgacgaactcggcgcgatcgtcgcgatcacggccgaccacgggatgaacgcgaagcacgacgatgaaaccggcgagccgaacgtgatctacctgcaggagctgttcgacgagtggctcgggcacgacgcggcacgcgtgatcctgccgatcaccgatccgtacgtcgtgcaccacggcgcgctcggctcgttcgcgaccgtctacgtgccggcgtcggccgatgccgaggcgctgcgcgcgcggctcgccgcgatcgacggcatcgaggtcgtgctgacgggcgccgagggctgcgcgcgcttcgagctgccgcccgcgcgcatgggcgacctgatcgtgatctcgaagcaggacgtcgtgctcggcacgcgccgcatcaagcacgacctgtcgggcctcgacgtgccgctgcgttcgcacggcgggatctccgagcagatcgtgccgctgatcttcagcaagccggtcgccagcgacgtcacgggccgcgcgcggctgcgcaacttcgacatcatcgacatcgcgctcaaccatctgcagtgatgcgtacgcatccgcaaggggacacactcatgaacgccattgcagcatcgacggacgtccgcgagattcgtcgcgaagcactgcgaatcgacggcgaacggattcatcgggacgcggtgatcgaagtgcgcaacccgtacgacggcgcgctggtcggcaccgtgccgaaggcgacgctcgacgacgtgcggcgcgcgttcgcggccgcgcatgcataccggccggcgctcacgcgccatgatcgcgcggcgatcctgcgccgcgcggccgacatcgtgcgtgcgcgcacggcggagatcgcggcgctgatcacggccgaggccgggttgtgcatcaaggattcgacgtacgaggcgggccgcgtggccgacgtgctgacgttcggcgccggcgaagtgctgaaggacgacgggcagatcttctcgtgcgacctgaccccgcacggcaagaagcgccgcgtgtacacgcagcgcgatccgctgctcggcgtgatttcggcgatcacgccgttcaaccacccgatgaaccaggtcgcgcacaagatcgtgccgtccgtcgcgaccaacaaccggatcgtcgtgaagccgtccgagaaggtgccgctgtcgtgctacctgttcgcggacatcctgtacgaagccggcctgccgccgcagatgctgcaggtgatcaccggcgacccgcaggaaatcgccgacgaactgatcacgaacccggcgatcgacctcatcacgttcacgggcggcgtctcgatcggcaagtcgatcgcggcgcggatgggttaccggcgcgcggtgctcgaactcggcggcaacgatccgatcatcgtgatggaagacgccgatctcgacgaagcgagcacgctagcggtgtcgggttcgtacaggaactcggggcagcgctgcacggcgatcaagcggatgctcgtgcacgagtcggtggccgatcgcttcaccgggctggtcgtcgaaaaacgcgtgcgtggtcgtacggcaatccggccgatccgtcggtggacatgggtacggtgatcgacgaagcggccgcgaagttctgcgagcggcaggtgaacgacgcgatcgcgcgcggagcgcggctgctggtcggcaacgtgcgcgacggcgcgctgtattcgccgacggtgatcgatcgcgtgacgcccgacatgccactcgtgaaatacgaaaccttcgggcccgtgtcgccgatcatgcgtttccgcgacatcgacgaagcgatccggatgtcgaacagcaccgactatgcgctgtcgtcgtcggtgtgcacgaaccgattcgaccacatcacgcgcttcatcaccgaactggaagtcggcagcgtgaacgtgcgcgaagtgccgggctaccggctcgagctgacgccgttcggcggcgtgaaggattcggggctggggtacaaggaaggcgtgcaggaagcgatgaagagcttcacgaacacgaagacgtattcgctgccgtggtaagcggtgtgtaagccgcgcgcaccggtttcgcggccggtgcgcgcgtcgatcggtgcgttgagcggcgcgttgattgacgcgttgatcgacgcgttattcgatcggctcatatcgatagccgatttgcgtttttgccgtgcctcgacgcgtcggtagaattcgcggacttctcgaacggcacgcgcgtgccgcgggatcaatccctccaatcattcggggtccgcaccatgaaaatccttcgctccatcctggtcgtcgccatgctgcaggccgtttcggtcacgagcgcactggctgccgacgacctgtctcagatcaagtcgtccggcgtgttccgggtcggtaccgaagggacgtacgcgccgttcacgtaccacgacgagaccggcaagctgacgggcttcgacgtcgacatcgcgaccgcgatcgcgcagcgtctcggcgtgaagccgcagttcgtcgaaggcaagtgggacgggttgatcgcgggcctcgacgtgaaccgctacgacgcggtcgtcaacgaagtgtcgatcaccgacgcacgcaaggcgaaatacgatttctccacgccgtacatcacgtcgcgcgcggtgctgatcgtgcgcgcggacaacacgacgatccgctcgttcgacgacctgaagggcaagaagtccgcgaacacgctcaccagcaatttcggcaagcttgcggccgcgcatggcgcggacgtcgtgccggtgcagggcttcaacgaatcgatcgacctgctgagctcggggcgcgtcgacgcgacgatcaacgattcgctgtcgtacctcgatttccgcaagcacaagccggacgcgaaactgaagatcgcggcgaccgacgcgggcggcgccagcgatgcatcgggcgtgctgctgcgcaagggcagccccgcgctggtggccgcgatcgacaaggcgctcgcggacatcaaggccgacggcacctacgcgaagatctcgcagaagtatttcggccgcgacgtgtcgcagccgtgacgcgaggctgaacgatgccggcctggcttcacctgatggcggaatcgctgaagcccctgctcgtcgcggggctcgtgttcacggttccgctcacgctcgcgtcgttcgcgatcggtctgctgctcgcgttcggcgcggcgctcgtgcggctgttcgggccgcgctgggcgcaggccgtcgtgcggttctacatctggctgtttcgcggctcgccgctgctcgtgcagctgttcgtgatcttctacggcctgccgagcgtcggcatcgtgctcgatccgctgacggccgccgtgatcggcttctcgctgaacgtcggcgcgtacaacgcggaggtgatccgcggcgtgatcgaatcgattccgaaggggcagtgggaggccgcgtactcgatggcgatgacgcgcccgcaggcgctgcgccgcgcgatcctgccgcaggccgcgcgcgtcgcgctgccggctttgtcgaattcgttcatttcgctggtgaaggacacgtcgctcgcggccgtgctgaccgtgccggagatcttccaggccgctcagcggatcgcggccgtgacctacgaaccgatgatcctctatacggaagccgcgctgatctatctgctgctcagttcggtgctgtccacgctgcagcgtcgcctcgaaacccgcttcggccgtcacgcgctgttccaggcggagttgcgatgatccggctcgaacgcatcgacaagtcgttcggcacgcagcgcgtgttgcacaggatcgacctcgccttgcagcccggcagcgtgacggcgctgatcgggccgtccggcagcggcaagagcacgctgctgcgttgcgtgaacctgctcgaagtacccgaggcaggtgcgctgacggtcggcgacgcccgcatcgacttctcgccgacgcaccggccggcgcgcgacgccgtattcgcggtgcgccgccagaccggcatggtgttccagaactttcagctgtttccgcacctgagcgtcgtgcagaacgtgatggaagggctcgtcaccgtgcagcgctggccgcgcgaacgggcccgtgaacgcgcgctcgcgctgctcgagaaggtcggtatcgcgaacaaggccgacgcgtggcccggcacgctgtcgggcggccagcagcaacgcgtcgcgatcgcacgtgcgcttgcgccgtcgccgcaggtgctgctgtgcgacgagccgacgtcggcactcgatccggagctgtccgtcgaagtcgtcgaggtgctgcgccagctcgcgcgcgaaggcacgacgatgctgatggcgacgcacgacctgcgcctggccgcgtcgatcgcgcacgacgcggtgtttctcgcggaggggcgcgtggtcgaggccggtgcatcgcgcgacctgttcggcgacccgcgcgatccgcgcaccgcgaagttcatctcgacgctcgcgcagggcgtgccggtgttctgacgcggcacgcgacacgcgacacgcggtacaggcggcgtcaacctttcctgactggtcgagtaccgccgcgacgatcgcttccggcgcatcttcctgcaccaggtggcccgcgcccggcaccctgatcagctggccgccggcgatgcgatcggccagcgcctgcccctgttcgagcggaatccacgcgtcgtcctcgccccacacgatgcgcaccggaaagtccggtggcgcataacgggtctcggcttcctcgatgtagtgctggcgcatctgcgcgatctggcgatagaacgcggcctggccggctggcgtgagccacggcgcgcggtagatcgacagcgcctcgtcgctcagcggccgggcgacggcgttgccgagataggccgacacaagtgcgtgatgcgcatacgcgggcaatccggtgaaggcagcttcgtgctgcgcgacgtggcgcacgaacggcgaaccctgcggcgcaatcgcgaccgggttcacgagcgtgagatccgcataggcgacgccgtcgaggaagtgcgcgcgcagcacggtggcgccgccgtagtcatgcgcgagcacgcgcggtcgcgaaatgttccatgcgtcgagcatcgcgccgaacagcgcgttctggcggccgagcgacacgtccgcatccggcatgtcggattgaccgtagccgagcaggtcgtagaagaacacgcgatgacggcgcgcgagccacggtgcgatccgccgccacacctgcgacgaaaacggcgtgccgtgcacgagcacgagcggcgggccttcgccgaacgttccccaggcaatccggtggccttcgaaaatgaagcggttggcgagttcgagcatcggcatctccgtgctaacctgttttggttgttaacaggttactccggatcgtccgggtgtgaaaccgataggtgaaaataaatggttactcgacacgaacccgtgcgacatgcgcatgaatgggggcagccgattttgtcggcggccatccggcgctcgacttcctcaacacggtggccgacacgggcaagacgcgcgacgcggacaagttcgtcgactggccggccgtgcatgcgtgggcggagcgatcggggttgctggcgccggccgatctggcgcggcttctgcgtcatgcacggcaggacgacgccgacgcactggtcgcgctgcatcgctttcgcgaggaggcttacggcgcgatcgcacacctgacggtcggcagtggcggcactgccggcgcgcgcgcggcgggccggctcgccgttgcgatccgcgaggcgatcgggcgcagcgcgttcgatgcggtcgacggccggttcgcgtggcggcccgacgcgcgcgtcgcgtcgcgctgggtcgacgcggccgcactcgggttcgagcatctgctgcgcagcgacgattttgcgcgcgtgcgccagtgcggccgttgcacgtggttcttcgtcgatcgcgggcgcggcgtcgggcggcgctggtgcgacatgcgcacctgcgggaaccgcgcgaaagtggaggcgttcagggagcggtgacgcgcgcgccgagccggtcgtcgtgccgcgcggtgcgtggccggcacgcgaacgtcaaggcgcggcttcgtgcggcggatgttccggccatagcgtcgcggcgatgaacagcccggccgcgaggaacggcgcgccgatcgcgaacaggatggccgtgaggccccagtgatcccagaagcggtcgaccaccgcgcgctcgggtgtgacggggtcgtacagcacgttgaccgcttcgccttcgtgcaggcccggatgcgacgacgccgaaccctgcgcgaacttgatctggcgtccgctgtcggtcgtgaacgcgacgatcgccgaatacagcgacgtgcgcgcgcggggcgagtgcgcgtttttcgcgatctcgacgacatggccggtggaacgcgcatagtggtggatgacctgccactggcgcaggccggccgcgccggcgccggcgatgaagcccgtgccgatcgcgatcggaatcagcacgatcgcgatatcccagcggctgcgcacgtgcttgcgggcgcggcgggccggcggcggggcggacgatcggcggcggcgctcaccggcgatcagcaggccgccgatcgcgaacgacgcgatggcgagcagcgccggcacgatcgccggaaaccagcgttgcgcgaaatcgtcgatcagcgcggggcgttcggggtggccggggtcgagccatacctcgacgttctcgccgatgtcgtaggcggggacggtcgatgcggtattgccggccacttcgcggcgctggccgtcgttcgcgaggtacgcgacgatcggccggtatgcgcgtatcgcgtcgctgtcctgcacgatgcgcacgaccgtgcccggtgcacggaccagctggccggtcgcctgcccggccgtcacggcgagcatgccggccaggacgagcagcacgacgccgagcgccatcgcgacgagtgcgtccctacccggcatgaccggatccggttcttcgtgcttcgcactgcggattccggcttgatcgggggatggcgtgacccgccgaaccggccgatatcggcgcaaccaggccctctgaatggtcgcgtcccgttcacatgcttccatgtctgacgtcccatgctctctcagtgccggcgggcgagcgacagtgcctgcgccggtcgtgtgatatttgtcggacgattctagcggaaacgatgcggaagatgggtgcgctcgcgtaccgcgagggcgcgcaacgcgaagcgaggcggcgtaaatgaacaacggcaggaaagcggcgtaaacggaaaggccggtcagcttgcgctgaccggcctttgaaatttcctggtggggcgtgagtgactcgaacactcgacctacggattaagagtccgctgctctaccaactgagctaacgcccccaacagaagaaagattatgcacgagcatttcaggcttggcaagtcctttctgcaaatttcctgagaatatttcgtcacgacaacggtggctgccggcccgataacgagcgatcgcagttttcgtgctcccggtatgatgacgccacacgtgttgcgcggcggtcgcgcagcgctttctgggctttcgaagatggacgaaaacgcagtccgcgaattgctggatcgcctgctggcccctgggtccgctcgcttggtctggtccccgtgtcgatcggcgacgacagcgtcacgctgcgcctgccgttttccggcgaattccgccattcgggcggtgtgatctgcggccaggtgttcacggcggccgccgataccgcgatggtggtcgcgatctcggccgcgctcggcgagttccggccgatgacgaccgtgtcgttgaacacgaacttcatgcgtcccgtgcgcaagggcgacgtgctcgtcaccgcgcgcgtgctgcggatgggccgcaatctcgtattcggcgaagtcgagctgttcgacgaagacggcaagatggccgttcacgcgacgtcgacctacgcgctcgtcagctgagcggcgcgatgttcgaccagatcgtctttgcgggcggcggcaatcgctgctggtggcaggccggcttctgggacgtcgcacagccggcgctcagcctgcgcccgcgcgtgatcaccggtatctcggccggcgcggcaactgcctgcatgctgtatacacgcgacgctgcctgggtgatgcgctattacgaagaggcgctgcgccacaaccggaagaacgcgtactggggcaacctgttcgggcgcgagcccgtgtttccgcattaccggatttatcgtcaggcgctgctcgacatctacggcgaaccgttcgcgaagcttgccgcggcgccggagatccgcatcggcgtgtcgcatgtgccgcgctggctcggtgcgcgcagcgcagtcgccgccggtctcgtcgcgtacaacatcgagaagtatgtgcgcaagacgctgcacccgacgctcgggcgcacgctcggctttcggcccgaattcgtgcgtgcgcaggcctgcacgcaagtcgaggaactcgccgacctgatcctgcagtcgtcctgcacgccgccgttcacgccggtgctgcgccgcggcggccggccggtgctcgacggcgggatggtcgacaacgtgccggtcgacgcgctcgacccgacgccgggcgacgtgctggtgctcgtcacgcggctgtatccgcgcccgcagatgttcacggtcgcgcatggcgagcagcgtcggctgtacgtccagccttcgagcaaggtgccgatttcgagttgggattacacgagcccgtcgcagatgcggcatgcgtacgatctcggtcggcgcgacggcgagcatttcctcacgcgcgtcgatgcgatgacgggcggccgcgtggccgcctgacgatcgggaacggaggtgcggggccgcgcggcgtgcgcagcccgcgcggtcagcgcttgcggatcggcgtcagcgcttccgggttggcaacgctcgacatgtcgccgtcgtcgaacgcgaggatgttgcggaacgccgcgctgaagtagagttcgtagctttcgcgttcgacgtagccgatgtgcggcgtgcagatcacgttttccattcgcagcaggctgtagccctgcaggatcggctcgctctcgaacacgtcgatcgcgaccatccccggacggttgtgcgacagtgcgttgaccagtgcgttttcctcgagcagttcggcgcggctcgtgttgacgagcagcgacgtcggcttcatccgcatcaggtcttcctgcttcacgatcccgcgcgtgtcgtcatgcatgcgcaggtgcagcgacagcacgtcgctctgctcgaacagcgcttcgcggctttcggcggccgtatagccgtcggcgcgcgcggcctcgagcgaatgctcgcggccccagatcagcacgttcatcccgaacgccttgccgtagccggcgacgagccggccgatcttgccgtagccccagatgccgagcgtctggccgcgcagcacctggccgaggccgaagttcggcggcatggccgacgtcttcaggcccgactgctgccaggcgccctgcttcaggttcgcgacgtactgaggaatgcggcgctgggcggccatcacgagcgcccaggtcagttcggcgggggcgaccggcgagcccgtgccttcgagcaccgcgatgccgcggtcggtacaggcttcgagatcgatgtggctcgacacgcggccggtctggctgatcatgcgcaggttcggcagcttcgcgagcagttgcgacgaaatcggggtccgttcgcgaatcagcacgagcgcctcgacttccgccagacggctggcgagttgtcccaatccgcgcaccgtattgttgaagaccttcacgtcgtggccggcaagcatctcgaagcagttcagcttgcggacggcgtcctggtagtcgtcgaggatggcaattttcatgatgagcgggtgtcgcgcgttgaaagcggcggcggcggcgcacctcgcgcacccgtcccgcccggccggggccgacatgatgctatgtcagccgccttcgtggtgtctttttaacaggttgttacgctccgccgcaattggcggcagcctgccacgacgccgctcgcgcgacgggcagaagggtgcgctgttgtgtcgcatcaaatacgtccttcctgattcggccgcttacacgacgaggttcacccaattgttgtcccaatcggaataattggatcaactatccgcagagggcgaggatttttgactatttttatcgtcaaccggggccttgttgagcaactctgcatcatttccgctgtcgtaggagaattacgcatttgcttcatcttttgaagttgtaacagcggcaggagtcgtttatggatcatttgcagtcgatgcgcgtgttcgtcaaggttgcagatctcggcagtttcgcgcgggccgcgagtgcaatggatatctccaacgcggtcgcgacgcgtcacgtcgccgatctggagggcaggctcggcacgcgtttgctgaaccgcaccacgcgcagcctttcctgacggagtcaggccaggtctatctggagcgtgcccgccagatcctcgatgagctggaagacgtcgagcagatggttgtcgcgcgcaatcacgagccggtcggcacgctgcgcatcgtcgcgccggtcgtgttcggcctgcataacctcgcgcccgtgttgcagtcgtacacggagaatttcccgaaagtggtgccggattcacgctggtcgaccggcaggtcgatctggtcgaggaaggtttcgatgtcggcatcgtcgtcacgcgccagatgcgcagcgcgagcatcgtcacgcggcgcctgaccaccggctgcatgaccgtgtgcgcgacgccgagctatctggagaagcacggcgtgccgacccatccggagcatctcgccgagcatccgagcctgagcctgccgaccgaatactggggcgacgagcgtgtgttcacggggcaggacggcgaagtgcgtgtgcgcccgaccaacgtgatcgtcgcgaacaacaccgcgatgctgcgccagttcgcgctgctcgggatgggtgtcgcgatcctgccgagttacctgatcggcagcgacatcgcgcgcggtgcgctcgtgcggttgctgccggatttccggctgccgcaggtcgagatcaacatcgcttacccgagccggcgccatctgcccgcgaaggtgcgcacgttcatcgaccacctcgtcgagcatttcagccacgcgaccgacgcgacgatgggtgagcagtgggccgcgcagagctccgcgctcgcgccgatcggtgtcgagacgcgtgccgagcaaccggaatcggccgacccgaacctgtcgccgcgcctgccgcgttcgccacgcacacgcgtcgcggcgccgtcgccgctgtaacggcgcgacggcccgggcgaccgggcatcggttaccgccggcacaaagaaaaacgcggatcgagcagtcgatccgcgttttttatagctgcctgccgaagcaggacgcgccgggagaaagcccgccccggcgtccaggctgttacgagcccgtcttgcgggccgtcgtcttgcgagccgccgtcttggtggctgcagtcttcgcggcggtcttgcgagccggtgccggtttctcttctgcaccttccgtcacggtttcggcatccttcgtcgccgatttcgcagtcttcttcgcggcggcagccttcggttccttcttctcgaactcgaagccgatcttgccgtccggctgcttcacgaggaacgccttgaagttgcggccggtgcgcgacgacttgaagttcggcagcagatccgtgcggccgtcggccaacagcttgcccatctgctcgcgcgtgatttcctgctgcaggatcaccttgcccgagcggaagtcgcacgtcttcgggttggccaccgagtgctcgcacacgtagctcatcccgtgctcgaacacgcggcccttgcacttcgggcacgcgccgaccggctcctgcgtggagaagtcgggcgcctcgccttcctcgccgcccgtatcctggccgaaatcgaactcgagcttgtagttcttcgtctcgtcgtcgaacgagagcttcaggatcgccgagaacgggcggcccatcttgctgcggaatccggaaagcggaccgatcgtcttttcccgcagcagctcctcgacttcctcgatctcgaactgccggctgcccgggatcttcgagatcgagaactcgcacttcgtgcacgcgaagcggcggtagttttccttcacctggccgccgcagttcggacacggcgtctcgagcgtcgcgtaatcgccggggatcgtgtcggaatcgtattccttcgcgcgcttgacgatctgctgcgtcatgcgggcgatttcctgcatgaaggcgtcgcgcccgaggttgccgcgctccatctgcgacagcttgtattcccattcgccggtgagctccggcgcggtcagttccttcacgccgagcccgcgcagcagcgtcatcagctggaacgccttcgcggtcgggatcagttcgcggccttcacgcacgaggtacttttcgccgagcaggccttcgatgatcgccgcacgcgtggccggcgtgccgaggcccttcgcggccatggcttcgcgcagttcgtcgtcctcgacgagcttgcccgcgccttccatcgcggacagcagcgtcgcttccgaatagcgtgcgggcggcttcgtgacgagcgcgacggcggcgatttcgtccgtcttcaccttctcgtccttctgcaccggcacgaggttcgcatccgcgccttcggcgtcgcggccgtacacctgcagccagcccggctcgacgagcaccttgccttcggtcttgaagtgatggccggcgacttcggtgatccgcgtcgtgacacggaattcggcggccgggaagaacacggcgaggaagcgcttcacgaccatgtcgtacagcttctgctccggctcggacagcgacttcggtgcctgcagcgtcgggatgattgcgaagtggtcgctgatcttcgagttgtcgaagatgcgcttgttcggcttcacccagcccttgtcgagcacctgcttcgcatgcggcaggtagttgtggctctccttgagcatctcgagcgtggactggaccgtcgacaggtagtcttccggcagcgcgcgcgtcggtacgcgggtaggtcagcaccttgtgcttttcatacagcgcctgcgcgagaccgagcgtgttcttcgcggagaagccgaagcggctgttcgcttcgcgctgcaggctcgtcaggtcgaacagcagcggcgacagttgtgtcgacggcttcgattcctccgagaccgtgccgacctggtcgcggcacgctgcgacgatcgtttcggcggccggcaggctccacaggcgggagtcgcgcttttccggatcgaattcgtcgcgcttgaatttcgggtcgaaccacttgccttcgtagaagccgcccgcgcacgcgaattccgccttcacttcccagtagtcgcgcgggatgaagcggcggattttctcttcgcgttcgacgacgatcgacagcgttggcgtctgaacgcggccaactgtcgtcaggaagaagccgccgcccttgctgttgaacgcggtcatcgcgcgggtgccgttgatcccgacgagccagtcggcttccgagcggcagcgtgcggcgtcggcgagcggttgcatgtcgatgtcgctgcgcaggttcgcgaagccgtcgcggatcgcctgcggggtcatcgactgcagccacaggcgctggaccggctgcttcgccttcgcgtgctgcgcgatcagacggaaaatcagttcgccctcgcgccccgcgtcacatgcgttgatcaggcggtcgacgtccttgcgcttcatcagcttcgtgagcaccttgaggcgcgactcgcttttgcgatcgggttgaggtcgaaatgcgggggatgacgggcagatgcgcgaagctccatttcccgcgcttgacctcgtactcttccggggcggcgatttccagcaagtggccgacagcggacgaaaggacgaaatcgtcgctctcgtaatactcgtcatgcttggtaaagccgcccaaagcgcgtgcgatgtcgttcgcgacagaaggcttttccgcaatgatcagtgctttggacatgacaggtgtgtgttggtagaccgggttcgccggttgtgggtcctttaacgaccgctttatagcacacgccgacgcgacggcggctcggcgtgcaaaaagcggctcatcatagagggcctgcaacggcggcaagcgcccggcgcggcggcgcgcgcaaacgggcgcaaaaccaccgggccggctcgtgaattcaggcttcgacggtcaggacgttgcgcaatttcggtgcgtgcggcgcaccgggtaccgcactcaggtcggacagcatccgctcgacgattgccgcatgcggcagcaccgtgccgaagaaacgtgcggtgtgggtatcttcgatcaggatcgtcgggaagttctcgacgtcgaggtcgtcgagctggtcggcatgcgtttcgatgtcgatccaggcgaagcaggcgtccggatgcgcgtcggcgagctggtcgaaggccgtccggtagtcgcggcacgtgccgcaccactcggcgcacaggcaggcgacgagcaacgtgccgggatcggcgaggcgctcggcgatccgatccgcatcggtgtcgaggttcagcgcgggcatggatttccttggatatcgtcggcggcgtggccgcccctatgcggggaatgtagcacgccgtgcgcggccggggtgggcgctgcgtcaaggcgcgcgaagcgtccgccggggacgctcgcgacgcgaccggccagctcgagcgcgagcagcgcgccgtgcagcacgtcgtcggccaggccgctgtgttcggcaagccattcgtaagtgacggggccgtatcccagtgcggcgagtacggcctgttcggacgggctgtggggtcgcgccggcgatgcttcgattcgcgccggcgggccggctgcaacgagcggatcggcctgcgcgacgccagcggcctcggttccgcggaggttggcggcgctggcgagctgatttccggtgcacgatgcatcgcccgccgcgcgaaccgccggttcgcccagcccgtactcctcgagcacgtcgagcggcgccgccgtcagcttcgcgccgtcgcggatcagtgcgtggcagccctgcgcgagcggcgcgtggatcgagcccggcatcgcgaacacatcgcgccccagttcgttcgcgagccgcgcggtgatcagcgagccggagcgcggggcggcctcgacgacgagcgcgccgatcgcgagcgcggcgatcagccggttgcgttgcgggaagtgtgcggcgcgggccggtgtgccgagcggccattccgacacgatcgcgccgtgagcggcgatttcgtgggcgagcgcgcggtgtcgcgccggatagacgagatcggcgccggtcgcgatcaccgcgaccgtgcctgaccggccgtcgagcccgccgcgatgcgcggcgccgtcgattccgagcgcgaggcccgacacgatcggaagcccggcgtcggacagctcgcgggcgaagcgcgtcgcgtcggcgagaccctgcggcgtcgcgtggcggctgccgaccacggcgagaccgcgcgcgtgcagcaggtcgagacggccctttacatatagcagcggcggcggatcgtgcaggtcgcgcagccgcggcgggtaggccggatcgttgagcgtgacgagcgcgttgcccggcgcgtcgagccaggcgagcacggcgtcggtgcgcgcgtcgaggtcgccgcgctcgctcgcgcgcacggcctgggccgcggcggggctggttgcggcggcgatcgcctggccggacgcgcgcagcagcgcatccggcgagccgaacgcgtcgagcagtgcctgcagcacggcgggtgcgaggccgggcgcatgcgcgagctgcaaccacgcacgcagcgcggaggtggtcagcacttgcggcgacatgagacgctcctcgaatgcggcggccagcggaccgcgtggcgccatgataaaattttcatcatccgaaatactcgacagggccgcgcgcgcaagcgcccggctaattgcaggaggcgtgatccgcggcattgattcgccgcgcgtccgcctcatcttcattgcatcccggcggcaccgccagctggccggatggccgatgcggcatgccgccccacgaataccgaacgccatggctttactcaatattcttcattaccccgacaagcggctgcacaaggtcgcaaagcccgtcgacaaggtcgacgaccggatccgcaagctcgtcgccgacatggccgaaaccatgtacgcagcgcccggcatcggcctggcggccacgcaggtcgacgtgcacgagcgcgtgatcgtgatcgacgtctcggaggaaaagaacgagctgcgcgcgttcatcaaccccgagatcgtgtggtcgagcgacgagaagcagatctacgaagagggttgcctgtcggtgcccggcatctacgacgaagtcgagcgtcccgatcatgtgcgcgtgcgtgcgctcaacgagcagggcgagaccttcgagctcgactgcgagggcctgctggccgtgtgcgtccagcacgagatggatcacctgatggggcgcgtgttcgtcgaatacctgtcgccgctcaagcagacgcgcatcaagacgaagatgaagaaactcgaacgcgcgatgtgacgcgcgttcgccctgcccgaccccgaaagctgtcatgaaccatacgttgcgcgtgattttgccggcacgccggaatttgccgcggctgccctggccgcgatccacgaggccggttttccggtgccgctcgtgctgacccagcccgatcgccctgccgggcgagggatgaagctgcaggcaagcgcggtgaagcgctacgccgtcgagcacggatgcccgtcgcgcagccgccgtcgctgcgccgcgcgggcaagtacccggcggaggcggccgacgcgatcgagctgctgcgctcgactccgcatgacgtgatggtggtcgccgcatacggcctgctgctgccgcaggaggtgctcgacattccgcgcggcggctgcatcaacattcatgcatcgctgctgccgcgctggcgcggcgccgcgccgatccaccgcgcgatcgaggccggcgacgccgagacgggcgtcacgctgatgcagatggacatcggcctcgacaccggcgcgatgatcgaggaggcgcgcatcgcgatcgcgccggacgagacgaccgcgaccctgcacgaccggctcgctgccgaaggtgcgcgactgatcgtcgacgcgctcgtgcagctcgagcgcgacggtgtgctgccggccacgccgcaaccggccgacggcgtgacttacgcggaaaagatcggcaagcacgaagcggcgctcgactggcgcaagccggccgacgtgctcgcgcgccaggtgcgtgcgttcgatccgttcccgggcggcgtcgcgacgctcgatggcgcggcgatcaagctgtgggcggccgagcccgtggcggcgcgcggcgacgcgctgcccggcacgatcgtcgaagccgcgccggaaggcgtggtcgtcgcgtgcggcagcggtgcgctgcgcgtcacgcagttgcagaagccgggcggcaagcggctgcccgcccgcgagttcctggccggttcgccgctcgccgcgggccagcgttttgcgctgaccgacgttgcctgaggcggcctgaccgctattcgacacggcctgccgggcgtgcgcaatcggccggacggccgagtcgcgcggtgcggcaggcgcgcgtagaatttcctgcgctctccggtttcgaggttttcatgttcggcatcacccatttcggctttttcgtgctggcagtcttcctgctgaacgtcacgcccggccccgatacggcttatatcgtcggccgcagcgtcgcgcagggccgtggcgcggggctgatgtcggcgttgggcatttcggccggctgctgcgtgcacgcgctcgcctgcgcattcggcctgaccgcgctgctcgcggcatcggctgccgcgttcacggtgatcaagctggttggcgctgcctacctgatctacctcggcgtgcggatgatcatcgcgaagcaggcgggcgagccgtcgggcaaggcggccgcgcaagccgcgaagccgctgcgccagctgttcatgcagggtttctggaccaacgtgctgaacccgaaggtggtgctgttcttcgtgtcgttcttcccgcaattcgtgtcggccgacagcccgcacaaggcattggcgttcctgaccctcggcggcgtgttcgtcgcgatgagcacggtgtggaccagcctcgtcgcctgggtcgcgggcagtgtcacggcgcgcttttccggcaagccgggtgtcaggaagtggctcgaccgtacggtcggcagcgctttcgtcggcctcggccttcgtcttgcggcatcgcaacgctgagattgaatttttccggcaagaccttatctaacaaatcgcttacaattttccgccgtgccttgtgatgtgcggcgggtcccctgacggataaggagtgggtatgttcaattgggtcaaaacggcgatgctgatggccgcgatcacggccctgttcatcgtgatcggcgggatgatcggcggctcgcgcggcatgacgatcgcgctgctgttcgcgctcggcatgaatttcttctcgtactggttctccgacaagatggtgctgcgcatgtacaacgcgcaggaagtcgacgagaacacggcgccgcagttctaccggatggtgcgcgagctggccacgcgcgcgaacctgccgatgccgcgcgtctacctgatcaacgaggatgcgccgaacgcgttcgcgacgggccgcaaccccgagcacgcggcggtcgccgcgacgacgggcatcttgcgcgtgctgtcggagcgcgagatgcgcggcgtgatggcgcacgagcttgcacacgtgaagcatcgcgacatcctgatctcgacgatcaccgcgacgatggcgggcgcgatctcggcgctcgcgaacttcgcgatgttcttcggcgggcgcgacgagaacggccggccggccaacccgatcgcgggcatcgcggtcgcgctgctcgcgccgatcgccggcgcgctgatccagatggcgatctcgcgggcacgcgagttcgaggccgaccgcggcggcgcgcagatttccggcgatccgcagtcgctcgcgaccgcgctcgacaagatccatcgctatgcggcaggcattccgttccaggcggcggaagcgcatccggccacggcgcagatgatgatcatgaatccgctgcatggtggcggattgcagaacctgttctcgacgcacccggctaccgaggagcgcatcgcgcgcctgatggagatggcgcgtaccggccgcttcgattgagccacggcagcccgtgcggcagttgccgctcggggccgccatgccacccgcacgcttcgcgctgcggggttttcattgtgcgtgccgtaaaggggccaaaggggctgcaacgtcgcacgctacaatgcccggtttgggaccgcggggccatgcgagtgccgcgatcccgccgtttgccgtatttgcttgccgcgcttgtttgccgaatttgctccgatgacacgaacccgttctaccgctccgtcttcttccggccgcccggcgcgcctgtccgcgctgcatctcgcgcccgattcgctcggcttcgcgctcgacgcggccgcgcaggcggtcgatgcggtacgacgcggcaccgcgctgccggcggcactctcggcggttttcgcgcagatggcgtccggtacgcaggcacttgcgcgcggggcgacgcaggacgtcgcctaccggacgatgcgccgtctcggcagtgcggactggctgatcggccggctcatcagcaaggcgccgcccgcgcacgtgcacgcagtccttgccggcgcgctcgcgctgctgctcgatccggcggacgaggccgcgtatccgccgttcacggtggtcgaccaggccgtgaccgtaatcggcgcccgccgcgaatgcgcgttcgcgaaggggatggtcaacgcggtgctgcgtcgtttcctgcgcgagcgcgacgcgctcgtcgcggcgctgcaggacgatgtcgtcgcgcgctggaattaccgcgcgtggtgggtcgattcggtgaagcgcgcatggcccgacgcatggcaggcgatcctcgcggccggcgagcgccagggccgctgacgctgcgtgtgaatgcgcgccgcgcgagcgtcgacgcgtatctcgatacgctgcgggcgagcggaatcgaagcgaccgcgatcggcaagcatgcagtgcggctcgcgtcggcgctgccggtcgatcgcattccggggtttgccgacggcgtcgtgtcggtgcaggatgccggtgcgcaactcgctgccgaatggcttggcgcgcgtgacggcatgcgcgtgctcgacgcatgcgcggcgcccggcggcaagaccggtcatattctcgaactcgccgatgcggaagtcgttgcgctggaaagcgacgccgcgcgcgcggcgcggatcggcgagaacctcgtgcggctgtcgctcgcggcggacgtgcgcgtcggcgatgcgggtgcgcccgacgcgtggtacgacgggcgcccgttcgatcgtatcctggccgacgtgccgtgctcggcgtccggtatcgtgcgtcgtcacccggacatccgctggctgcgccgcgaggccgacatcccggcgctcgtcacggaacagcgtcgcatcctgtcggcgttgtggccgctcgtgaagccgggcggcgaactgctttacgtgacctgttcggtcttccccgaagaaggcgaattgcaggcccgctggtttgaagcggcctgtgaagatgcggtacgattggacgcccccggccaactgctgccgggcggagtgcagggagggcggccgccggcgcactcgaccagaacaccgatcacgacggatttttctacgcgcggtttcagaaacggtgacgatcaaacacctttttccacttcggctcgcggccgtcctgatggtcgcgttgacgctgtgcctggctgtcgtccggccggcgcatgccgagtcgatcgccgtgcagcgcgcgtcgctccaggccgacggaagcggctggagcctcgatgcccgcttcgatttcgagctgaacccgagcctcgaggatgccgtcaacaaaggcattccggtgtatttcacgacggatttcgagttgagccgtgcgcgctggtactggcttgacgaacagccggtatcggtgtcgcagacgatccgcctgtcgttccagccgctcacgcgcgagtatcgcgtgtcgacgggcggcctgcagctcggtttcccgtcgctgaaggatgcgcttgcggtcatcaggcacatcacgtcgtggcacgtgatcgaccgcagccaggtgcgctcgggcgaaacctacacggcatcggtgcggatgcagctcgatacggcgctgatgccgaagccgttccaggtcgatgcggtgaacaaccgcgactggacgctcggatcggactggaagcgcttcactttcacggtgaccgaacgtgctaaataaagtgcgccgcgcggccagcggaagagcctcctcgttcgcgtgatcgtctcgaccgtcgcgctcaccgcactgctgctgctcgtgctgctcgcggccgcgagcgcgaacaccgaattcttcgatcgctactactcgtggctgtacgcgacgaacatcgtcgtcgcactcgtgttcctgctcgtggtgctcgggctgatcgggatgatcgtcgtgcgcctgaggaagggcaagttcggcacgcggctgctcgcgaagctcgcggtgttcttcgcgctcgtcggcgtggtgccgggcgggatcatctacatcgtgtcgtaccagttcgtgtcgcgcagcatcgagtcgtggttcgacgtgaacgtcgagacggcgctgacggccggcctgaatctcggccgcgggatgctcgatgcgtcgctgtccgatctgcagacgaaggcgcggctgatgtccgaccagctcgcgagcgccgacgcgaacacgaacggcacgacgctcacgctgctgcggctgcgcgaccagttcggcgtgcaggacgcgacgatcgtcgagccgagccgcggcggctcgggcgcggcacccgacctgcatatcgtcgcgcaggcgtcgggcaatttcgcggcgctgattccggacgacctgccgacgccgctgatgctgagccaggcgcgcgaacacggcgcgtacgcggcgatcgagggcgaagtcgacggcgacccgcgcgcgcacggcgcgaagggcgcgctgcggctgcgcgtcgtgcggccgattcccgatgcgtcgacatcgctgctgcagccggcggagcgtttccttcaactcacccagccggtgccgcccacccttgcccacaacgcggatgccgtgcagcgcgcgtatcgcgagtaccaggaaaaggcgctcggccgcacggggctgcgcaagatgtacatcggcacgctgacgctcgcgctgttcctcgcgacgttcatcgcgatgatgctcgcgctcgcgctcggccagcagctcgcgcggccgctgttcctgctcgcacagggcacgaaggagattacggaaggcgactacacgccgaagcgcgagatcaagacgcgcgacgagctcggcttcctcacgcagtcgttcaacgcgatgacgcgccagttgtccgaggcgcggctcgcggtcgagaagaaccgcgtcgcgctcgagcattcgaagacgtatctcgagagcatcctcgcgaacctgacggccggcgtgttcgtgctcgaccgccagttccggctgacgacggccaatcgcggcgccgagcggatcttccggcagccgttcaacgcgctgatcggcacgacgctcgaccggatcggcgtggccgccgggttcggcgcgatggtgcgcaaggcgtttgccgatcgcgaggcggcatccgacggcgccagcggcgatcgcggccattggcagcagcagttcgcgatcgaggtgccgggcgaagccgatccgctgacgctgctcgtgcgcggcacgcgcctcgtatcgacgatcgagggcaggccgacgatccgcagacgtccggttacgtcgtcgtgttcgacgacatttccgacgtgatttccgcgcagcgttcggtcgcgtggggcgaggtcgcgcgccggctcgcgcacgagatcaagaatccgctgacgccgatccagctgtcggcggagcggttgcagatgaagctgtccgacaagctcgcgccgcccgacgccgatgtgctcaagcgcggcgcgacgatgatcgtcaatcaggtggccgcgatgaagcggatggtcgacgatttccgcgaatatgcgcgcacgccgccggcggtgctcgcgaacctgcagttgaacgaactggcgagcgaggtgctcgggctgtacggggtgggcgaaggcaagagcgcgatcgtcgccgagctcgcgccgtcgctgccggtgattcgcggcgacgcgacgcaattgcgccaggtgattcacaacctgctgcagaatgcgcaggattcggtcgcggagacagcgcatccgcgtgtgttgatcgaaaccaagacagtagaatatggcgatcccgacgccgagggcaaaacacgcgtcgcggtacgtcttaccgtgtccgacaacgggcccggttttccggcgcgcatcctgacccgcgcgttcgagccttatgtgacgacgaaggcgaagggcacggggctggggttggccacggtcaagaaaatcgtcgatgagcacggtgcgcggatcgatctgcgcaatcgcatgcacggcgagaccgtcgagggtgcgcaggtgtcgattctgttcctgcagatggcgagcgatgcgccaggcgccgaatcgggcgggcaggacgggacggctcccgccaagacaaaagcaagtgagcagacaaaggcagcgtaaatggcaaccatcctggtggtagatgatgaaatgggcatccgggaattgctctcggagatcctcagcgatgaaggacatgtcgtcgaggcagcggagaacgcgcaggccgcgcgggaataccggttgaatcaggcgcccgatctcgtgctgctcgatatctggatgcccgataccgacggcgtgacgttgctcaaggagtgggcggcgcaggggctgctgacgatgcccgtgatcatgatgtccgggcacgcgacgatcgacacggccgtcgaggcgacgaagatcggcgcgctcgatttcctcgagaagcccatcgcgctgcagaagctgctgaagtccgtcgagcacggcctcgcacgcggtgcggcgccggtgtccgcgaacgcggcggcgaaggccggtgcggggcagccggcgggcccggcggcggtcgcatccgcggccgcgctgcccacgctcggcgacgacatggcttcggcgctcggcctcgcgggccagacggccgcgatcccgttcgacattccgttgcgtgaagcgcgcgatgcgttcgagcgtgcgtacttcgaatatcacctcgcgcgcgaaaacggcagcatgacgcgcgtcgcggagaagacgggcctcgagcgcacgcacctgtatcgcaagctcaagcagctcggtgtcgagctcggcaagaaaccgtccgaaggcgccgtataaaatattttgcgaaaacacttgctcaggtacgaatagctcgatatactttcattcttcgttggcccggtagctcagttggtagagcagcggattgaaaatccgcgtgtcgatggttcgattccgtcccaggccaccagaattaaaaccccaagaatcgaaaggttcttggggtttttcgtttgtggtggggttggcgtgatgaggtccgcgggcccgcgagcccggcagtattcgagatggcatgataaaatccgtgtccgctcaataacttagcgcatcgcttcatgcgcacggcaggctgccagcgtggcgccgccgtggcgcgcggcaacgatgccgcgcgatgggcggtataagcgctccgccgcgttcgcggccgattgcgctgcctatactggtcgagccggcccaggccggcacgcgtcgggccgcccggcggcagccggccccgggcgcagcgcgacgcgagcctacacattcacggagtatcacggtgattcggacagacgctaaagacggcgcgctcgtgttgttttccggcgggcaggactcggccacgtgcgtggcctgggctctggaacgctaccagacggtcgagacgctcggcttcgattacggccagcgccaccgcgtcgagctcgagtgtcgcgaaggcgtgcgcgaagcactgaagcgcgattttcccgcatggtcggatcggctcggcgacgatcacatgatcgacctgtcggtgctcggcgcgatcagcgataccgcgatgacgcgcacgatcgagatcgagacggcggcgaacggcttgccgaacacgttcgtgccgggccgcaacctgatgttcatgacgatcgccgcggcgatcgcctatcgccgcgggctgcgtgtgctggtcggcggaatgtgcgagaccgatttctcgggctaccccgactgccgcgacgacacgatgaaggcgctgcaggtcgcgctgaacctcgggatggacacgcgcatcgtgctcgagacgccgctgatgtggctcgacaaggcgcagacgtggcagctcgccgagcagctcggcggcgaagcgctcgtcgaactgatccgcgtcgagacgcacacgtgctatgtgggcgagcgcgcggaattgcacgaatggggcttcggctgcggcgaatgccccgcctgcaagctgcgcaagcgcggctacgaggcttacctgaagggcgagcgggtgaccgaagcgccgctgtgacgcgggtgcgccggcagcgctggacgaataacggattctgatcgacaacgagcggcgcgagccggacgaagcacgatgacttacgcggtcaaggaaattttctacacgttgcagggcgagggcgcgaacgcgggccggccggccgtgttctgccggttcgccggctgcaacctgtggtcgggccgcgaagaggatcgtgcggaggccgtgtgccgcttctgcgataccgacttcgtcggcaccgacggcgagaacggcggcaagttcaaggacgccgaagcgctcgtcgcgacgatcgccggcctgtggccggagggcgaggcgcaccgcttcgtcgtctgcacgggcggcgagccgatgctgcaactcgaccagccgctcgtcgacgcattgcacgcggccggcttcgagatcgcgatcgagaccaacggttcgctgccggtgctcgaatcgatcgactggatctgcgtgagcccgaaggccgacgcgccgctcgtcgtcacgaagggcaacgaactgaaggtcgtgatcccgcaggacaaccagcggctggccgactacgcgaagctcgacttcgagtattttctcgtccagccgatggacggcccgtcgcgcgacctcaatacgaagctcgcaatcgactggtgcaagcgtcatccgcagtggcggctgtcgatgcagacccacaaatatctgaacattccctgagccacggcttttgacatcgtgctgattacccgaaaactcgaattcgacgcgggccaccgcattcccgatcaccgcagccagtgccggaacctgcatggtcatcgctacgtgctcgaagtcacgctgcgcggcgatctcgtcgataccgaggggcgcccgaccgcggcatggtgatggatttcgccgacgtgaaggcgctcgcgatggagcacctggtcggcaagtgggaccacgcgttcctggtctacgcccgcgacgaggtcgtgcgctcgttcctcgagcagatggccgaccacaagacggtcgtgatcgaccggatcccgaccgtcgagaacctcgcggcgatcgcgttcgacatcctcgcgaacgtgtacgacgcgcactacggcgtgaacctgcggctcgagcgcgtgcgcctgtacgaaacgccgaactgctgggccgacgtcgaacgccagcccggccgctgatcccgccttcccggcagccccgccagccggcgcgggctgcctgacgccgcaccccgcggcttcgtcccgcccccgtccgttcccacattccgcgtaacgccgcgctatgatcgttgcgtggcgccggaaaacgcggccgtgcgcgatcgcgcggccggcgctgtcagatcggccgtccacggccgaccaacgatccagggcccggtcctggcgccgccgtgcttcgctgcccggcgtgtcgcgcgccgctttgcccgttgcttgtcccgttcgattgccgttccgtccaggaggccgtatcgatgagcacgctcaccaattcactcaaacaacgcctgcacgacggcgacgacccgttgtacggcctgtggctgtcgctcggcagcgactcggccgcggaagcgctcgcgcatgccggctacgactggctctgcatcgacatggagcacgcgccgaacgacagccgcgatgttgcatcgcagtttcgcgcgatcgcggccgcccatctgccgagcgaacccgtcgtgcgcgtgccggcgcgcgagccgtggctcgtgaagcacgcgctcgatgccggcgcgcgcacgctgatgtttccatgcatcgagacgctcgacgacgccgcgcacgcggtgcggctgacgcgctatccgtcgcccgaatcgccggacgggctgcgcggtgtcgcgggcatggtgcgcgcggcggcgttcgggatgcgccgagattacgtgcagacggcgaacgcgcaggtcgcggtgatcgtgcagatcgaatcggcgcgcggcgtcgacgaagtcgagcggattgcggcgctgcccggcgtcgactgcctgttcgtcggcccggccgatctcgcggcgagcctcgggcatctcggcgacatccgccatccggacgtcgaaaccgcgatggcgcgcgtgctcgcggccggccggcaggccggcgtcgcggtcggcatcttcgcgggcgatacggcggccgcgcgccagtatcgcgaggccggctaccggatgatcacgctgtcggccgacgtcagctggctgttgcgcgccacgcggcaggcgctgcaggaggtacggtcatgaacgatggcgacggcgcgtgccgtgggcgcgtgcagggtggggccggggcgcgcaggcggatcggcgcgatgctcggcctgtggtgcgtgtgtggcgtctatggcgtgtgtattgcagcgggcgcaccgggcgtgccgcaagcgaagcccgatccatcgcgcgagacgcagtcggcggtcgccgactacaacgccggcgactatcgcgcggcgctggtgcagttccacgacgcggccgagcgcggcgaccgtctcgcgcaattcaactacgcgatgatgctgctgacgggcgaaggcgtgacggcgaacgtcgacgaagggctgcgctggctgaagcgcgcggccgacgcgaacatgtcgcatgcgcagtacgtgtacgggcgtatgctcgacgacggcgagttcgtcgcgcgcaatccggccgaagcgcatcgctggttcctgcgggcggcgaagcaggggcatgtgcaggctgcgctgtcgctcgcgaaccagttcctcgacgggcgcggcacgccgcgcgacaaccggcaggcattcgcgtggtacaagcaggccgccgatgcaggcgagccgaccgcgcagtacgtgaccgcgtcgttctacgagcgcgggggcgacggtgtcgcgcagaacctgaacatcgcgcgggcgtattacgcggcggcggccgcgcagggcgacgagacggccgggctgaaattcaaggagctgagtgcgcggctgaaggtgcaggggccggcgtcgggcgccggcgcggagccgggcgggacgcacgcgccggcgccgtgaacggaggtcgcgccacgccgcgccgcgcggccgcgttcggcaaggacggtcaaaaacggcgccgcggcgccgtttttctttctgcgatgcgtacagcgcggtcagctcttcatcaaccgccgctgcctcccgacgctcatgatcatcccgatcgcgatgccgagcgtcgtgagcgccgtgccgccataactcatgaacggcagcggcacgccgacgaccggcagcacgccgctcaccatcccgatgttgacgaacgcatagacgaagaacgcgagcgtgagcgagcccgcgagcaggcggccgaacagcgtcgcgccctgcgcggcgatatagagcccgcgtgcgatcagcgccatgtaaagcgtcagcagcacgagcccgccgacgagcccccattcctcggagaacaccgcgaagatgaagtcggtgtgcttctccggaatgaactcgaggtgcgcctgcgtgcctttcaggtagcccttgccgagcacgccgcccgagccgatcgcgatcacggcctggatcgtgtggaagcccttgccgagcgggtcggaagtcgggtcgagcagcgtgcacacgcggtgcttctggtagtcgtgcatcagcggccactgcacttcgggctggcagatgcgatcttcgaacacggcgatcgagccgaccgcgatcacgcccgcgacgagcaccggcacgatcagcttgaacgacaggccggcgaggtagatcacgaagaagccggccgcgaacacgagcaggcccgtgccgaggtcgggctgcttggcgatcagcccgaccggcaccatcaggatcccgaacgcggcgatgaagtcgtaccagcgcagcccgccttcgcggcgctggtagtaccacgcgagcatcaggggtcgcgatcttgaggatctccgacggctggatcacgacgccgacgttcagccagcgcttcgcgcctttcttggtcatcccgaacagcgcgaccgcgaccaatagcgtgaccccgaacgtgtagagcgggaccgcgaagcgcatcagcgtcgtgggcgggatgttggcgatcacccacatcagcacgaacgtcagcaggatgttgcgcaactggtcctcgacgcggcccggcatgtcgatcgccgcgctgtacagcgtgacgatgccgacgcacagcagcaggaacacgatgagggcgagcgggcggtcgaagcccgcgaacatctgcttgatcttgtcgagccaggcgcgcttgtcgaattgcatgcctttctccgttaatgagcggtgccggcgtccgccgccttcgcggaggccgtcgcacggtggttgtcgtcgcgcggcgtggcgacgagcggctgcgcgtcactggcgggccggcgcggccggtgcgggcgccggatcggcggcaggctcgcggccctcggcgcatcggcaccggcgctcgccggcacggcggcgcttgcaccggcggccgacgcttcggaggccgcggcggccgatgccgcttccgccgcactggccgcgctcggcacgaccggctgcggcagcgccgtgaagccggccgcgacggcggcgggccggttcgcgtcgccgatcaccggcgcgttgacgggttcggtcgccgacgccgcggcagccacggccgcggcctcgttctgcgggttctggcggtcgacgagatagaagtcgagcacgcggcgtgcgatcgggcccgcggcctgcgcccccagccgccgttctcgacgaccagcgcgacggcgatctgcggatggtcgaccggtgcgtacgcgatgaacagcgcgtggtcgcgcaggtgctcggcgagcaggtggcccttgtagttggagccttgcagcgagaacacctgcgcggtgccggtcttgccggcggcgaggtacggcgcgccgcggaacaccttgtacgcggtgccggacgggttctcgatcacgttctccatcccgcgcttcacgacgtcgatgtcggcctgcttgagcgggatcacttcgctttccttcggcacggtcaggcggcgcccgcgcgtgatcgggtcctcgatttccttcaccaggtgaggcttcatcacgacgccgttgttcgcgagcgtcgcggtcgcgtgcgcgagctgcaggatcgtgaacgagttgtagccctggccgatcccgaggctgatcgtctcgccgtcgaaccacttctgctgcgcggccttcttgaacgccttcttcttccagtcggtcgacggcaggatcccgcgcgcctcgccctggatgtcgatcccggtgatctggccgaagccgaacggcttcatgaagttcgcgatcgcgttcacgccgaggtcgcgcgcgagcatgtagaagtaggtgtcgttcgacaccatgatcgccttgttcatgtcgacccagccctggcccgagcgcacgtcgttgcggaacgtgtggccgccgaacgtgaagtagccgggatcctggaagccccagcccggcgtgcgcttgccgagcgtcaggccggcgagcgccatgaacggcttgtacgtcgagccgggcgggtaggtgccgtgcagcgggcggttcagcagcggcttgtcggtcgagttgttcagctcgtcccaggtctgctggtcgatgccgtcgacgaacgagttcgggtcgaaactcggcgacgacacgaacgcgagcacgtcgcccgtcttcggctcgatcgcgaccagtgcgccgcgcttgccggcgaacgcctgctcggcgacctgttgcagcccgatgtcgagcgacagcacgaggttgttgccgggcgtcgcctgcgtgcgcgacagcgtgcgcaccggccggccgccggccgtcacctcgacttcctcgaagcccgtcagcccgtgcagctcggtttcgtagctctgctcgacgccgatcttgccgatgtagtcggtgcccttgtagttgttcgcgtcgcggcgcggatcgtagttttcctggtcgctgtcgttgtcgtcgctcatcgcgtcgatgcgatcctggtcgcgcttcgagatccggccgatgtagccgatcacgtgcgcggccgtcgtgccgagcggatattggcggaacagccgcgcgcgcacgtcgacgccggggaagcggaagcgctgcgcggtgaagcgcgcgacttcctcgtcggtgagccgggtgcggatcggcaggctctcgaagttcttcgagtcttcctgcagcttcttgaagcggcggcggtcgcgcgcgtcgatcgggatgatctcggacagcttgtcgatcgtgttctcgagcgtgtcgtcgagcttcgacggcgtgatctcgagcgtgtacgccgaatagttcttcgcgaggatcacgccgttgcggtcggtgatgatcccgcggttcggcacgatcggcgcgaccgagatgcggttttcctcggcctgcagcgcgtatttgccgtgctgcatcaactgcaggtagaaaaagcggctcgcgagcagcccgaagcagacgaacacgaacacgcccgccgccgcgacgcgcaggcggaacttcgagagctgctgttgggtgtcgttgaattcggtcatgcggttacgatcgatctggcccgcgcacgatgcggctgcgggcgagggccgcccggagcgcggcgggcgtggaggcggcgggtagtcaaggcaggcccagggttcagatggggcgcgtatcgtccggatcgaccgggcggcgttgcggcatcagcagcaggtggctcgcgatcggccacagcgcggcctcgacgaagccgtcgaccaggtagcgccagcccgggaacgcggcgcccatcacgaggcggatcacgaacggaacgagctgcgcgacgaccagcagcggcgtgacgtacagcacctgcacgccgatcggcatccacagcacgcgacggtggatcgtgatcgcgccgtacgacagcagcgtataggcgagcgcatgctcgccgagcagccccgcgtcatgcacgtccatcaggatgccgagcgcgaacgcgacgcccatcccgaccttgcgcggctgatggatgttccagaacagcagcacgagcgcgacgaagtcgggcacgccgggcaggcggccccacggcatcaggttcagcaggaacgcggcggcgaggctgaagacgatgaagtacggattgaccggttgcaggatgtattgcgggcgattcatcgctgggctcctggttgcccggccgcgggcttcgcgggcgcggcggcgggcttggccgcaggcgcggcaggcgccggcttggcgccgggctgggccgcggcggccggcttcgcgccggcgtcggccttctcgcctttcgcggcggctttcgcgcctttcttgcccttcgcgttcttgtcggcggccggatcgggctcggccgggcgcggcgggatgtcgttctggtaatgcagcacgagcatctggcgcgcgccgcgcacggcggcgatcggcgcgcaggtcacgcgcgcgaatgcggtatcggcgagcttgtcgacgcgtacgaccttcgcgaccggcaggccgggcggatagacgccgtcgaggccgctcgtgacgagctcgtcgccgacgacgagatccgcgctcgtcggcacgaagcgcaggtcgagcgaatcgcccttcggcgtgccgtagatcacgctgcgcaggccggtgcgcagcacctgcacgggaatcgcgagatcgcggtcggtgaccagcgtgacttcggactgcagcgggaacacgcgcgtgacctggccgaccacgccgttctcgctgacgacgggcgcgccgttctggatgccctgctgcgaaccctggccgatcacgatcttctgcgtgaacggatcgctcgtgtcgtactggatctcggccggtgtcgattgcgtcgcgatgtgctggcgcagctcgagcacggcgcgcaggtgcgcgttctcctgcgcgagcacggcggcctggttggcctgcgtggacagctgcaggttgcgcttgcggagatcgtcgttgtcgtggcgcagcgacgcgccggtgacggcgatgtcggccgcgcccatgaacaggtcgcgcggcacgagcgcggcgcgctgcagcggatagagcacggtgccgagcacgccgcggacgatttcgagcgtgttgaagcgcgcgtccgacaccagcagtgcgatcgcgacggcgacgaaaagatgagccgcgcgagcgcgggcgggccttgcttgaagaggggcggcggactgtattccatggtcggcgccgggcgcgaatgatcggttaaatgaagctcagacgcgcaaacggcgcggcggttcgttctgaatgagcgagccggccacgccgcgggtgcgtcatgtcaggaagactgcctagacgatcactcgtacgagaagatgctgcccagcttgtccatgcgctcgagcgccatgcccgaaccgcgcacgacgcaggtgagcggatcttccgcgacgagcaccggcaggccggtttcttccgcgagcaggcgatcgaggtcgcgcagcagcgcgccgccgcccgtcagcatcatcccgcgttcggcgatgtcggcgccgagttccggcggcgtctgttcgagcgcgatcttcaccgacgacacgatctggttcagcggatcggtcagcgcttcgaggatttcgttgctggagatcgtgaagctgcgcggaatgccttccgacaggttgcggcccttcacttccatttccttgacttcggagcccgggaacgcggagccgatttccttcttgatcgcctcggcggtctgctcgccgatcagcatcccgtagttgcggcggatgtagttgacgatcgcttcgtcgaacttgtcgccgccgacgcgcaccgagcctttatagacgatgccgccgagcgagatcacgccgacttcggtcgtgccgccgccgatgtcgacgaccatcgagccggtggcttccgacaccggcaggcctgcgccgatcgcggccgccatcggctcctcgatcaggtagacctgcgatgcgccggcgccgtgcgcggcttccttgatcgcgcggcgctcgacctgggtcgagccgcacggcacgcagatgatgatgcgcggcgacggcgagaacatgcgcgactcgtgggccgtcttgatgaactgcttgatcatctgctcggtgacggtgaagtcggcgatcacgccgtccttcatcgggcggatcgcctcgatgttgcccggtaccttgccgagcatctgcttggcttccttgccgactgcctggatcgtcttcttgccgttggggccgccttcctggcggatcgacacgacggacggctcatcgagcacgatgcccttgccgcgcatgtagatcagggtgtttgcggtgccgaggtcgatcgcgagatcgttggagaagtagctgcgcaaaaaccgaacattcagaatcctgtttcgctctgggccggccctgcatagcgagcgctgagggcggcagcggaaaaataacagcctcgggaagcgtggcggaagcggcgccgcggcgcacgaagctgcgagtgatgtctaccggggatcgcacgaagcacgcacggcttgccgaagcggggcgaaacggtgcgggaaaaggctgccgggtttgggtcgaacgcgtaatgataccttataatttcacggtatttgaatcgaaacgggcggtatttttgccgcttcggccccgatttttgagggtgagatcgcaccctccaacccccgccgcagtgctgctttcgatgcattgcgcagtcttgtttttccggtgatcgcatggccctgaccctgaccgatgtgaaacgcatcgcgcacctggcgcgactcgaaatggccgacgccgacgccgagcacatgctcggccagctcaatgatctcttcggcctcgtcgagcagatgcaggcggtcgacaccgccggcatcgcgccgctcgcccacccgatcgaacagatccaggaagtcgcgcagcgcctgcgcgacgacgccgtgacggaagtcgtcaatcgcgacgacaaccagcgtccggcgccggccgtccaggacggcctctatctcgtgccgaaggtgatcgagtaagcattcgacgacaagcgcgccggccagcgccgcgcgccacccagaattcccaggaaaaccactcaatgcacgcaaaagcctgaccgaactgcgcgccgcgctcgccgccaaggaatgctcggccgtcgagctcgcgcagctctacctgaaacggatcgacgccgcgcgcgacctgaacgcgttcgtccacgtcgatgccgacctgaccctcgcgcaggcgaaagctgccgacgcggagctcgcgcgcggcgcgggcggcgcgctcaccggcctgccgatcgcgcacaaggacgtgttcgtcacgcgcggctggcactcgaccgccggctcgaagatgctcgcgaactacgcgagcccgttcgacgcgaccgtcgtcgcccgcctgcaggcggccggcatggtcacgctcggcaagaccaacatggacgagttcgcgatgggctcgtcgaacgagaactcggcgttcggcgcggtgaagaacccgtgggacacgaacgcggtgccgggcggcagctcgggcggcagctcggccgccgtcgccgcgcgcctcgcgccggcggcaaccggcaccgacaccggcggctcgatccgccagcccgcgtcgttcgcgggcgtgacgggcatcaagccgacctacggccgcgtgtcgcgctacgggatgatcgcgttcgcgtcgtcgctcgaccagggcggcccgatggcgcagagcgcgtccgactgcgcgctgctgctgaacgcgatggccggcttcgacgagcgcgactcgacgagcctcgatcgcgacgatgaagacttcacgcgccacctcggccagccgtgggcggccggcaacgatgcgggcaagccgctcgcgggcctgcgcatcggcctgccgaacgagtatttcggcgacggcctagccgacgacgtacgcgcgacgatcgacgcggcactgaagcagtatgaagcgctcggcgcgacgctcgtgcccgtgtcgctgccgaagacggagctgtcgatccccgtgtattacgtgatcgcgccggccgaggcatcgtcgaacctgtcgcgtttcgacggcgtgcgtttcggccaccgcgccgcgcaatacggcgacctgctcgacatgtacaagaagtcgcgcgcggaaggcttcggccccgaggtgaagcgccggatcctggtcggcacgtacgtgctgtcgcacggctactacgacgcgtactacctgcaggcgcagaagatccgccgcatcatcgcgaacgatttccaggaagcgttcaagacctgcgacgtgatcatgggcccggcctcgccgacggtcgcatgggatctcggttcgaagggcgacgatccggtgcagatgtatctcgcggatatctacacgctgtcggtgagcctcgcgggcctgcccggcatgagcgtgccgtgcggcttcggcgcgggcgcgaacgcgaagcgcccggtcggcctgcagatcatcggcaactatttcaacgaagcccggatgctgcaggtcgccgacgcgttccagcgcgcgaccgactggcacaagcaagttccggcaggggtgtaagcacatggctactcaatgggaagtcgttatcggtctcgagacgcacgcgcaactgtcgaccgtctcgaagattttctcgggcgcgtcgacgcagttcggcgccgagccgaacacgcaggcgtgcccggtcgacctggcgctaccgggcgtgctgccggtgctgaaccgcggtgcggtcgagcgggcaatccgcttcggcctcgcgatcggctcgaccatcgcgccgcgcagcatcttcgcgcgcaagaattatttctacccggatctgccgaagggctatcagatcagccagtacgagattccggtcgtgcagggcggccagatcacgatccaggtgcccgccaacgaaaaggccggcaaggaagcgtacgagaagacggtcaacctgacccgcgcgcacctcgaggaagacgcgggcaagtcgctgcatgaagacttcgccgggatgaccgggatcgacctgaaccgcgcaggcacgccgctgctcgagatcgtcaccgagccggaaatgcgcagcgcggccgaggccgtggcctatgcgaaggcgttgcacgggctcgtcgtgtggctcggcatctgcgacggcaacatgcaggaaggctcgttccgctgcgacgcgaacgtgtcggtgcgaccggtcggccaggagaagttcggcacgcgcgcggaaatcaagaacctgaactcgttccggttcctcgaggaagcgatcaactacgaagtgcgtcgccagatcgagctgatcgaggacggcggcgaagtcgtgcaggaaacgcgcctctacgatccggacaagcgtgagacgcgctcgatgcgcagcaaggaagacgcgcacgactaccgctacttccccgaccccgacctgatgccgctcgtgatcggccaggactggatcgagcgcgtgcagtccgggatgcccgagctgccggccgcgatgcagcagcgcttcgccgagcagtacggcgtgtctgcgtacgacgcgggcgtgctgacgtcgagcaaggcgatggccgcgtatttcgaatcggtggtcgcgaaggccggcgccgcgaacgcgaagatcgccgcgaactggctgatgggcgacgtgtcgtcgcagctgaaccgcgacggcatcgagatcgacgcgatccccgtgtcggccgcgcagctcgcgctgctgttgcagcgcatcgccgacggcacgatctcgaacaagatcgcgaaggaaatcttcgcgacgatctgggacgagaagccggacgacgaaggtgcggccgaccgcatcatcgacgcgaagggcctgaagcagatctccgacaccggcgcgctggaagcgatcatcgacgaagtgctcgcggcgaacgcgaagtcggtcgaggaattccgcgcgggcaaggaaaaggcgttcaacgcgctgatcggccaggcgatgaaggcgaccaagggcaaggccaatccgcagcaggtcaacgaactgctgaagaagaagctcggctgagcatgagcgcgcgcctgaaccgcgcttgacgacgggccgccccgaaccagttcggggcggcccgttgcgtttggcggatgcgttatcgtatgcgtcacaccgtccaacggaggaacgaatggcgaaacaaccgtcgctcgacgatttccgcgtgccttatttcacgcgcgagaaggaagccgccgcattcaagctcgatgcgttcgacccggccgcgaagccgttttcgtccggctcgaaggatgacgaccgcgaacggctgtcggtcgtgtcgaccgaactcgacgtgcagcaggagcgcctgcacacgcagcagaagaagcgcgtgctgctcgtgctgcaggggatggacaccagcggcaaggacggcaccgtgcgcgcggtgttccgcgaggtcgatccgctcggcctgcgcgtcgtgtcgttcaaggcgccgacgccgatcgaggccgcgcacgacttcctgtggcgcgtgcatgcgcaggtggcggccgcgggcgagctcgcgatcttcaaccgcagccattatgaagacgtgctcgtgccgcgcgtgctcgatctgatcgacgcgaaggaatgcgagcgccgctaccggcagatccgcgatttcgagacgatgctggtcgagaacggcacgacgatcatcaagtgcttcctgcacatctcgaaggacgagcagcgcgagcggttgcaggcgcgcatcgacgatccgaccaagcactggaagttcgacatctccgatctcgacgcgcgcaagcactgggacgcgtaccagtccgcgtaccgcgacgcgctcgccgcgacgtccgccgagcatgcgccgtggtacgtgatcccggccaactcgaagacgcaccgcaacgtgatgatcgccgagctgctgctgcgcacgatgactgacatgaagctggaattcccgccgccgaagcccgagctcgaaggcgtgaagatccgttaagctgccaccctgtaaaacatcgaactgaacggaatccgacatgatgcgagtgattaccgccaacctgaacggcatccgctccgccgcgaagaagggcttcttcgagtggctcggcgaacagaacgccgattgcgtgtgcgtgcaggaaatcaaggtctcggccgacgacctgccggccgaattcgtcgagccgcacggcttcaagagctattttcaccacgccgagaagaagggctacagcggcgcgggcgtgtacagccgccgcgagcccgacgacgtgatcatcggcttcggcagcagcgaattcgatgccgagggtcgttatgtcgaggcgcgctacggcaagctgtcggtcgtgtcggtgtacgtgccgtccggctcgagcggcgaagagcgccagcaggcgaagtaccgcttcatggacgagttcatgccgcaccttgcccagctcaagaagaagcgcgaggtgattctgtgcggcgacgtgaacatcgtccacaaggaaatcgacatcaagaactggaagagcaaccagaagaactcgggctgcctgccggaagagcgcgagtggctcacgaagctgttcgacgatgtcggctacgtcgacgtgttccgcacgctcgacccgcgcgccgagcagtacacgtggtggagcaaccgcggccaggcgtatgcgaagaacgtcgggtggcggatcgattaccagatcgcgacgccgggcgtcgccggcaccgcgaaaagcacgtcgatcttcaaggacatcaagttcagcgaccacgcgccgctgacggtggactacgactacaagaagtgattgccggcgccgcgccgcgcgcgtagcgcccgaacccgccggtcgccggatgcagaacgggccgcatgtcgaacatgcggcccgtttcatttggggcggcgatcgtgcgggccgcccggcggtggcgcttactgcttgatcgatgccatgtcgatcacgaaccggtacttcacgtcgctcttcagcatccgctcgtaagcggcgttgatctgctgcatcggaatcgtctcgatatccgacgtgatcccgtgctccgcgcagaagtcgagcatttcctgcgtttccgcgatcccgccgatcagcgagcccgcgaggcggcggcgcttgaagatcaggttgaacacctgcggcgacggatggtcgtgctccggcgcgccgacgagcgtcatcgtgccgtcgcgcttcagcaggtgcaggaacgggttcaggtcgtgctgcgcggcgaccgtgttcaggatgaagtcgaagctgttcaggtgcgcgttcatctgcgcttcgtccttcgagatcacgacttcgtgcgcgccgacgcgcttgccgtcctcgatcttcgacggcgacgtcgtgaacagcacgacgtgcgcgcccatcgcgcgcgccagcttcacgcccatgtggccgaggccgccgagcccgacgatgccgaccttcttgccggggccgacgttccactgccgcagcggcgagtaggtcgtgatccccgcgcacaggagcggcgcggcgccggccgggtcgagcgtctcgggcacgcgcagcacgaacgcctcgtcgacgacgagctgcgtcgagtagccgccgtacgtgacgtcgcccgtcacgcggtcctggccgttgtaggtgccgacgaagccgttctcgcaatactgctcgagcccgtcggcgcagctcgggcaggtgcggcacgaatcgacgagacagccgacgccgaccagctcgccgaccttgaagcgcgatacctgcgggccggtcgcggtcacgcggccgacgatttcatggcccggcacgaccgggtagatcgtgttgcgccattcgttgcgcgcctggtgcaggtccgagtggcagacgccgcagtagaggacgtcgatctggacgtcgaggtcgcgcagcgcgcgacgctggaattcgaacggggcgagcggcgactgcgaatcggttgccgcgtaagcgtaggtggtgctcatgcaggggctccttggccgggaaaacatccggcgaaacgaactgccgtcgcaccctatggcgatgcggcgaggcaggacgtcatcgtaaggagcgcggcgccgcgatgaaatacacgaaggtctggaagatttgcctattcctctcgaactgcgtgcaaacggccgccaaaacgcattcaagatgctacattgcgagccagattctcttgccggacaggatgacgcagatgagcttcgagccccttttcgccgacacgggcgaccgcgtgcagcgccgcatggtcgagctgcacacgcgcctcgcgccgaacgagggcgacacgctcgcggcgctcgacggcgtgcgtttgattcgcgtgagccgtccggggccgcgcatgcccgtgctgtacgagccgagcatcatcgtcgtgtgccaggggcgcaagctcggttatctcggcgaccgctcgttcgtgtacgacgcgcagcaatacctggtgctgtcggtgccgctgccgttcgaatgcgagaccttcgcgagcgcggaggagccgtttctcgcgatctcgatccgcgtcgatctcgcggtgatcgccgaactcgcgatcctgctcgacgagacgctcggcgcggccgcgagcgaaccgctcggcgtctattcgacgccgctcgacgcaccgctggccgatgcggtcgtgcggctgctcgaagcgctggcttcgccgcacgacacgcgcgtgctgggccccgcgatcatgcgcgagatcgcgtatcgcgtgctgacgggcgcgcagggcgacgcgatccgcgcggcgctcgtgcagcagcatcacttcggccgcatcgcgaaggcgttgcggcgcatccatgcggagctgagggccgacctcgatgtcgagaccctggcgcgcgaggccgggatgagcctcgcggtgttccacgcgcacttcaagcacgtgacggcgacgtcgccgatgcagtacgtgaaggccgcgcgcctgcatcaggcgcggctgatgatggtgcaggacggcgtcggcgccggtacggcggccgcgcgtgtcggttatgcgagcgcgtcgcagttcagccgcgagttcaagcggctgttcggccgcagccccggtgacgaagtgcgctggatgcgtgaaatcgggattcgcccggtcgtggccgatacggacgcgtagcgtccggcgtcagccggtggcgccgcgccgcacgaccttgcgccgctgcgcgctgatgcccgcgtagtcgggcagtgagtcgacccgcttgccgatcgccttcgcgtacagcggcatcaggtccggcagccggttcagcagatcctggcgccgcgcggtgccgtacgggtgcgtgtagatgaagcccgtggccttgttcgcgcgcgtcgcggccgcgagcttgtcccacagtgtgatcgccgcgcgcggatcgaagcccgcgcgggcggcgatgtcgccgccgatcacgtcggcttcggtctcgtcggtcgggtcgtagtggagcgactgcaggcgctcgccgaggttcagcgcctgcggcagcggatcgccgacgccgaacagcggcggcagcgcggcggcgcgcagcgaagtttgagatgccgcgctgaagttgctgcgcgcatgttcgcgcagcgcgtgcgcgatgccgtgcgcggccagcacgccgagttcgtcgtcgttcagccggaggcgctcgagcaggccgccgtacacgagcaccttgccgcccggcaggcaggtcaggcggatgtcgcgcgagcggatcacgttcacgtcccacgcccagttcttcacgcgatcgttccacttcaccgaatacggcgcgagcttcgcgacgatcgcgcgcaggcgcttcacgcgcggctggtttgccggcagcaggcggttgctgtcggcggccgcctgcacgatctgcgcgtattcgctcgcggtgagctgctcgagcagcggcgacgggatcagcgtgcggaatgcgatcgcattgccgtagcgaacctgctgcggtgtcggcgtataagccttcgtcgacgcggcggcgccggtcggctgcgcgggttcggcggtggccggctgggcgggggcggcggaagtcgacgttgccggcggtgaagccggtgcggcggccggcgcggagcccgcggcggttgcagcggtcgcgccggtgtcggacgcatgggcggcgaacccggcggcgagcgccgcggcaccgacgctccacgaagccgcaacgcgcgcgaggcggtgcaggcggttactgcgcacggctggcctcgccgttgcgtgcggcgccgttccacggcgcgatcctgaacagcagcagcatgccgggaatcgcgagcgcggtgcacacgatgaagtagtcgaaccagccgatcttcgcgacgatgaagccgctcgcggccgacgcgagcgtgcgcggtaccgacgcgaggctcgtgaacagcgcgaactgcgtggccgtatagcgcgggtcggtcgtgctcgcgatgtacgcgacgaacgcggccatcgtcaggccggtcgtgaaggtttcgaagccgtagacgagcgcgagcgcgacggtcatcgggctcagatgcggcgtgacctcgaagccgaagatcgacaggaacgacgcgagcgcatggctggccgcgaccgtgaagtcgtagagcgccgcgagcaccggcgagccggggccgacctgcgcgagccacgcgaagccgagcgtcgacaccatctgcagcgcgccgaagacccacagcccgcggccgatgccgatcttcacgagccagacgccgccgatgatgccgccggcgacgctcgcgacgagcgcggtggttttcgcgacgatgccgatctcggtgcgcgagaagccgatgtcgaggaagaacgacgtcgacagcgtggtggccatcgtgtcgccgatcttgaacaggaagatgaatgcgatgacgagcagcgcgccggcccagccgtcgcgctggatgaattcgcggaacggcagcacgatcgcgtcgcgcaggttgcgcggcggcgcgccgaccacttcgggctcgcgcaccagcagcgtcatcaggatgcccggcagcatgaacgcaccggtgagcgcgaacacggcgtcccacggcatgtgatcggacaggatcagcgcgagcgaaccgggaatcagcgcggcgagtttgtacgcgttcacgtgcaccgcgttgccgaggccctgctcggtgtcgcgcagcagctcgcggcggtatgcgtcgatcacgatgtcggaactcgcaccgaagaacgcgacgagcgtggtgagtgcggcgaccgtccagatcgaatcgcgcggcgacacgaagccgagcgcggcgatcgcgcccgcgaccagcacctgcgtgagcagcatccagccgcgccggcggcccggccgccagccgggcaggcgcgggatgtagcggtccatcagcggcgcccacaggaacttccacgtatacgggaactggatcagcgcgaacaggccgatttccttcaggttcacgccttccgagcgcagccaagcctgcacgaggtagacgagcgtgaacaggggcaggcccgacgtgaagcccaggaacacgcagatcagcatgtgcgtgttcagataggctcgccagccggggtgatcctcgtgagcggtgagtgcgggcgcctcgtgtggcgatttcgacatggacagaaactgggtagcgttgactgattgcggcggcagcgcaggcggcggtgcgagcgacgcgagagggcggccgcacgctcgtgcgggccggatcttccgtcaacggcccccggctcagctgcgcttgacgcggtagacagcaagactaccacgccagttcgctccccatcgaatcggctggccttcgtgcagcacgacgcggtcgaggatcgtgacgccgacttccggcgcgagcgcctcgaaatccttgatcgtcagcacccggacgttcggcgtgttgtgccactggtagggcagcgatttcgacacgggcatccggccgtgcagcaccgacagccggtgcgaccagtagccgaagttcgggaacgacacgatgcactcgcggccgacgcgcgccgtttcgcgcaggatcgcggcggtctggtggatcgtctgcagggtttgcgacaggatcgcgatgtcgaagctgtggtcttcgaacagccgcaggccgtcctcgagattctgctggatcacgttgatgccgttcttcgcgctcgcgagcacgcccgcgtcgttcagttcgatgccgtaaccggtgacgtccagttcttccatcaacagcgcgagcagcgagccgtcgccgcagccgaggtcgagcacggtcgagcgcggctcgacccagcgggcgatcgtgcggaagtccgcgcgcgcggacagggaattcagtgcttgctggttcatgcccccacctcgatggcgattcgttcgtaatacgcgcggagcaggttgtgataacgcgcgtcgtcgagcaggaacgcgtcgtggccgtgcggcgcgtcgatttccgcgtagctgaccgtgcgcttgttgtcgagcagcgctttcacgatctcgcgcgaacgcgccggcgcgaagcgccagtcggtcgagaagctcgcgatcaggtatttcgcctgcgtgtgcgcgagcgcggccgtcaggttgccgtcgaacgccttcgccgggtcgaagtagtcgagcgcgcgcgtgatcagcaggtaggtgttcgcgtcgaagtagtcggcgaacttgtcgccctggtagcgcaggtacgactcgacctcgaactcgacgtcgaagctgaagttgtacgcgtcgagcgccccgtccgcgcggcgcagcgcacggccgaatttctcggccatgtcgtcgtcggacaggtacgtgatgtggccgatcatccgcgcgacgcgcaggccgcgcttcggcttcacgccgtgcgcgtaatagtcgccgccgtggaagtcggggtcggacaggatcgccgaacgcgcgacctcgttgaacgcgatgttctgcgcggacagcttcggcgtcgacgcgatgtcgatacagtgcgcgacgcgctccggatacatcaggctccacgccagcgcctgcatcccgccgaggctgccgcccatcaccgcggcgaagcgttcgatgccgaacgcgtcggcgacgcgcgcctgcgcgtgcacccagtcctcgacggtgaccaccgggaagcgtgcaccgtacggcgtgccggtcgacggatcgacgctcatcgggccggtcgagccgaaacacgagccgaggttgttcacgccgatcacgaagaagcggttggtgtcgagcggcttgcccgggccgaccatgttgtcccaccagccggtgctgcgcggatcgtccgcgtagacgccggcgacgtgatgcgacgcgttgagcgcgtggcagacgagcaccgcgttcgagcgcgcggcgttgagctcgccgtacgtctcgacgacgagctgatagttgccgatcacgctgccgctttgcaagcgcagcggttcggcgaagtgcatggtctgtggagcgacgatgccgatcgattccattcgttccgccttatgccatatgactgggcggctaaatggtgtcggcggggcgcggagtcgaaggtgcgcggctgacgacctctttagccgcatttgtagtgaaccgccggggagcgacgcgcgacgcatcaaggccccggccggttcgcgcgcccgcaatcgagtcagcaaatcggcgcgcttccgacctgccgccagggaggcggcaagtcggacgagtatagcggaaattgcgggacccggattcgggaggtgcgcggggtggccggcggcccggccctgcggatccgctggcccggccggaaccgcctgcgcgggagcaggcggcgcaggccgcgccccgtcaccagtggtacttcgccgccagctcgcccttgaccaccgcatagtcggacaggttcgcctccaccccgaggcccgccgatatcgcgaagcgcttcgacacctggcctcgcgcgccgatccggaacgccgcgcggtcgcgcgggacgctgaacgagaaagcattgcggtcgagcgtcagcgtgcgcgagccggggccgtgccaccagttcgcctcgatgaacgggcgcaactcacggccgtgcgacatcgcggtcacgccgtgcacgcgtacgcccaggcgggtgagcacatcggtggcgccttggccgtcgaggcggccgccggcggtgccgtgcgcgtccgcgcgatagtcggacacgacgagctgcgcttcgggctcgacgaagaaccgcgtgtcgccccgctcgtagaacccgagtgaatagccggtctcgatcgaaccggtcacggtgcgcgaccgatacgaatcggccgcgaggctgccgccgacgctgttcgcgtaggcgccgtacatgaaccacgcatcgacgtaagggccggtcaggatgtcgcggctgccgtaccacgtgccgtacacgccgacgttgtagccggccacgctgccgcgcgcggtggcgttcgtgacgcgccctcgatcgggttccacagcgggcgtgtcgaccagttcgactggctgccgtacatgcccatcgcgccgatgcgcacgctgccgccgcggccgtcgtcgaagcggagcaggtcggcgcccgcgtgaatcaggcggccgttgcccgacacgctgcggttgccgcccgacatcgacgtcatctggccctcggcgcgcagccacacggcgccgtccagcgggccggttgcctcggcgcgtagcgaacgatcgtcacgctgatgcagcgaatgaatcgccatcgtcgctgcggcgtctgcgtttgccagatacgcgtcgggttccggtgcggcggcgcgcggaggagggggacgacttccggcacgatcggcggatcgggctggaccggcggcagtggctttgccgcggagacgagataccagtcttccgcctgcccgccgtcgccgccacgtttgagcatgtaatcgtagccgcctgccgacaacgtaccgaagccgttccggtagccgtccgatgccgcatcgagcgtgaatgccgatgcatcggtcgtgccgccgttgcgggtttcgacgagcgggatgccgacggtcgtcgccgcgccgtcgccgcccgcgcgcttcacgacgatgccggtatcgcccgatgcgtggccgccgtcgatcacgaggcggtcgctgggcgacgcgtcgtcctgcagcgtcgtatggaggacgagcttgccgttgcgggccgcatagtcgcccgtcaccacgagcgtgcgcggtgtcggcgcgcctcgggccgccggcgcgtcgaatgcgatcgtcgaatcgttcagcgcgacggagccgaccgacgaatccgcggtgacggtccagagactgttcgtgtccagcgacagcgtgcgaaccgcgtcggtcgcgcccgtccacgcggacgcgttcgtgagcgcgacgtccgtcaccgcctgcgtcggactgccgtcgtcggtcgggtggttgacgatgtcgcctgcggcatgggagcgctcgtcgagcgtcaggcgtaccggcgcacccgactcggcatggacggacagcagcttgccgttgccgccgatcgcgcgcgtgccgtttttcagcgtgaccgtcgcatcggatgcgtcgatcgcgccatggcgctcgctgacgagcgtgccgtcgtcgatcgtcagcgtgccgccatggacggccgccccatacgcgtcggcgccggtcgtgcgggcgtcgctgcgcagcagatcgaccgtgccgccgacactcgcgtgcaacgcggtggcttcggcgccgtgcgtctcgacgctcgtctcggtgagcgaggcgacggagcctgcgccggccgacagcacgccgcgcgcgcgttcgccgctcgtcacgatgccgccgcgtgtcatcgcgaccttgccgccgagccgggcgatggcgccgatcgagcgcgtaccggttgtggtgacgtacgtatcggtcgcttgtgcgacgggcgcgttcgcaaattccttcgaggcatacaggccatgggcgctctcgccgtgcgtgagcacgttcgagcgggcgagttcgacacggccttcgcgggcatccacgccgagcgcggcatagccgctcgtttgcaggagcgagtcgctgaacgtgacggtggatgtgcccggtttggacagcgccgacgcgtagtcgccgattgtcatgatgtcgactcgatcgaaggccgcacgcacgtcgccgtgactcacgaacacgccgaaagagaattcgccgccggtgatgatcttcgtatcggcgacgctcacggaggcgcccggcgcatagtgcacggcgacgccatgcgcttcacggccgcgtgtggcaatcaggctgtcggagagatcgatgtggctgtcggcgccgtcgacataggcgccgtgggcactgtcattgtccgtatcgatggaaagctgtcgcgccaccacgctgcctccctggcgcgcatcgattcccgtgccgaatatgccgcgcgtgcggatttcggcgttgttcaattcgatatatgagcgggccccttcggcgattgcgccgcttgaaccgtggccgaacgtgaacaggcgcgtcttgccgccggtagtgagcgtgccgccgttgagtgcggccaatgctggagcgccatggctgaacgtcgaatagtcgccgggcgcgacttcgagcgcggtgccgtccgcacgctggccgttaccgccgggagattgggcctgggacggcaatgacatcgccgtgccggcgagtatcgccgcgcgggcgaaatgcccaccgatgccaaatttgaagagcacatgcctgcatttcactggttcactccggttttgcttgaatgttcgagcgaaatgtatcttgtgagagagggtttggaaatttgacgagttcgaatttgcagaccgaattgttgccgtaccggcatcgcgaatgcccgattgcgccacgctgttcgtacccgtcatgtcgggtacgggccatgcactgaatggcgatggagacggtcaccgtgactgatccgattcatgtcgtgaatcggccgtgcgatgcggtcggggcgctggggcgtgatcgcaccgcgatcaactggtgcggcaaagcaggtgcgagtgttgtgtgttcccgagacagggtaagcaggagcaccgctgccggacatcaattgttatgtatctgtgacagcgggcgacaaaacatggcgtgacgcctgtcgatcgacgaactttcgtacatttacgatgaaatccgacgataaattaggacgacgatgggtgtgatgaacttgtgtttttcggaaaattcccagcgaaatgccgtcgccggcaacggggatgatcgatttgtcctgaaaaagcgacggaacatttcaactttaccttaaaccttataggcaattatcgacatgaaaaagcgtttgttccgatgctgctggccggtatttcagtcttgatgcttgcccccgccgcgcacgccgcggacggattggtcgagttcgatggcgtgctgacatcggcaacctgcacgatcaataacggcagcaaggatttcaccgtcacgctgccgccgatgtccacgaagacgctggccgcgccgggttcctgggccggtcgtcaggggttcaagctgtccctgaccgattgcacgccgtccacgggcatcgtgagtgcgtacctcgagcccggtccgacggtgaattcggccaccggcaatctgaagcctgacgccggcggggcgacgaaggtcgaagttgccctcctcaacagcagttacgacccgattgatgcatcgaagccgatcggtcagcagaacgtcgacaaggtcagccttgcttcgggcaaggccgacctgcagttctacgcacagtaccagtcgctcggcaacgccacggcgggtgcggtcaagtcgcgcgtgaactacacgatcacgtatcaataagcacgccgcgtaggcggccggtaatttcaccgccgccccttcgcgttctcgtatcaagccgtttcgtcgtcacgcgagacggcttctcaggaatgacgcgagtacatattaaataggaatgcgtatgaaaatttcgtggagaatcggattgtatgccgcgctgcttggcctgagcgcggctgcggcgatcgacagtgcacacgcgagcgtggtgatcgacaacacgcgcgtgattttccgcggcaccgagcgtgaaacgtcgatcaagatgacgaatgcaggtgaccggcccgcattcgttcaggtctggatcgacaagggtgaggttcaggcgtcgcctgagacgatcgacgtcccgttcacgttgacgccgaccatgttccgtctcgatgcaaagaaggggcagacggtccgcatgatctatacccgggaaccgcttgcgcaggacagggaaacgctgttctggctgaacgcgctcgaggtgccgccgaaagcgacggatgaggaagccggcgagaactacctgcaattcgccttccgtacccgcatcaaggtgatgtaccgaccgaaggggctgtccggcgatcctctggacgcacccgggaaggtgagatggtcggttatgcgaagcgaagggggcggcggttatgtgctgaaaggcgagaacccgacgccgtatttcgtcaatctcggtgaggtcacgctgaagtctggcggccacagctatagcgccggaaacggttacgtcccgccgttctcgtcccaaactttcccgatcgaaaggctggcacggcagccggatgccgacgccgaagtcgattacctgtccatcaacgactacggtgccggcgtgccgggcacgcacccgctcaagagcccggcgcaacgctgacccgcggccgcgcggcacgcatgccgcgccgtgcctgaccggccgcatcgacgcggccgtccttccctgaattgcctcccgacgtcgaaagacacaaccgcgccttcaacggagcattttgcccggtctccgggcgcaccgagtaatgaagtgcgtgacaccatgacgaagaccgtaaaacccgaagcgcagggtatcctgccacgcctgcggccgctttctgccgcggtgctgtcgatgttgtccacttatcaggtggtggccgctgaagtcgaatcgagcaatgcgcgattcatggtcgcgccgatcgagttcgaaaaggaatttctcgcgcctggcagcagcgcggcgaccaatctttcgcgcttcgaaaagggcgacacggtgctgcctggtacatacaacgtcgacgtttacgtcaacgaacgctgggtcggccgtatcgacgtcccgttcaaggagccggacggattgcgtggcagcaatgcgcgcgcctgctttgacaagtcactgctgcttcgcaccggcgtcgatctgacccggctcgcctccgcaaccgccgaggcgctggacgtgccgggcgcgtgcctgccgatagaacaggtcatcgacagcgcaaaggcagacttcgatttcggcacgcaacgtctcgatctgacgatccagcaaatgtcgctcagccgaaatccgcgtggttatgtcggccaggcgtactgggatagcggggtgaacgccgcatttctcggctacgacacgaatgtctatatgtacaacagccacggtgcggaaacgcaaacgcagggatatgtcgggctgagcgccggcatgaacctcggcccgtggcattttcggcatgacggttcatacaactggagttcgcagagcaaggggcaatatcaaagcctcaggattttcgtgcaacgcgatgtgccgcgcctgtcgtcccaactcacgcttggcgagtcgataccactggtgaactcttcgattcggttgcgttccgtggtgcccggctcgcaagcgacgaccggatgctgcccgactcgctgcgcggctacgcgccgaccgtacggggcgtggccaacagcaacgccagggtgacgatcaggcagaacggcgcgacgatttacgagacggtcgtcgcgcccggtgcattcgagatcaacgatctttatgcgacagggtacggcggcgacctcaaggtggacgttaccgaggcggacggccgcgtgcattccttcagcgtgccctatgccgcgctgccgttgtcgttgcggccaggcatcagccgttacagcatcacggcgggcacgcttcgcgatgcatcgctctccggcaatccgccgttcatccagggacctggcagcgcggtttcacgaatgcactgaccggatatgtcggtgcggcggccgccgagggttacgcgacagcgttggtgggcggcgtgctggccacgaaggtcggtgcgttcagcttcgactacacgcaatcgaacgcgctgattccgggatcgggccggatggtgggcggcagcatgcgaatcggttactcgaagaatcttccgcagaccggctcggacatttccatcgcagcctatcgctattcgaccggcggcttccttgacctggtcaatgccatgcagatgcgcgacgcaagcaagcgtggcctgactgcgggaggcaacgtggtgcgtccgcgcaaccgcgcacaggcgacgatcagtcagtcgctcggccagcgaggcggcgtcgtatcgctgacggcgtcgacggtgaattactggaatcgcgccggttccgatatcaactactcggtcggttacagcaatacgatccgcaacatcagcgtgaacctccaggcgacgcggcagcagatgcaattcggccggcagagcacgctttactacgcgagtctgacgattccgctcggccgtgatcgcccgctcaccatcagctcaagcgtgtcacgcgatacgagcggcagcacgcaggttcggacggccatgacgggttcgcttggcgcggatcgcaatctttcgtacggcgtgaacgtcaaccacgtttccggcaacgatcagggcagcacgtcgggcagtgcaaatgcgctgtatcacggccgcgtagccgatatttcggccagcgcgggcaccggaaagggtattcgcaaggctcgctcggcgtgcgcggcgcattggttgcgcatccgggcgggatcacgctgtcgcagccggtttctgaaacattcgggatcgtcgaggcaaagaatgcccaggggcgcgcgtcctcaattcatcgggtttgcgagtggatggccgtggctacgcgatcgtgccttacctgacaccctatagcgtcaattcggtcgatatcgatccgaaggggctgtccaccgatgtcgaattgaaatccaccagtcagcagatcgctccccgcaggggcgatcgtgatgctgaagtatgaaaccgaaatgggccgctcggcggtgatccacaccacgcggtcgaacggcaagccgttaccgttcggtgcagatgtgatcgacgtacacggcaagcgtgtcggcatagtcgggcaggccagcaagatattcgcccgggggctggaggatcgcggcgaactctcggtcagatggggcgaggcgcccgacgcgcggtgccgcatcacatatgacctgccggtgcgtgaaaaacattcgggatcggacagctaccagcgtgttgatgcgctttgtcgcagcgcagagccaccgaccgatggaacggatgctgcacccggcgagtaacacgcgtctacgcggacaacgtcgcaggcgccgcgcgctcgtcaagccgcgacgccagcaccgacggggcgctgactggaagagacacggctcgtcgcggaaagatcgcggcagtcgatgcccagcgaaagacattcaagttgatcgatagagaaattgcgatgaaaaatggaaatggattattgcgatggcgatgatgtcggggctgtcgggtctcgcgcacgcagccccttattgcttcaccatcaatccgactggtccattaaagacggcagagtacaatttcgacgccaataaaataccgccattcaatcccaatgtgccggatggcacgctgttactcggcataacgctagagtcggacaatgtcccgccgccgttttggattcgatgtgtgtaccctatatttagcctttcttattggcattctcctttgccggcatacggtgtcaatcagaagatgtttcaatcggggattgaaggcgttgcggtaaaaatagcgagcagtgggaagtttcttccgatagatagtcgggatgcgtattatccggaatatgagataggtgttggtggtggtaacaaagcgtccgtgatgctgcaattttacaaaatcggccccattacgggaaaaggcagattgtcgggcgagtttgcttttcactcggtgacctctctgacggacaaagtcgtcagctatcgatggtccggtgatttacagatcaaggcgccgacctgtaatgctgctgcggcgacgcaaaatgtggatctcggtacctattccacaaagaaattcaccgggatcggctcgacctcggatttgaagcctttcgcgatcaacttgatctgttccggtggtgacgagagcgtcgatgcgaagctctatatgactttgaccgacgtcacgtaccagtccaacacgtcgaatacgctgaatctctcgtccgattcgacggccaagggattgggcatccaggttttcaaggattcgacgctgctcagctacgggcccgactcgtcagtggcggggaacaagaatcagtggtatgccggcacgacaggtaacggcttcttctcgatcccgttgagcgcccgattcattcagacgtcgccgaccgttaccgcgggcaaggccaaggggcgaatgacgttcacgctcagttaccagtgaggcgtcgctggcggagggcggcccgatgtgtcgcacgctttgccgaccgcgcgtggcgacgatgaaccgttttgccgccgaccacgcttactgcaggatcagccgcaaatgcgcatcggcctgctcgccgggcggtttctggaacccgcctttcgcgaagcgatgccaccggccgatcacatagctgacgagcaggctcgcgcgggcggcgggatcgtagtcggcgggcagagcgaacggcgccgcgccgtcgggcgcttgcgcctcggtacgcgcgacccgcaggcactgcttgacggtcgcctcgatccggtcgagcaactggttcacgcgctcggtcaggcgctcgtcctcgccgaccagcgcctcgccggtcagcacgcgcgtcatgcccggattcttcgcggcgaaattgagcatcgtcagtgcgatcgtgcgcgcctgctgcacgccgttcggctccttcgcgacgatctggttgacgagcccgaacagcgcctgctcgatgaactcgatcagcccttcgtacatcttcgccttgctggggaagtgccggtacagcgcggcttccgacacgtcgagccgggccgcgagcgaggcggtcgtgatttttcgggtttcggcgcctcgagcatcgccgcgagggtctgcaggatcatcacgcggcgctcgcccggcttcgggcgcgggcgggcaggtgtggtccggccttcggttacggcttggtcctgcgggtaagtcggctgcatttttgtcgccccgatcgtgtgcccagtcggagcgattttagcgaacgaatgcgctggtcgacataaagtgggcgtccggtgcctggcaggtggccgggcaggtggccggtgatccacaccgtgccgatgccgaggcgcttgtagcgcttcaggtggccgagcgtatcctcgacgaggatcgcgtcggacgcacgggcacgcacggcgcgcagcgtacggcgcagcatcgtgtgatcgggcttcgcgcgccatgtgcggcggtcgcgcatgtgctcgatcgcgatcacgcgttcgaacagccgctcgatgcgcaattcgcgtagcaccgcgcgcgcatagttctcgggcgcattggtcagcacgaacttgcggcccggcagcgcggcgatgatgtgcgcgaggccgcgctcggcgcgcaccatcgcgggaagatcggcgaacgtgtggaccacgcgcaggaagtcgtgcggatcgatcggatggtggcgcgtgaggccgaggagcgcggcgccgtagcgctgcgtgtagccggtgcgcaggcggtcggcttcggcgcgctcgacctgcagcgcgtcgatgatgtactgcgtcatcgcgcggttgatctccggaaagatcgcgtgcgatgcgtggtgcagcgtgttgtcgagatcgaacagccagacgggcgagccggcgtgcggccggctgcgggagatgcgccggcgtcgcagcgacgccggcaggtcggggccggagggtttgcggcgcgcgctcaatgcgagcggatcatcgtgccgaacggctgctcggtcaggatttccagcagcaccgaatgttcgatccggccgtcgacgatgtgcaccgacttcacgccgctcttcgccgcgtcgagcgccgacgagatcttcggcagcatgccgcccgagatcgtgccgtcctcgaacagcgcgtcgatctcgcgcgcggacaggtcggtcagcaggttgccgtccttgtccatcacgccggggatgttggtcatcatcagcagcttctcggcgttcagcaccgtggcgagcttgcccgcgaccagatcggcattgatgttgtacgagaggccgtcctcgccgaagccgatcggcgagatcaccgggatgaacgcgtcgtcctgcagcgccttcacgaccgccgggttgatcgcctcgacttcgccgacctggccgatgtcgatgtactggcccgggttgtcgcggtccggcatcagcagcttgcgtgcgtggatcaggccgccgtccttgcccgtcaggcccactgcgtggccgccgaagtggttgatcagcatcacgatgtcctgctgcacttcgccgcccagcacccattcgacgacttccatcgtctcttcgtcggtgacgcgcatgccctggatgaaggtgccggccttgccgatcttcttcagcgcgtgatcgatctgcggaccgccgccgtggacgatcaccgggttgatgccgaccagtttcagcaggatcacgtcgcgcgcgaagccttgcttgagccgctcttccgtcatcgcgttgccgccgtatttgatgaccacggttttcccgtggtaacggcggatatacggcagcgcctcggcgaggatttctgctttcagcgtgggggcgatctgcgagaggtcgatgggctcggacatggcggcggctctggctgggaacggttgaaacacggcgaattgtacaggagtggcgcagcgcagcatcgggttttggacgggccggaacacgtgcggcgcggctcgggtacagcgcgcggcggcccgccggctatggcgcggcgcgatgcgggcggccattcgggcggcggtgtgcgcaacggtgcgcgggtagcggcgccgaggtggctcgcgagcgtttacgacggtcgtcggccggatggacggcgtgcaaaatccgttcgccgcgctatgcttgtcgcgtagggcggtttcacgcccgcttccgcgtttccgccatgaccgatcccgccgccgacgcccgttccgccccgcgccgcgcgcgttgcccgcactgcgggcgcagcttcgactgcggcgcccgctcgcagccgttcgaatgctggtgcgcgtcgatgccggtcttgcccggcagtacgccgccggctgccggcgcgcgctgccggtgccccgaatgcctggccgacgagatcgcgcagcggatggccggcgcggccggctgacggcaccggccgtgcacgcagcgcatcccgttcaccgcgttccgatccggccccgctagaggcgctgcccgctaaacgggtaaactgcccggatgcaacgaatcaccaccaccgggcgcgtcaacctcagtcacctgttctggctccgcaatctcgcgatcatcggccagctcgtgacgatcggcgtcgtgcagacctatttcggcgtgcatctgccgttgccggcgatgctgatggtcatcgcgctcgaaatcgttttcaacgcgctgacctgggtgcgcgtgctgcgcgcggcccgagaccaatttcgagctgctcggccagctatgggtcgacctcggcgcgttgtccgcgctgctgttcctgtcgggcggcacgaccaacccgttcgtgtcgctgtacctgccttcgctcgcgatcgcggcggccgtgctgccgtggcacctgatgatctggctcgcggcgttcgcggtcgcgtgctacgcggcgctcggcttcgactcggtgccgctcaacatggataacccggccaacctgttcgactactaccgtaccgggatgtgggcgaacttcatggtcagcgtcgggctgatcgcgtggttcgtcgcgcgcatgtcgaacgcgctgcgccagcgcgacgcggcgctcggcgaagcgcaggcgcacctgctgcgcgacgagcgggcggtcgcgctcggcgtgcaggccgccaccgtcgcgcacgagatgggtacgccgctgtcgacgatcgcgatgcttgccgaggaactgcgcgacgcggcgcgcgccgatccggggctggcccgctacgaagccgacctgaaggtgctcgaggagcagatgacgctctgcacgtcggcgctcgcgcgcctgcgcagccgcgcgagcgcacccgcgagccgccagccggtggacgactggctcgacacgttcgtcgagcactggcgcctgcggcatccgcacgtgcagttcgaactgctcggtgcgcgcccggcgggcgtcgcgctcgacgatacggtcgcggccggccagatcctgacgatcctgctcgacaacgccgcgcgcgcgagcccgcagcgcgtgacgctggccgcgaaggtcgcgcacgccggcgcggccgacgagatcgaattcgaggtgtgcgacgacgggcccggcattccggccgcgctgcgcgagtcgctcggcgcgatgccggtcgacagcacgcagggcgggcacggggtcggcctgtatctcgcgttcagcgcggccgcgcggctcggcggcgagatcgaactgtccgatgtcgtgccgcgcgcgcgggcggcaacgggcgggccggcggggcggcgaatggtcacgccgcggccggctcgggacagcgtgcgggccagcgcgcgtccgaacggacaaccggcacgccggacagccgtgcggccggcacatccgccgcgcgcggcacgcgggccgtgctgcgcctgccggcggtgcgcgtcgcggcgccggccgcctcaaccaacacgtagacggagaaaccacatgagcgagaacaatttcctggtgatcgacgacaacgaggtgttcgcgggcacgctcgcgcgcggcctcgagcgccgcggttacgcggtccagcaggcgcacgacaaggaggcggcgctgcggcttgccgcgggcggcaagttccagttcatcaccgtcgacctgcatctcggcgaggattcgggcctgagcctgatcgcgccgctgtgcgacctgcagcccgatgcgcgaatcctggtgctgaccggctacgcgagcatcgcgaccgccgtgcaggcggtgaaggaaggcgccgacaactatctcgcgaaacccgcgaacgtcgagtcgatcctggccgcgcttcagaccaacgcgaccgaagtgcaggccgacgaagcgctcgagaatccggtcgtgctgtcggtcgaccggctcgaatgggagcacatccagcgcgtgctggccgagaacaacaacaacatctcggcgacggcgcgcgcgctgaacatgcaccgccgcacgttgcagcgcaagctcgcgaagaagccggtgcggcagtaagcgggtacttgcgcccggcgcgtcagccgggcgagcccggggctcgcgacaggcaggcgacgatctcgcgtttcagcaggagcgtgagcagcgccgagtagcagacgttggcgagcagcggcgcgcatccgccgacgacgatggcgctggccagcggccacggcgttgccgatacagcacgcgcgacgaactggatgccgatgctgatcgccacgctggcgaatgcgatgcccgccagcgtgcccagccacgcgagtgcaaacgcgacgctgtagcgccgcagcgaatcccgcctgatccggcgcaggagcgacaggatgtcggcgcgcgtgagcgcgagcaaggccggcacgattcggccggcgacggacgggtagatggtcattcgaaggcggtgacgaatgcgtcggtacttggctggaggagtccggattatagggacgcaccagcgcgcttgccatcagccgcattccaggggcaggcacgggcgccgcatcgcctgaccatgaaaaacgggcgaccccgcaaggccgcccgtttttcgtcggacgccgcgcgcgttacagcacgtagcgcgacaggtcttcgtcctgcgacacttcgcccagcgcgcggtcgacatacttcgcgtcgatcgtcacgcgctcgccggcatggttgccggccgagaacgacacttcctcgagcagtttctcgatcaccgtgtacagccggcgcgcaccgatgttctcggtcttctcgttgaccgcatacgcgatctccgcgagacggcggatgccgtcgtcggcgaactcgagctgcacgtcttcggtcgcgagcagcgcctggtactgcttgacgaggctggcgtcggtggcgacgaggatcgcctcgaaatcgttcaccgacagcgagtcgagctcgacgcggatcgggaagcggccctgcagttcgggaatcaggtcgctcggtttcgcgaggtggaacgcgccgctcgcgatgaacaggatgtgatcggtcttcaccatcccgtacttcgtgttgaccgtcgtgccctcgacgagcggcagcaggtcgcgctgcacgccctggcgcgacacttcgccgccgctgccttcgttgttgcgcgacgtgatcttgtcgatctcgtcgaggaacacgatgccgttctgctcgacgttctgcacggccttcgtcttcacttcctcgtcgttcagcatcttcgccgcttcctcgtcggtcagcagcttcagcgcttccttgatcttcaccttgcgacgctgcttcttgccgctgccgaggttcgagaacatcgagcggatctgctcggtcatctcttccatccccggcggcgccatgatgtccatgccggccgacggctgctcgaggtcgagctcgacttccttgtcgtcgagctggccttcgcgcaggcgcttgcggaaggtctggcgcgtcgcgttgttgtcgtcgttcgcgtggtcggcattgccgccgaagcccaccgcgcgcggctgcggcagcaggatgtcgaggatgcggtcttccgcctggtcggtggccttgctgcgcaccttgcgcatctcggattcgcgcgtctgcttgaccgagatctcgatcaggtcgcgcacgatgctgtcgacgtcgcggccgacgtagccgacctcggtgaacttggtcgcttcgatcttgatgaacggcgcgtcggcgagcttcgcgaggcggcgtgcgatttcggtcttgccgacgcccgtcggcccgatcatcaggatgttcttcggcgtgatttcctggcgcagcgggtcggcgacctgctggcggcgccagcggttgcgcagcgcgaccgcaacggccttctttgccttggcctggccgatgatgtgcttgtcgagttccgagacgatctcggcaggggtcatggtgctcatggtgcggtccttactcgatcgtttcgatgatgcggttgtggttcgtgtagatgcacatgtcgccggcaatcttcagcgacttctcgacgatctcgcgcggcgacagctcggtgttctccgcgagcgcgcgggccgcggcctgcgcatatgcaccgcccgaaccgatcgcgcagatgccctcttccgggtcgagcacgtcgccgttgccggtgatcacgagcgtggtggtggcatcggccgtgatcagcatcgcctcgaggcggcgcagcatccggtcggtgcgccagtccttcgcgagctcgacggccgcgcgggtcaggttgccctggtgtttctcgagcttcgcctcgaagcggtcgagcagcgagaacgcatcggcggtgccgcccgcgaatccgaccagcacctggttgttgtagatccgccgcactttccgcgcgccacccttcatgacgatgttgccgagggttacctggccgtcgccgccgagcgcgaccttgtcgccgcgccggaccgaaacgatggtcgtgccgtgaaattgctccatctgcgttccttgagaaaaacggggaagagtcgggcggcgcgaggcgccgccgcgtaactcgcagtgcgccgggaagcggcccggcgcgcgtccgtttcattttagggcgggcgcggggatatcaagaggcgggaggcaaatcggaaaaccggccaaccgcgagccggtgccggaaaaacaaaagcgcgcggcaggccgcgcgctttcgaagcagcgtgtctgagcggaacgccgctcgatcagtcgccgaacagcttctggcgcaactcgcggcgctcctgcgcctcgagcgacagcgtggcggtcggacgggcgagcagccgcggaatgccgatcggctcgccggtttcctcgcaccagccgtaatcgccggaatcgatgcgggcgagcgactgctgaaccttcttgaggagcttgcgttcgcgatcgcgcgtgcgcagctcgagcgcgtgctcttcctcgatcgtcgcgcgatcggcgggatcggggacgatcaccgtctcgcgcaggttctcggtcgtctggcctgcattcttgaggatgtccgcctgcaactgttcgagccgatttttgaagaaggcgagctgatcctcattcatgtaatccttgtcgctcatcttcaggatttcggcttcggtcaagagtttcttcgtcatctgcttgcttcttcaatgtgcggcaaatcgagagatattgcctgcactttgggattacccgcaaccgcgcttgcaatcatttgcgatttgccgccgcggggccgaaagcctctggaaaaccggttctcaaataccaggataggcctggcgcggagttgcgcgcgctgcgaaccggtgtgctgcgcggcacatcgcatcggccgcggccgggaggcggattggcgatccggcgcggttgcgatgcccggaaaactggttcagcaagaaccgggcctgtttgttgccgtactccagcgggcacgtattgtaactgaatcgcaagcgggcgccgtatcgggtcgatccccgtcggctgcgccaatatctagaaaatataacgcgcaaatcgcgaaaaagcgatgacggcgaaaccctgcccgaaacgggcgcccgcggccgccgcagccgcccgcggggcggccgcgcggcggcgtgtgcggcggttgcccgcgcgcgtcaggcgagacaggcgtcgaggccgtcggtgatcaggtcctgcggcagatcgacgccgatgaacaccatcttgttcgtcttcttctcgatcggcagccacttcgcggcgaggtcgctgcccatcatctgatgcacgccctggaacacgaccttgcggtcgacgcccttcatgtacagcacgcccttgtagcgcagcatccgctcgccgtagatctgcaggatgccgccgaggaagtcttccagcttgttcgggtcgaacgggcggtcgttgcgatacacgaacgacttgatcttgtcgtcgtggtgcgcgtggtggtgatggtggtggccgtggtcgtgatcgtgcgcgcattgaccgtgatcgtggtcgcaattggcgtgatcgtgatcatggtcgtgatcgtggtgatgatgcgcgtgatcgtcctcggcgaggaagtcggggtcgatctcgagcttcgcgttcaggttgaagccgcgcaggtcgaagatttccttgatgtcggcttcgccgaagttcacgaccttgatcgcggccttcgggttcatgtgcatcaggcggtgcttcaggccggccacggtctggtcgtcgaccaggtccgacttcgtgatgaacagccggtcggcgaagccgacctggcgctgcacgacttcgtgctcgtcgagctgcgcgttcgcgtgcttcgcgtcgaccagcgtgatgaccgcgtcgagcaggaagtcgtcggcgatttcgctgtcgatgaagaaggtttgcgcgacggggcccgggttcgcaaggccggtggtttcgatcacgatgcggtcgaagtcgagcttgccttcgcgcttcttcgcggccaggtcgccgagcgcgcgggcgaggtcgccgcggatcgtgcagcagatgcagccgttgctcatctggatgatctgctcgttcgaatcctgcacgaggatttcgttgtcgatgttctcttcgccgaactcgttctcgatcacggcgatcttcatgccgtgctgttcgttcaggatgcgcttgagcagcgtcgtcttgccgctgccgaggaagccggtgaggatggtgacgggagtggccatgtcaatcgcctgtggttcgtgaatcggggtcaaaaccaggatgtgcgttgcgcccgctcgcgctgccagccggggcgcacaaccatccattgaaacatacctgtcaagcccccgcccgtcgtccgaacgacaggcgggaacgcgaatccgccgggcgcgaggccgcggccggcggaaggttacgcgcgtagatcggggcgatcagacgatttgcaacagcaggcccttcagatattcgccttccgggaatgccgcgagcagcgggtgatcgacgcccgcgccgagccgcttcaggatgcgcgcgtcgaccttcgcgtcggccgccgcgcccgcgacgatcttctggaacaggtccatgtcgatcgcgcccgagcacgagtacgtgaacagcaggccgcccggacgcagcagcttgaagccgctcaggttgatgtccttgtacgcgcgcgccgcgcgatcgacgctgtcgcgggtcggcgcaaacttcggcggatcgagcacgatcaggtcgaaacgctcgccttcgtcgacgaggcggcgcagcgtcttgaacgcgtcggcgtcgagccaggtcgcgcgttcggcgtcgaagccgttggcgacgacgttctgctgcgcgagcgcgagcgcatcgcccgacgagtcgatcgacacgacacgcttcgcgccgcccttgagcgccgcgagcgagaagccgccggtgtagcagaagcagttcagcacgtcgcgatcggccgcgtactgcgcaaccagcgcgcggttgtcgcgctggtcgacgtagaagcccgtcttgtggccgttcggcacgtcgacgtgatagcgcacgccgttttcgttcgagatcagcgtcgcgggcggcgcatcgccggccagcacgccggtcgtctgctcgagcccttccttgtcgcggatcgacacgtccgagcgctcgtacacgttcgggcagccggtcgcgccgacgagcgccttcacgatcgcgtccttccatgcttcgacgcccgcggccatgaactggcagacgagctggccgcgcggcgccgcgccggcttcggcggtgtccgcgacgtagtagtcgacgatcagccccggcagcccgtcggcttcgccgaacacgagccgcaccgcgcccgtgcccgacaccatcgtcgtgcggtgcgcaacggcgcgctgcacgcggcgcttgaagaacgcgtggtcgatcggctcgttctcgtcgaagctccacacgcgcacgcggatctgcgactgcgggctgtacgcgccgcgcgcgaggaagcggccgtcgtgcgcgcgcacgatcacggtcgcgccgggcgcgggtttgccgtcgacgcggtcgatcgcattggcgtagatccacggatggcggcgcagcagcgatttgtccttggacggcttgagggtgacggtttgcatgatgagatcgaaatgggccgtgcgcgaagccgaccgtggccggtcgccgcgcgcggcggataacacggacgcgcgtcagtcgcgcttcttcgcgcgcggatgcgcgctgtcgtaaatcttcgcgagatgctggaagtcgagcgacgtatagacctgcgtcgcggacacgctcgcgtggccgagcagttcctgcaccgcgcgcaggtcgccgctcgactgcagcacgtgcgtcgcgaacgagtggcgcagcacgtgcggatggacgttggcggggatgcccgcggcgagcgccgcgcgcttcacgcgctcgcgcacgacgcccggcgacatccggttgccgcgcacggacacgaacagcggatgcggatcgtgcttcacgaattcgccgcgcaccgcgagccatgcgttcagcgcatcgattgccttgcggccgaccggcaccttgcgctccttgttgcccttgccgcgcacggtgacttcggcttcggcgagatcgagccagccggccgagcggtagccgtcggcctgcgtgtacatgacgtcgagcccgatcagctccgcgaggcgcagccccgacgagtagaacagctcgaggatcgcgtgatcgcggatgctttcggtcgtgccggcgagcggtgcgtccatcagggccgatgcgtcgtcgaccgacagcgccttcggcaaggtcttcgggcgtttcggcgcgcgcaccgcggcgaccgggttcgcgggcatgtcgatgcgctgcgcgagccagcggtagaacgcgcgccacgcggacagccggtgcgcgatcgaccgtgcggacagcccgcccgcatgcgcgcgcgcgaccgcgccgcgcatgtcggcggccgtcagcacttcgagcggccggccggccgcaagcttcttcagttcgtcgagttcgtgcgtgtaggcgcgcagcgtgtgctccgacagctgcctaacgtgcttcaggttcgacaggtaggcggcgaccggatcgtctgtcatcgcgtgcggcaggctcagtgcggcagcaggcgcgtgagcgcggcgcttgcgagcgttgcgatctgcgcgaggaagtcggtggccatcccgtcgtggaagcgacgcgggtcgggcgaacccagtacgagcaggccgaacgcgggcgcatcggtgccggcgagcggcgcgcgcagcgcgagcagtgcgaccgatgcggcggagccgtcgccggccggcggcgcggcgtccgcgccttccgccgcattcgcagccggggcggcgaccgcgggcgcgagccactgcgcggcctcgaagcccgtgttcgcaccgcagtacggcgtcgacaggccgttcgtgaacaggcgcacttcctcgccgacctggcgcgcgaagtcggcctgcgaataggtgtcggcgacgtcccacacgcgcagtgccgtctgcggcacgtcgaatacgtcggcgatgccgtcggcgatcgtgcgcggcagcgcgtacggatcgcgttccgcgatcacgcgggcggtccagcggctgaacttcgcggacaggctgtcgttctcgtggccgtagcgcacgagttcggcgagccggcgctcgagatgcttgttcttgtcgcgcaacatctccatctgccgctcctgcagcgagatcgcggccttgccgtgcgggttcgcgaggcggatcgtcgcgagcagttcggcgtgctgcgcgaagaattcgggattggcgagcaggtagtcggcgacttcgcgatcgttcatgtggctggagcgttcagttatcaaggacgttgcagggtcaggcgggcaggtcgatctcgccttcgaacacggtcgtggcgggcccggccatcatcagcgcggcagcttcgtcgcgtgcgccgtcccagctgatcgtcagcgtgccgccgtgcgtgtgcacggtcacgggcgaatcgagcaggccgcgccggatgccggccgcgaccgccgcgcacgcgccggtgccgcacgcgagcgtctcgcccgccgcgcgttcgtacacgcgcagccgcacttcgctgcgcgacacgatctgcatgaagccggcgttcacgcgctccgggaagcgcgcgtggtgctcgatcagcgggccttcctcgagcaccggatacgcttcggcgtcgtcgacgatctgcaccgcgtgcgggttgcccatcgacaccgtcgagatccagcgcgtcgcgccgccgacgtcgagcggccacaacgtgtcgcggccctcggtgcggccgtcgaggcccgccgcatcgaacggcacctgcgccggcgcgaacacgggcgcacccatgtcgacgacgacttcgccgttgtcctgcatcgtcagcgtgatcaggcccttcatgacctgcacgcgcacgctgcgcttgtcggtcaggccgcggtcgctgacgaacttcacgaagcagcgcgcgccgttgccgcagtgttcgacctcgccgccgtcgcaattgaagatccggtacttgaaatcgacgccgtcgacggtcggtttttcgacgagcagcaactgatcggcgccgatgccgaagtggcggttggcgagcgcgcgcacctgcgcttcggtgagcggcggcaatgcgcgcgaatagccgtcgagcacgacgaagtcgttgcccgcgccgtgcatcttggtgaacgagagtttcactgggtccggatttccatggcgaacaaggcggtcagcacggctcgcgcgacgccgcgccatgccgggcggcctcgttcgtcgtgctgatctcaaccgcaaatgatacatgcagccgacaggggcgtcctgcgcgggcgttccgggcgttttcgtactcgttcaattgatgaggccacccggagattcgtattgtttcgccatacgccctgtcaacctccagcgagctcattcaagccatgaaccgcatcttcaatccgccccatccgggcgaaacgctgcgcgacgacgtgctgccggcgcttggcctgaccgtcaccgaggccgcgtcgcagctgggcgtgacgcgtgccgcactgtcgcggatcctgcacggccatgccggcatctcgccggaaatggcgctgcgcctcgaagcgtggctcggcgaggaaaacgggggcgggccgatctgtggctcgcgcagcagtcggcccacgatctgtggcgggcgcgcgcgaagggcgcgccgaaggtggcgagggcgcaggcgcgcacatgacggcccgcctgcgaacgtcttccggcgggatcagtacaggctcggctcgccggccgggcgcgtcttgaagcgcttgtggacccaatagtattgctcgggcatcagcgggatctgttcctcgaggaattcgttcatccgccgcgcgtcgagatcgtcgtcgcccgtcgggtagtgatcccacggcttgaataccttcaggcgataacccttgtagttcggcagcacttcgccgatgaacggcacgacctgcgcgcggcccgtcttcgcgagccggccgaccgccgtcagcgtgcacgcgggcacgccgaaaaacgggacgaaggtcgaattgcgcagcccgtaatccatgtcggcgccgagcatcaccggcttgcggtcgcgcagccagcgcagcacgacgcgcgcgctgtccgcgcggccgaccatctcggcgtcgaaacgcccgcgcgccttcttcgcctcttcctcgagcacggcgttcgagaacggctggtagagcgacccgcagcggcggtggagcgaacggttcagccagatcgagccggcttcgatgccgacgaaatgcaggccgaggaacagcgtcggcggcaggtccggatcgtcgaggtcgaccgcgctgtcgacctggatcagcttcgcgagctttttctccgagccgaaccactgcacgctgcgctcgacgtagctgcggatcgcatggcggaaatgctggcctgccacttcctcgcggcgtgcgtcgctccaatccgggaagcagagtttcagattggtgtgtacgatgcgttttcgccggctggggatcttgtagagcagccagccgagaccatcgccgaaccgtgcggtcaggccgtacggcaacagggcgagcagtttcagcaagccaatggcgaggtgcgtgcctagacgacctagcatgcgaaacctccgtggaaccggctggccggcgcgttgcgaacaggtaggtgagacagcggaagatgcagcacgggcggcgctctgtgacaattcaggaaagccgctataatacgggcttcgccgagttaactgacaacttgcggggcgaagccggttggcgtcatacgcgctgcccggtcctggtaatccgctaaagcgtcgccgcttcaggcccaacgaagctggctacgtgaaaccaaccgtaaccacacaggagcctgaaaaagtggcaaacgattatctcttcacgtccgaatccgtctccgaaggccatccggacaaggtcgcggaccaaatctcggacgcgatcctcgacgccatcctcgagcaagacaagtattcccgcgtcgcggcggaaacgctgtgcaacacgggtctcgtcgtcctggccggtgaaatcaccacgacggccaacatcgactacatccagatcgcgcgcgacacgatcaagcgcatcggctacgacaacaccgactacggcatcgactacaagggttgcgcggtgctcgtcgcgtacgacaagcagtcgccggatatcgcccagggcgtcgatcgtgcacacgacgacaacctcgatcagggcgcgggcgaccagggcctgatgttcggttacgcgtgcgatgaaacgccggaactgatgccgctgccgatctacctgtcgcaccgtctcgtcgagcgccaggccagcctgcgccgcgacggccgcctgcaatggctgcgcccggacgcgaagtcgcaggtcaccgtccgctacgtcgacggcaagccgcattcgatcgacaccgtcgtgctgtcgacgcagcacgcaccggacatcgaactgcccgcgctgcgcgaagccgtgatcgaggaaatcatcaagccgacgctgccggccgacctgatcaagggcgacatcaagttcctggtgaacccgaccggccggttcgtgatcggcggcccgcagggcgattgcggcctgaccggccgcaagatcatcgtcgacacgtacggcggtgccgcaccgcacggcggcggcgcgttctcgggcaaggatccgtcgaaggtcgaccgttcggctgcgtacgcaggccgctacgtcgcgaagaacatcgtcgccgccggcctcgcgtcgcgcgcgctgatccaggtgtcgtacgcgatcggcgtcgccgagccgacctcggtgatggtcaacacgttcggcacgggccgcgtgtcggatgcggtgatcacgaagctcgtgcgcgagcatttcgacctgcgtccgaagggcatcatcaagatgctcgacctgctgcgcccgatctacgagaagacggctgcttacggccacttcggccgcgaagagccggaattctcgtgggaagcgaccgacaaggcgctcgcactggccgaagcggccggcgtcgagccgacggcacgcgtcgcgtaagcgtcgttcgcctgaaatgaaaaacccggctagccggggtttttatgggatccgatcgtcggggcaaccggacaaacggcgcgacggcgatcgtcgcgcgcggtgcccgccggcgtgcgctcagcgcgcgccgaacccgaaccagccgttgctggccgcgaggcggcgcggacggttgacgcggcgttgcggcccgagcgtgcggcgcagcgcgagcgcgcgcagcgacgacggtttctgcagcagcgagcgcaggccggcacggcgcgagaaggcctgtgcactcatcatcgagaaaaatgcgtggaaccacgcacggataccatccagccggctgtgggcgggcgtgcgctcggccagcgcctgcgtgcgtgcgcggtgatggcgcagcgagcgggcaggagcggtcggcacgacgcgcttcgcagcgcggctgagacgggaagtcagacggaatggcatgtgaacgatgcttcgcttgtatggatggcgccctggagagcgcactggtatgaacggcctcggatgacgcaacggatcttactgaaactcgctgcgcgccgcgcccgccagaattgacaggccgcgacaggctacaggggattcatgacgggcaaaagtcgcgataaacccttgtgccgcaaggcgtgtgccgcataccgcctgtcggtgaggcaggtgccgcgacgaacagttcccttgagccggatcaaatccgcgattggcatgcccctgcgcatgacaatggtgctgttcgcggcatccggcgccgatttacaatcgtcacattcacacaataaacgtctggcatcccatgtcgtctccattgcagtcggaatcgatccgcgcgcaagtcgcggaattgcgcgagcgcggctttgtcgtcgcgcgtggcctcgtcggcgaagcgcagtgcgcggcgctcaggcagatcgcggagcgccagttgcgggaggcggccgagccgatcgagttcgaggcggatctgcgctacccgggcgcgcccgagtccaagcatgcgccgggcgggcatacggtgcggcggctgctcgatgcgtattcacgcgatccggcgttcgccgagcgcgcgatcgcacccgaaatcggtgcgtggatgcgcgagtatttcggcgaagaacccgtgctgtcgcgcgcgcatcacaactgcatgatgacgaagcatcccgcgtacggcagtctgaccggctggcatcgcgatttccgctactggtcgttcgagcgcccggacatggtgtcggtgtggcttgcgctcgggccggaaacgaacgaaaacggcgcactctggctcgtgccggggtcgcatacggccgaattcgggcctgaagcgttcgacgatgcgaagttcttccgcagtgacctgccggcgaaccggaagatgatcgatgcggccacgtgcccgtcgctgcagacgggcgacgtggtgttcttccacagcaatacgctgcattcggccggacagaaccgttccgatcaggtgaagttctcgctcgtgtacacctatcacggcgcgagcaaccggccgctgcccggcacgcgctcggcgtcgaaaccggaagtgcagttctaggttcggaccggacgggcggtgacaccaccgcggtcacgcgatgcggtgcatcgccggcggatgaagcaacgggcggcctggccgcccgtttcgcttggcgcggcgcggtcgcacgacgcgggccgcgtgtgcatcgcgcggctgcgcgatcagcgcttgttgcccggcatcgcgaggccgatcaggccgatgaacgatgcgacggcgccgcccgcgatcagcaggatcgtcttcgtcgcgggcgaaccggtgaagaagcgcgacacgttgtcgttgatcgaatggaacgactggccgccgaaatacagcagcacgacgccggcgacgagcagtgcaaccgagatgacccgggacataccaacctcgctgaaacggtgattcgagacgccgcagtgtaggcgacgaccgcggccgcgtccatcgccgtgccgccgtgcgcgatccggccgctttcgctaccatagtcgtcgtatgactccttcgccgccgtcgcgccatcggcgcggccggcgcgcgtcctcctccgatgtcctgacggaacagactcatggcctacgaagcagcttccgaacgttatgccgacatgcaataccgcacctgtggcaaatccgggctcaaactgcccgcgctgtcgctcggcctgtggcacaacttcggcgactcgacgccgatctcgacgcagcgcgaaatcctgcgtaccgcgttcgacctcggcatcaaccacttcgatctcgcgaacaactacgggccgccgtacggcagtgccgaaaccaacttcggccggctgctgaaggaggatttccggccgtatcgcgacgagttgctgatctcgacgaaggccggctgggacatgtggccggggccgtacggcagcggcggcgggtcgcgcaagtacgtgctcgcgagcctcgaccagagcctgcagcggatggggctcgactacgtcgacatcttctattcgcaccgcttcgacgcgcacacgccgctcgaggaaacggcgggcgcgctcgcgtcggccgtgcagcagggcaaggcgctctatatcggcatctcgtcgtattcggcggcgaagacgcgcgagatggccgagctgctcgcgcagtacaaggtgccgctgctgatccatcagccgtcgtacaacctgctgaaccgctgggtcgaaaccgagctgctcggcacgctcgacgagatcggcacgggcagcatcgcgttcacgccgctcgcgcagggctgctcacgtcgaagtacctgaacggcgtgccggccgacgcgcgcgtgaacaagccgggcggcggctcgctgaagcaggatcacctgagcgcggacaacctcgagcacgtgcgcaagctcaacgcgatcgccgagcggcgcgggcagagccttgcgcagatggcgctcgcatgggtgctgcgcaacggccgcgtgacgtccgcgctgatcggcgcgagccgtgcggagcaggtgcgtgaaaacgtcggtgcgctgaagcacctcgaattctcggcggaggaactcgcggagatcgaccgttacgcgacggaaggcggcatcaatctgtgggaaaagccgtccaccgatcaggcgatctgaccggtggtcgatacggcatgcgaaacatcgcgtgtcgtatcaatggctcgcgtgcggcctgtcgcatcgctgctgtgcagcgatgcacggcacacgggtggtgcgctgctagatcagcgcaggcaggccttcgacgagcaataccgcaacgccgacgccgaggatgacgcccagcacgcgtagcaggttgtggcggaattcggttgcgcacggcaccgcgccgagaaatagcgctccggccagcgccatcggaatcaacaggatgaagtcgccgatcgtgaagtaggttgtcatgcgtgtctccagtgtcggccggagttagcgctttagcgcttactccggccccatcctgtgggatttcggccggagtcggcacttcagcgcttactccggccccatcctgtgggatctcggccggagtcggcacttcagcgtttgctccggctccatgccgggtgtttctagtgttggtcgcgacccgattgcgagcgggccggtcaattcgagtataggcaaccggcagcgcttttcgctatccgaaccattaaaaatcagcggaatgcccggcgaatcacgcatttttcccgcaagtcagacgaacgccttgcgcacatctttctcgtgcctttcgatttctgtggattcgtcgcatgtgtctggtgcgtgccgccgcacccgccggcgcggcggcacgcccgctcatgcgcggtcgggccgcacgcgggcgggcgccgcgcgaaacacgagcgcaagccccgcgatgatcgcgcccatgccggcgagcgcgagcggctcgggccggttgccgagccatacggcatccatcagcgtggtgacgacgggcacgagatagaagaggctcgtcacgttgacgagatcgccgcgctgcatcaaccggtagaacagcagttgcgcgatcaccgaaatcacgacgccgagccacagcagcgggatcacgaacgcccagctcatgtcgaacgacaccggccggaacggcacgatcgccacgcacagcgcgaggccgatcgcattctgcaacggcagcacgtcggcgggcgccgcccgtacgcgcttttgcagcagcgagccggcggtcagtgcgacgagcgcggtgagcgcgcacgcgatgcccgcgagcgacaggccgtcgtcgcccacgccgcggcacacgacgagcgcgaggccggcgagtgacagcgcgagtcccgcgatgcgcacgggctgccagcgtcgctcgacgagcgcgagcgtgaggatcggctgcacgccgaggatcgtggcgagcacacccggcgcgatcccgcgttcgagcgcgagcaggtagaagatcgaatagccgcccatcatcagcaagccggtcagcgcggccatgcgctgttcgccgcgcggcggcagccagcgtttgcgcacgaaggccagcccgagcagcacgagcgatgcaagggcgaaacgtgcggtgagaaagacgaacgcggatgcgtgacgcagaccgagttcagcgaagatcgcgccgctgctccacagcagcacgaagagcgacgtcgcgccatgcgcggcgagcgcgcgtttgaacgaaaccatgtgaatccacctgtcgaacggatcggaacgttccatccgcgcgcgcagcagcgagccgtgcgtcacggcgcacgaatgcaggcctgcgggcgaatggaagacgaaacggaagccggctggtcagccggcgcgtgccgccggagggcggcgcggcgccgacgagcggcggtgcgacaggaggaggaagaaccgacggatgcgcgcacgcctgcggccgcgagtcgaactgcggccgggattttgcaagggcggacgtgagcggatgcatcggatcggaatgcgctggaacgcgaatgaagcatcaaaggtaccgcaaggccgacatcggacgcaaccactgtcggtgacattgcatgacgcagcgcggcgtgcggtgaatcacgcggtgatgcgggcggcgaagtgggcggcgaagcgggcggtgcgtgcgcaaccgtcgtcgtgccggttgcgttcgaggtacggggaaggcgatgacggtgcggcgtcgttcggccacggcggtcgcgcgaaatttcccggtgatgcggcaccgggcccgcgatgcgcgcgcggcatgcgtcgcgggcgcgtcgcggtgccgacgcggattcggcgggcagttacattcgacagggtatgatgggggtaaccgggcgggcaagcgcctgtccggcgcagtggttgattggagacattcgacgaattcgcggcacttcgcctgcttcttcttcttttcgcgcttcgataaaccgtgaacaatgggattacgcgcaacgctccgacgagagcgcgcggatcgtgcatttgccggctcgccatcgagccgggtttcaagagtcaagagtggggaaccatcatgcatgtcgggtcgattgtctgcactacccatatcgctgtgccgaagggcgcacgcggcatcgtccagcgcatcctgggcgacatggccatggtgacctggtacgcgggcgtaccgggcgagtcgaaggaactcaacaccgagccgttctttctcgaggacctgatcgacaccggcgaatccgtgctgccggccggcgcggcgcttcactgagcgcatacgccgcaccgggcgctcgtctttcggcccggctggcggcacaatgcggggcatgaaagacgtcacttccgctcccgcttctcccgccggcccgccgttcgccggactcacgcccgagtgcgtgctcgacgcgctcgacagcgtgctgatgccggccggcctgcgcaccgacgggcgcctgctcgcgctcaacagctacgaaaaccgcgtatatcaggtgggcatcgaagacggcccgccggtcgtcgcgaagttctaccgtccggcccgctggtcggacgaagcgatcctcgaagagcatgcgttcgtcgccgagctcgccgcgcgcgagattccggcggtgcccgcgcgcacattcgacggccgcacgctgcacgcgttcgacggtttccgcttctcgatcttcgagcggcgcggcggccgcgcgcctgacctcgaccgcagcgacacgctcgaatggctcggccgcttcatcggccggatccatgcggtcggcgcgacgcagccgtatgccgcgcgtcccgtgctcgatatcagtacgttcggctacgagccgcgcgactacctgctcgcgcacgatttcattccggacgatgtgcggcccgcgtatgagaccgccgtgacgctcgcgctcgaaggcgtcgaggccgcgttcgagcgggcgggcgagatccgcctgctgcgcacccacggcgactgtcatccgagcaacgtgctgtggaccgatgccggcccgcacttcgtcgacttcgacgacagccggatggcgcccgcgatccaggatctgtggctgttgttgccgggcgatcgcgaaggcgcgtcgcgtgcgctcgcggacctgctggccggctacgaggatttctgcgaattcgagccgcgcgagttgcatctcgtcgaagcgctgcgcacgctgcggctgatccactacgcggcatggctcgcgcgacgctgggacgatcccgccttccccgccgcgttcccgtggttcaacacgcaccgctactgggaagcacgcgtgctcgagttgcgcgagcagatcggcgcgatgcaggaagggccgctctggcccgtatgacggcgcgtgcggcaccggcgccgcgcggcctgccggtgcgggccgcggcgcgatgcgcgcggcccgttcgatcccttccgttcagaacttcagcatcagcttgatcagcgcggcgaagcgcttgccgtacggcggcgcgagcaggttgcgcgtgttcaggcgcgcctgcgtgagtaccggcttcatcttcgagaacgtcacgaagccgtcgtagccgtgatatgcgcccatgccgctcgcaccgacaccgccgaacggcaggctgccgcacgcgatgtgcatcagcgtttcgttgatcgacacgccgcccgagaccgtttcgcgcatcacgcggtcgatcgtgccgccgtcctcgtcgaacaggtagagcgcaagcggacgcgggcgcgcattcacgtatgcgatcgcttcgtcgagccgctcgtacggcacgagcggcagcagcggcccgaagatctcctcctgcatcagctgcgacgcggccggcacctgcgtgaccgcgcacggcacgaagcggcgcgatgcaggatcggattgcgcgtcggacagcggatgcagctgcgcgccggccgcctgcgcgtcgctggcgagctgctgcagccgggcgtagtggcgcggcgacacgatcgtcgtgtagtcgccgttggtcgacaggtcggggtacatcttcgcgaaccgtgcccgcgcgcgctcgatgaacgcggcttccatcccgcgcggcagcagcacgtagtcgggcgcgatgcaggtctggcccgcgttcagcgtcttgcccgcgacgatcgcgtcgacggccgcatcgaagcgcgcgttcggcccgacgatggccggcgacttgccgccgagttcgagcgtgacgggcgtgaggttgtcggcggccgcgcgcatcacgtggcggccgacgtgcgtcgagccggtgaacagcagatgatcgaacggcagcccgctgaacgcggcgcccacttccgcatcgccgttcacgaccgcgacgtggtcgcgcgtgaaggtcttcgcaatgagctgctcgaacagcgccgacgtgcgcggcgtcagttcggacatcttgatgatcgcgcggttgccggccgcgagcgcgcagatcagcgggccggccgcgagcagcaccgggtagttccacggtacgacgatgccgaccacgccgaggggctgcggaatcaccttcgcgcgcgccgggcgcagccacttgttcatcggcttgcggatcggtttcatccagcgcttgccgtgcttgagcgcgtcgtcgatctcttccttcgccatccagatttccgacagcagcacttcctgcttcgcgcgatgaccgaaatcggcgctgatcgcttcggcgagtgcgtccgcgtgatcgatcagcatcgtgcgcagcgcgcgcaagtgctgcacgcgcgtttcccatgccgggtacggtgcgcgcaggtaggccgcgcgctggtcgcgcagcagcgacgtcagtgcatcgaccgacggcagtgcttgcggggccagttcgggcaggtcgttcttcatgtcgtctcctccagttgggcctggctggtcggccggccgtcacgccgcatgcgcacgctcggcgagcgcggcgacgcggatcggggtggtgcgtgtcgcgcggcgcggggccggatgcgacgtgtgctcgaaaaccggttcaagcgtgcagcgggcgtcgcatccacgcgacggtgtgtgcatccggaaaccgtgttgcggcgcgtgggcatgcagtgcgatgcaaccgttgccgggcgcgcgacgccgcggcgcgactgcccgcctgcgcaccgaagcggggtggcgcgacggggccgtccaaccatgccgcggcgcatcgtgccgccgtggcgacaaaccgtccaaacggtcggcgacgacgcgtgccgttcgatttcgatcgactgcgcgcatgacgcggggcacctccgcgcgggcagccgtttgaaatgaaatgcgggctgcgcgcatcgcatccggacaacccggtcggcacgcggcctgcagaacctggcgctgcatcgtcgtctctcccgtttcgcgacggatcggcttctcgtggccggcgcgtcgcgcaaagcgaatcgatacatcttaaatttagttcacgcgagcgtttagaggaatcgctcttgaatccgcgcgccgcgcgcacggtggcgattcctacaatgcccgaacactacaaggacgcggtcgcgcggcggcgccgggcgccttccatgagacgacggagacgtgacatgcaatacgactacatcatcgtcggcggcgggtcgggcggatcgagcctggcaggccgcctcgccgatgcctgccccgatgcgacgatcgcgctgatcgaggccggttcgcatacggagcgcaacctgctggtcaacatgccggtcggcatcgcggcgctggtaccgttcaaactcggcacgaactacggctacgagacggtgccgcagccgggcctcggcgggcggcgcggctaccagccgcgcgggcgcgggatgggcggctcgagcgcgatcaacgcgatgatctacacgcgcggccacccgggcgactacgacgaatgggcgcagctcggcgcgacgggctggggctggcaggacgtgctgccgtatttccggcgcgcggaaggcaacgaacgcggcgccgatgcgtggcacggcgcggatggcccgctgtcggtgtcggatctgcgctttcgcaatccgttctccgaacgattcatccaggccgcgcatgcggccggctatccgctgaacgacgacttcaacggcgcgacgcaggaaggcgtcggcttctatcaggtcacgcaccgcgacggctcgcgctgcagcgtcgcgcgtgcgtacatctacggccgcaaccggccgaacctgcacgtgatcaccgatgcgacggtgctgcgcgtcacgttcgacggcaagcgcgtggccggcgtcgcggtcgcgcgcaacggtcgcgtcgagacgctcgacgcgcgcgcggaagtgatcctgtcggccggcgcgttcaattcgccgcaactgctgatgtgctcgggaatcggcccggccgagcaactgcgccggcacggaatcgccgtcgtgcaggatgcgccggacgtcggcacgaacctgatcgaccacatcgacttcatcatcaacacgcgcgtgaattcgtcggagctggtcggcgtatgcctgcgcgggatcgcgaagatgacgcccgcgctcgcgcgctatttctcgagccgcaccgggatgatgacgagcaacgtcgcggaggccggcggcttcatcaagagcgatccgtcgctcgagcgccccgacctgcaactgcatttctgcacggcgctcgtggacgaccacaaccgcaagatgcactggggcttcggctattcgctgcacgtgtgcgcgctgcggccgttcagccgcggcacggtgacgctcgcgaccggcgatgcgcgtgatgcaccgctgatcgatccgcgcttcttcagcgattcgcgcgatctcgacctgctcgtgcggggcacgcaggcgatgcgcaggatcctgtcgcaggcgccgctcgcgtcgcagggcgggcgcgagctgtacgcgggcggaccagagcgaagcggagctgcgcaagacgatcgtcgagcatgccgacacgatctaccacccggtcggcacctgccggatggggtcggacgcgcacgcggtcgtcgatccgcaactgcgcgtgcgcggcgtcgaaggattgcgcgtggtggatgcgtcggtgatgccgacgctggtcggcgggaacacgaatgcgccgtcggtgatgatcggcgaacgcgcggcggacttcatcgtcgcggcgcgcaagggcggcgtgtcgcgcggcgaggcggctgccgcggtgcacggccgctgaacggcgcgcgcacgcgggcagtcatgctcaggcaaacgtatcgacgaggccggcgcggctcacgctcgcggcgaccggtgcggattgcgcagcgtcgaccggtgcatcgacggctgacgatccgccgctcccgcgccgcgacgactgcccgccggcgaaggacgattgcgggttctgctgctgcgaagcgaagccgccgtcgctgacggtcgcgctgcccaggccgagcccgcccgattccatcgcttcgcgcagcttcggcagcgcggcttcgaccgcgtcgcgcacctgcgcgtgctgcgacacgaacagcgcgtgcgcgtgattgtccgcgacgcgcagcacgacctgcagcggcccgagatcgggcgggttgagggtcagctcggcgctctgctggtgcgcattcgacaggaacacgaccttctggctcagcgcgtccgtccagtccggggtgccgacgtgcggggcgagcacgtgcgcgttcgccgcggcgatcgctcccgcggccggcgacaactgcaggttcgcctgtgtcgcggcggcggccgttgcgccggctgcgagcgtcgcgctggcagccggatccgtcgcgtcgccggctgccgcgagcgcgtgctgctcgcccgactgcgcattcgcgttggcctgcagcgcctgcgcggtggcctgcgtcggcgtttgctgggtcgcgagcgcccccttcgcgtcggcgagggtgcggtcgaaggtcgggaccttcggggtcagcggtgcggtggcgccggtcgatgcggtcgatgccggtgccgacgcggtcgcgccggccgcgggtatcgcgatcgcgcccgagccgcccgtcagcctgtcgagcgcggtctgcagcacatcgcggcccgacgcgggcgcggccggctgggcggccgcggcggcgtccgtggccgcgtgatccgccagcgtggccgtggcatcgggctggccggacacggccgccttttgtgcagcggcggcggcagcagccggatcgaccggcgccgcgttgtccatgcgcgcctgcagttgcgcctgcacggccgcggcggccgcgagcgcggcggcgtcggggttggcggtggtgttcgtggtcgtatcgtcggtcgcgtcgtcgtcatcggtcgcggacggcttcgtgccggcggccggcttcgacgaagcctgtctcgtcgaagcatccggcgcgccggcattcgacgaatcgcgacgcgtgacgacgctttgcttcagcgtctgcgcgaacggcacggcggtcgcggcatcgttgccggcggcggcgccggacgaacccgagccgcgggcggcctggagtgcggtgccggcggtgtcgagcagcgcgccgagcaggggcaggggaggcatgacgttctctcgttcgaatgcggtggtcggttacgacgaacgggccgcgtcggcccgcatgcgcaggatcttcgcggcgtgttcgtcggcatcgcgctgctcgcgccgggcttcgcgcttcgcttcctgcgcgacgccgcgcgcctgcaggatttcataggagccgacggtgcgtttcttctgttgccagttcgggcgtgcttcgtcgatgcggacttcggccgcggccagcacgctgcgctgctgcgcgatcgcggcgtcgagcgtgtcgatgaacgcctggaaattgcgccagttgccggccggcatcccgtgctgggcggattgcgagaagcgcgcgtggtattcgtcgcggtagcgcagcagcgcgtcgagctgctcggcggccgcggtgcggtcgcgctgcgcggtgccgagctgcttcgcggccgagtcgaggtcgtcctgcgcgcggtcgagcagcaactgaaggggaaagccgtgagccatcgggatcagcctccgtaagcgtcgaacagtgcatcgagcccggcgaggctcgacgcgaacggcgcgcattcgcgaaagccctgctgcaggaacgcctcgatgcgcggatagagcgcgatcgcgcggtcgagctgcgcgtcgcggccgggcgcgtacgcgccgaccgcgatcaggtcgcgattgcgctggtagcgcgacagcatctgcttgaactgccggacgtggtcgagatgcgtttcgtcgatcagcgcggtcatcgcgcggctgatcgacgcctcgatgtcgatcgccggatagtggccggcctcggcaagcgcacgcgacagcacgacgtggccgtcgaggatcgcgcgcgccgaatcggcgatcgggtcctgctggtcgtcgccttcggtcagcaccgtgtagaacgcggtgatcgagccgccgccctccggcccgttgccggtgcgctcgacgagcgccggcagcttcgcgaacaccgacggcgggtaacccttggtcgcgggcggctcgccgatcgcgagcgcgatctcgcgctgcgccatcgcgtagcgcgtcagcgaatccatcagcagcagcacgtgcttgccctggtcgcggaaatactcggcgagcgacgtcgcataggccgcgccctgcatccgcagcagcggcgagacgtcggccggcgccgcgacgacgaccgagcgtgcgagcccgtcctcgccgaggatctgttcgatgaactccttcacttcgcggccgcgttcgccgatcagcccgatcacgatcacttccgcgctcgtgtagcgcgccatcgtgccgagcagcaccgacttgccgacgccggagccggcgaacaggcccatccgctggccgcggccgacggtgagcagtgcgttgatcgcacgcacgccgacgtcgagcacgtggtggatcggttcgcgctcgagcgggttgatcgacggcgccgacagcggcgcgtcgaccttcgacgcgagcgggccgaggccgtcgagcgggcggcccgacgcgtcgacgacgcgcccgagcatctcccagccgaccggcaaacgcttcgcgcccgcgagcggatcggccaccggcgcggtttcgcggggccagacgcgcgcaccgggcagcacgccggcgacgtcggtggtcggcatcaggaacaggcggtcgccggcgaagccgacgacttccgcttccgcgtgcggcagcgtgctgccgggcgacagttcgatcgtgcattcggcgccgaccgacaggcgcagcccgatcgcctcgagcacgaggccggccgcgcgcgtcaggcggccgcacgggcgcagcggcagcgcgcggtggctgcgcgcggcgaggccgttcaggtgcgtgcgccagtacgcgagatgcgggttgtgcggcgcgcgcggcgcgtgcccggcgggcggcgtggcgccggaagcgtcggccgctgcggcggcgccgtgcgggtgtgcgtcatgcgtgtcatgtgcggcgtcggggccgaacgacgcgagcgcgagctcgcgttcgagcggcgtcaggccgtcgtgcgcgagcgcttcgggcggccgcgtcaccacgtgctcaccttgccgatcgcggcggcgacgcgctgccagcgcgtgggcagcgtcgcgtcgacctcgccggtcgcggcgtgcgcgcggcagccgccgcgctcgatcgacgcgtcggtgcgcacgttccagccgagcgtatcgagatcgtcctgcagataggcttcgacgacgggcaggtcggccggattcaccgcgagatgcggcgcgccggacagcgcgggttcggccgcgagcacgtcgcgcacggccgcgacgagcgcggcggggtcgtgcttcacgtgctggcgcacgacctgttgcgcgatgtcgagcgcgagctgcgcgatgtcggcggccagatcgtgctcgacgctcgacacggcctcgcggaacgacgcggcgagcgccgcgagctgcgcggcctgttcgcgcgcgtcggcctggccggcttcgaacccctgtgcgcggccctgctcgaaaccggcctggtagccgagcgcctggccttcgacatggccggccgcatggccttcggcgtgcgcggcgtcgcgcacgcgctgcaggtcctcggcgagcgcggcggcggccgctgccgcgtcgtcgggcggcggcgggggcggcggcgggtcgaacgacgccatctcccaccgctggtaggcggtgagggtgcccgcgcgatcgctcgccgaatcagacatacgcgtcttccgccttgccgccgatcgcgatcgcgccgctctcggccaggttgcgcacgatctgcaggatgcggcgctgctgcgtctcgacttcggacacgcgtaccgggccgcgcgcgtcgagatcctcggcgagcagttcggccgcgcgctgcgacatgttcgcgaggaacttctggcgcagcgcgggcggcgcgcccttcagcgcgatgatcagcgtttccgactcgacttccttgagcaccatctggatcgcgcggtcctcgaggtcgagcaggttctcgaacacgaacatctggtcgacgatcttctgcgcgagatccgcgtcgtactggcgcacgctttcgagcacgccttcctcatgcacgctcgtcatgaagttcaggatctcggccgcggtgcggatgccgcccatcgggctgcgcttcaggttgtcgctgccggacagcaggcccgtcagcacgtcgtcgagttcgcgcagcgcggccggctggatgccgtcgagcgtcgcgatccgcagcatcacgtcgttacgcaggcgttcggtgaagcacgacgcgatctccgatgcctggtcgcggtcgaggtgcacgaggatcgtcgcgatgatctgcggatgctcgttcttgatcagttcggccaccgcgcccgagtccatccacttcaggccctcgatgccgctcgtgtcgctgccctgcaggatgcggtcgatcagcacgccggccttgtcctcgccgagcgccttggtcagcaccgagcggatgtagtcgctcgaatcgagcgacagcgcggtgtgctgctccgcttccttcgcgaattcctgcagcacgtcctcgacctgctcgcgcgtgacgttcttcagcgcggccatcgcggcgccgatcttctggacctcgcgcggcgcgaggaacttgaatacctgcgcggcctcttcctcgccgatcgacatcagcagcagcgcgctcttggtcaagccttcagcgttcatcggacacccagttcttcacgacggtggcgacgatcttcggatcctggcgggcgatcgagcgcgcgtagtcgaggttgcgttcgtaacggttcttttcgctttcgaaaccgagcagcagcgcgtcgggttcttcggtcttctccggcgccggcaggccgtcgagcgcgaccggatcttccggcgcggcgagcgccggcgcgaccggctcgggcggcgggaacgcgcggcgcatcgccgggcgcacgaacatgaagtaaagcgccgccgcggccgccgcgatgccgagccacttcgcggcttccttcgccatcgcgatcatgtcgggctggcgccaccacggcaggtcggcgtacgggtcgctcgcggtcgagaacgcgctgttcacgacgttcaccgagtcgccgcgcttcgcgtcgtagcccatcgcatccttcacgagctgttcgacctgcgcgagcttcgccggcggcagcggctgcatcgtcacgtggcccttcgcgtcggcgaccggctggtagttgacgacgaccgcgaccgacagccgcttcacgctgcccatcggctgctcgaggtgacggatcgtcttgtcgagctcgtagttggtcgtctggtccttgcggtcgctcacgggcgtcgtctgcggcgcgttctggccgttgccggcgacgatcggcgcggacgccggctgcggcggcgtgttcgacaacgcgcccggcacgcccgacgcgccgccctgcgcgagctcggtcgcgctgctggtctgctggctgcggatcgcggattgctgcggattgccgttcgggccgtagctttccgacgtctgctcgaccttcgagaaatcgaggtccgcgctgacctgcgagcgcgcgttgcccgtgccgaagatcggcgcgaggatcgcgtcgatgcgcttctgcgtgttgtgctcgacctgctgcacgtacttgagctggctcgcgtcgaggccggatgccgaggcggtctgggtcagcaggttgccgtcctggtcgacgatcgtcacgttcttcgcgggcatgtcgggcacgccggacgacaccatccgcgtgatcgcctgcacctggccctcgtcgagcacgcggcccggatagaggtcgacgaacaccgacgcgctcggcgcttccttgtcgcgcacgaacaccgacggcttcgggatcgcgagatgcacgcgcgcgccgcgcacggcgttgatcgattcgatggtgcgctgcagctcgccttcgagcgcgcgctggtagttgatctgctcggcgaactggctgatgccgaacttctggttgtccatcagctcgaaaccgaccgagccgcccttcggcagccccatcgcggcgagcttcaagcgcgtttcatgtacctggttcgacggcacgaggatcgcgccgccggcatcggcgaacttgtagggaacgtttgcctgctggagcgcggcgatgatcgcgccgccgtcgcgatccgacaggttgctgtacagcacgcgatagtcgggcgcgcggctccacagcacgagcgcggtgatcacggcgaccgcgaacgcgacggcgatcaggaacggcagcttcgggttgcccttcatccgcgagatgccgggaatgcgttccgcgaagccgccaagcccgaagtccgcgcctgcgccacccgcgcccggcaacgcggcggccgcggcggcgccgggcgccgggctggcgaggcccgcgcgggcgtctgggttgatcagcgagttggcctgcgaatccatgcgtcgagtttctccggagcgggacgactgagctcgctcgggcgagcgggcggacaatgacacgatgcgattatcgtgacccgggcccggttccgatcgactgaaaagagcggggtttccccgtactttctcggctttgacgcgcggcgcgctgctatcctttttcgcgatccggcatggtgcgcgtggtgcggcgccggcggaaacacccggtgcgccgggtttcttctctcggttttggggacagcatgactgcgaacgtcagcggaatcggttcggtgttgcaacagatgcagtcgatggccgcgcaggcgtccggcggcgtcgcgagcccgacggcagcgctggccggttcgggcgcggcgacggccggcacgttcgcgagcgcgatgaaggcgtcgctcgacaagatcagcggcgaccagcagcacgcgctcggcgaggcgcaggcgttcgaggtcggtgcgccgaacgtctcgctgaacgacgtgatggtcgacatgcagaaagccaacatcggcttccagttcgggctccaggtccgcaacaagctggtgagcgcttacaacgacatcatgcagatgtcggtgtgatgcgcgcggcacccggggacgggtacccggcgacgggcacccgtgggcggccatccggcgaaagtcgttcaggaaggcctccgggccggcgccttcggcgccccggcggcaggccgcgcttgcctaaagcttttcaaatcccttccgataactccggtgaaggccgcgtcgtgcgatgcacggcggcggttcccgtatagccaaggcataacaaggagaagcgcatgttttcccaggacacgctggagccagtgcatacgcgcgtgtcggcgtcgagaccggggtgatgggcgcctcccgcaccgtttgatcgcgatgctgtaccagggcgcgcggcaggcggttgcgctggcgcgcatgcatttgcagcagggcaatgtgtccgcgcgcggcgatgcgatcggcaaggcgatccggatcgtcgagagcgggctgaaggcgtcgctgaaccgcgacgcgggcggcgagatcgcggagcggctggacgcgctgtatgcgtatatcggccggcgtctgctggaagcgaacgcgcaggcgagcgacgcgatgctggtcgaggtcgacgggctgctcgcgacgctcgaggaagcatggacggggatcgcccggaagtcgcgcggatggccgcgcaacaggcagtggaagcatcgagatgaatcgcaaggccgaatacttcgcacgttacgaggcgctcgccgccgtgtcgggccggatgctgggcgccgcccgcagcgccgactggagcgcgttgccggggttgcaggccgaattcacggcactcgtcgacgggctgaaggaagccgatccgggcgtcgtgctcgacgaatcggatctcggccgcaagctcgacctgatccgccgcatcctggccgacgacgccgcgatccgcgacctcgcgagcccggacgtcgcgcggctgtccgcgctgttcgaggcgcggcgctcgaccaaggtattgaccgatctctaccgcgcgcgcgggtagggcccgtttcccgggaagccgggaggcggaagggcgggcgcggggcgcacgagcccgttgcgggaggcgcgcagttcccgcgagcggcaccggcgtgccgttcccggattcgcaacgatgtggctgaggtgagcaggctccgatcatgaccggtatcgactccgttgcggccgcgctgctggcgagccgcctcgacagcctgctgaccggcaccgtatcggcgcccgccggcggcggcgcgacctcgcaggtcggcacgccgggcaccggcacggcgtccacgccttcggccggcagcccgccggccgcgccgccggcctctacccaaaccgcactgtccgatgtcgggcgcgtgctcgacgcgatctcgcgggccggtggcgactcgacgccggccattgccgggcgcgtgccgctgctggccgatcccaccgtgctgctgaccgatacggccttgccggcccgcgcgccggccgcttccgatccggctgcgtcttccacaccggcctccgccgcggcatcttccgctgctgcggcggcacacgaagcggccgcggccctgccggtcgcggcgctgcgcgcagcgctcgcgcaggccgtgagcgaaagcggcctgttctacgaatcccatctggcgcagtggctggccggccagcgcccgctcgcggcgctgatgcgcgagccgcaggcgcgccttgcggccgcgctcgcgccggtcgacccggatgccgcgcagcacgactcgaccgacgtgctcgacgaactgctcgcgcagcggccgccgctgcccgcgaccgcgcgggcgacggcgcagccgggtacaccggcccagggtggcgcaccgacacgcgatcctgcgcaaggcttgccggcgggcgtgcggcacggcgcgtcgttgccgcccgatacgttcgatctgctcggcgaacgccctgatgtgcgcgggacgcccgcgcaactggccaccgcgtcgtccgactcccaggcgcagacgctggcgcccgtgcatccggccgccgtgccgctcgtcaggcagcagctcgacgcgctcgcgaccgaccagttccgctggacgggcgaggcgtggcccggcgcgcggctcgactggacgatcgagccggacgatccgggcagccgcgcgccgcgcggcgacgacggcccgggcgacggcatcgcatggcgcacgcgcctgacgctgacgttgccgtcgctcggcacggtcgacgcggaactggtgctgaacggcacgcaactggtcgcgcgattgcgtgcgaaccagacgggcgccgaccgcctcacgcggcacgaggccgcgctgcggcagcggctcgaggtgtcggggctgcgggtgggtggattgtcgatccgcgcggtcgacgacggcccggacggcttcgacctgtttgcagcccaggcggccgccgccgcgtatgcgcgcggctcggccggcggcccggcgacgcaggcgccggatagcgacgacgaggcgctgccatgagcatgacgtcccgcaagcgcgcggccgcgctcgtctacgatccgaagggggcgatgcggcgccgcgcgtggtcgcgaagggctacggcgtgctcgccgagatgatcgtcgcgcgtgcgcacgatgcgggcttgtacgtgcatacggcaccggagatggtgtcgctgctgatgcaggtcgacctcgacgaccggattccgccgcagctctaccaggcggtcgcggatctgctcgcgtggctgtacgcgctcgaccgcaccgagcccgcgccggacgacaccacaccgcgctttccgctgccgccgctgcgctgaatcgcccggcatcgcgcgacttcttacgaaatgctgtcctggtcttgcaaggtcattcgggcggcattttccggttatcgtccggcatcgtggcgcaacgcgcgcgcttttcccgccttcttgctcttgccgggcgtgccgcgacgcacccgggtggattgagccgccggtttgtttgtgtaatgatatccattctcattttcatgctgcccgggcggcgcgcacgttttgcgcgccgcccgttgttttgaacgaatggaacctttcgcgtgaacgcgcccgaaacgatcaatccgcccaagacgggtactgcccgcgcgggcgtcaccgtgctgcacccggcggcccgcccgctgagcgacgacgaactggccgcgcgccgccagcgttcgcgccgcgcgaccttcatcaagtggctgcgcaaggtgcacggctgggtcgggctgtggggcgcggtgctcgggctgctgttcggcgtgacgggcgtgctgctcaaccaccgcgcgccgccgctgaagatttcgacgggcgagccgcaggtcgaggagatgcagatcgcgctgccggatccggtgccgaagacgcccgccgcgatgacgaagtggctgcagcacgagctgaatttcgacggcaagccggggcgcatgcgcaaggaggccgcgcagcccgttgcgtggggcgacaagcgcgtgatgcagccggagcactggcagttcggcctgttcggcccgcaccagaacctgcaggccgaatactgggtcggcaacggctacgtctcggtgaagcgcacgggcaacacgttcctgacgacgctgaacaacctgcatcgcggcgtcgggatgaatctcggctgggtgctgctgatggacacgatcgcgggctcgctgatcctgctgtcgctgaccggcgtgctgctgtggaccgagctgaacaagcgccgcacggtcggcgtggtgctggtggtcggttcggtcgccgcggcgcttgccgccggcctgacctgaccggcgggcgcgccggccgggcgccggcgcgtgcgctgtcgtcagttttgtcggcttcgtcggcttagcccgtcgcggccgcatatcccgcgcgaccgcccgccgatcagaggccgcatgccgcgccgctgttcgccgcgatctcccgcgcggccttcgcgccctcgacctgcaggatcgtcggcagcgacacgtggttcttcgcggcggtgatctcggcgaggatcgagatcgcgatttccggcggcgtccggctgccgatgtagatgccggccggcccgtgcagccgggccagttccgcttcgctcaggtcgaattcgcgcagccgctcgcgccgtgccgcgttgttgcgccgcgagccgagcgcgcccacgtagaacgcgggcgtcttcagcgcctccatcagcgcgagatcgtcgagcttcggatcgtgcgtcagtgcaatcacggccgaacgcgcatcgaggttcatctcgagcaccgtatcgtcgggcatcgcgtgcacgacgcgcgtgcccggcacgtcccacgcatcggtgtattcctcgcgcggatcgcataccgtcacctggtagtcgagcccgaccgcgatctggcacagataacgcgacaactggccggcgccgatcacgagcatccggtagcgcggcccgtggatcgtcacgagccgctcgccgtcgaacgcgagcccgtcggcggcctgcgcgggtgacagcgatgcgcggcccgtcgcgagcgtcatcgtgcgcgtgacgaggcgcccggcctcgacttccgcgcacagcgcggttatcccgctgtcgcgcgtgagcggctcgagcacgagctggatcgtgccgccgcaaggcagcccgaagcgatgtgcttcctcggccgtcacgccgtacttgagcgcttccgggcgcgcgtcggccgcgatgccgctcgcatgcacgcgggcgatcaggtcgtcctcgatacatccgccggacacggaaccgaccacgagcccgtcctcgcggaccgcgagcatcgcgccttcggggcggggcgacgagccccaggtcttcacgaccgtcacgagcagcacgcggcgcccttcttcgagccagcgcgcgctggatttcaatacatcgagatcgacgctttccatcatcttcttcctgttgccgggcgcacccgtcgatgcgggccgccgttcgatggcgcgattatgaaccggccgcgacaagcgtgcagggacggggaaggcgcaaaacgtggaggggaggcgcgcagcggcgggaaggcgggcgggacggcccgtgccgggccgtcggcaggttgccgggcggacacatccgcccggcggggcgatgcgtcagagcgagcccaggtactgcgtcaggttgcggatgttgttgtcatacgcgctcggcgagccgagctcgacgccgccgctgcgcacgtaatactcgaacggcacggagcgggtgccgaagaacggcaggaaattgtccggctgcagcgtcgtgccgttcaggccgatcgcccagttccgcgacttgtacagctcgagctcgcggatcgtcgcctggacctggttcgtctccgacgcgcgaatcgcggcgatgtgctgcgtcagcgtctcgatgttcgcctggtatgcgctcggctcgccgaccgagacgccacgcgcgcggacgtagtagctgaacggcaggttgcgttccgtgaagaacgtgaggaaaccatccggcgcgagcgtatccccgttcagcccgatcgcccagttcttgctttgataatccctgagccccgcaatcgtctggttggtcgcgctgatttcgaccttcgccgtgacgttgaccaatgtattgctcatgacagacctctctggttcttgttgaacttcggacaggtgcagcgacatgcctccgctcggaggcaattcaataccagcgaccggattatccggttttaaatgtttttaattaaaaagatgctgaaaattcgttcgtgaacacgcaatgaatttctgtttgatggaaatgcgattcgatgaagccgattgcatcgcgttgcgctcatgctgcggcaaattccccgtctgacgcaggctgggcgggtgtgtgcggccggccgacctgaatactagtttggcggatgaaagagttcaatgtcgttcgcgagattattttcttctattcatattcaattcaattgaattacatttttcatcgattaatttgtcgatcggaatcgaatataccggtattcgaaaaacagccgatgaaaatgggaactgccgcgcgaatcgttgcgggagacgcaacgcggcggcgagacgggcgaggggagaggaggggcggggccggatggcggccccgcgggtgcgcaccgtgccgcgtgcggcacggcggcgctcagtgcgcgtcgtggcgaccgtgcgcgagcttcgagtggtgacgcgagtacaggaagtagatcacgagaccgatcacgagccagatgccgaacgcggcccacgtgacgggctgcaggttcagcatcaggaacaggcacgatgcgaccgcgaggatcggcacgaccggcacgccggggcaacggaacgcgcgcggcaggtcggggtgcgtgcggcgcagcacgagcaccgcgatcgacaccatcgagaacgccgcgagcgtgccgatgttgatcagctcggcgagcacgttgagcggcacgagcgcggcgatcagcccgaagaacaggccgacgagccaggtcgtcaggaacggcgtcgcgtagcgcgggtgcacgcgcgacagcgtcgccggcagcagcccgtcgcgcgacatcgcgaagatcacgcgcgtctggccgtagctcatcacgaggatcacggtcagcatgccgagcacggcgccgagatcgatgaagcccgccacccacgtctcgccggcgacctgcagtgcgtacgagatcgggtgcgagatgttcgcgtaccgggccgacggcacgatgccggtcgcgaccgcggcgaccgtcacgtacagcaccgcgcacaccgcgagcgacgcgatgatgccgatcggcaaatcgcgtttcggattcttcacttcctcggccgccgacgacaccgcgtcgaagccgatgaacgcgaagaacatcacggccgcggcgccgaacacgccgttccagccgtgcggcatgaacggcttccagttggcgggcgtcacatggaacacgccgaccgcgatcacgagcagcacgaccgacaccttgatgaacaccatgatgttgttgatgcgggtcgactcgcggatgccgatcgacagcagcgtggtgatcacgatcatcacgaggaacgcgggcaggttgaaccacgtgacgacacccggcaccgcgccgggcgcggccgtcagcacggtgggcagcgtcagcccgaagccctgcagcagcgactgcaggtagcccgaccagccgaccgacacggccgacgacgcgaggccgtattcgagcatcaggtcccagccgatgatccacgcgacgagttcgccgagcgtcgcgtacgagtacgtgtagatcgagccggcgacggggatcgtcgacgcgaattccgcgtacgacagcgccgcgaggccgcatgcgatcgcggcgatcacgaacgacagcatcagcgcggggccggcctgcacggcgccggtaccggtcagcacgaagatgccggtgccgatgatcgcgccgatgccgaggaaggtgaggtcgatcgcgccgagcgctttcttgagcccggcggcttgcgcgccggcgatcatgcgatcgacgtttttcttgcggaagagagacattgcggatgaatcgccagcgcgcgcgggcgcgatagcgctgactgagtgaaaacccgcaattttagccgatttggcgcgcaagactcgctgcggcgcagcggtgtgccgcgaaatagtccgataaaacaagcgcttgcgcgccaaaaggacgggcggcggacggcactcggcggcggcgcggcatgcgccgcgtcgccgggtcgggtcaggtgagtcgggccgggcgggaaatcaggcgccggccgtgggcgccatgtcgacgagctggttgctcatcacgtagaacgtgagttccgcattgttcgacagccgcatcttctcgagcagccgcgaccggtacacgctcaccgtcttcacggacagcgacagcgtgttcgcgatgtcggtgagccgcttgcccgacgcgagcatgcagagcgtctggtattcgcggtcggacagcttctcgtgcggcagcggctcgttctcgaacgacacgtattcggcgagcgcctcggccatcgcggggctcacgtacttgcggccggccgcgacctgctggatcgcgccgatcatctgcgcggcgttgaccgtcttcgacaggtagccggcggcaccggccttcagcgcgcgtaccgcgtactgatcctcgcggtacatcgagaacatcagcaccggcgtgcgcggcagcttgcgcttgaggcgcttgagcacttcgatgccgttcgtgtccggcagcgagatgtcgagcaggatcgcgtcgaattcctgtttgtcgacggcggccatggcgtcgccgccgttctcggcctcggtgacgtcgcgcgcgacgccacggtcgatcagcaactggcggatcccttgccggacgatcgcgtgatcgtccacgagcaggatgttcaggctcatgacgacctcacgaaagcgacgcgcggcgggccgtgacgggcaccgcgagcagcgaatcccaggcgaagcgcgcggtgacgcgcgtgccgtggccggcttccggcgtggccgtctcgaagctgccgccgaacgcctcgcagcgggcgcgcatgccggcgagaccgtagccgctgcggcggctgcgggcgaaaccggtaccatcgtcggagacaatcaatgacagatgcgtgccgtcggtgacgatccgcacgtcgaccgacgtcgcgcgggcgtgcttcgcgacgttcgacaacgcttcctgcgcgacgcggaataccgcgagtgcgccggcgccggcgacctgcgtcaggcgcgcatcggccgcgcacacgaagctggtgcgcaggcccgtgcgtgccgcatgagtgtcgacccacgacgacaacgcgccgaccacgcccgcgtcgagcgccggcgtgtcgcgctcgtcgatcagccggcgattcgcgtcggttgcggcgtcgagcgcctgctgcgccagctccagcgcgcgcaggcaaccgtccggcgcgtcggccggcagccacgtttgaacgtttgcgagcgcgaaacgcgcggcggtgagttcggcgccgagcccgtcatgcaactcgccggccaggtggcggcgagcggcttcgtcggcggcgagcaattgggcagacagcgctgcgatccgcgcggcggaggcgccgcgtttcggcgcggcgtcggtaatgggcggagtcgcggcgcagcccggcacgagctgttgcgacgggaacggggcgtgggcgcccaaaggcgcgttaagcgacgtatccatgactctccctgctgtcagaaagcggttcagacaccggctggctgcgtggatcggctgccgtttcgaagacggtcgccgccagagaatcgcccctgccgaggtaacaaaagttacgtcttgtaacacttgcatccgacccttccactctcatccgaacggcaaccacgcgcggcgaataatatctcaaaatttccgaaaaggtcatgtcgggcggacatttaagggtaaatgtgaataatcggaatgaacgtgttgtaggaaaacactgacacccgagcaccggacgatgacgtatccaaatgtaactatttgagatgggatgatcccaatttgttacgaattcgccaagtagggacgaaaaaaacggagctttcgctccggttcttgatgacgcgcaaatctggggatcgatcagtccacgaatgcgcgttcgatcacgtagtggcccggcgcgctgttcttgccttcgacgaggccggcctgcttcagcaggtcggtcgtgtccttcagcatcgcggtgctgccgcacagcatcacgcggtcgttttccggcgagaacggcgggacgtcgagatccgtgaacagcttgcccgtcgcgatcaggtcggtgatccggccttcgttgtcgaacgcttcgcgcgtgaccgtcgggtagtagacgagcttttccttgatgatgtcgccgaggtactcgtggcccggcaggtcgtgcttgatgtagtccatgtacgcgagctcgcccttcaggcggcacgtgtgcgtcaggatcaccttgtcgaagcgttcgtagatgtccgggtcgcggatgatcgacatgaacggcgcgaggcccgtgcccgtcgacagcatccacagcgtcttgcccggcagcaggttgtcggcaaccagcgtgcccgtcggcttcttgccgatcagcaccgtgtcgcccaccttcagatgctgcaggcgcgacgtcagcgggccgttctgcaccttgatgctgaagaattcgagatgctcttcgtagttcgggctgacgatcgagtaggcgcgcgcgagcggcttgccgtcgacttcgaggccgaccatcgtgaattcgccgttgttgaagcgcaggctcgcctcacgggtgcaggtgaagctgaacagcgtgtcggtccagtgatggacggattggacggtggcggtgtcgtatttgctcatggctttgaaaacggacgcgcgtagcgaacgcgagtaacgggcccaaaaacgggcaaaaaccgagtgcgacggcctgatcgaggatcggccggccggcgcgtcggacacgcgccttctcgatgacagacgattgaggaactcgttattttaccctgttggcgcggatcgcgggcttgcccccgcggctgcgcggatttggcgcaacgaattatttcaatctgctttcaattttcagcgctcggccgcgagtttcgcgccgaggccgacgagtgccacgccgcacagcgcgtcgagcgggcgccgcacgcgccggtagccacgctgcgcgcgcgggctcgcgaacaggtacgcgacgcacgaataccagccggccgacagcacgccgatcgtcaccagcaccgcgccgttgaaccacagcggcacgtgcgcgggcagcatcgcggcgaacacgctggtccagaacgcgcacgatttcgggttcgtcaggcacgtgaacaggccgctgcgatacgcgcgcaggtagtcgcgcgcgtgcggcgcggccagcggcgcgcgttcgtcgggcgcgtcggccggtgccgcgtcgcggcgcacgcccgagcgcagcagcttgacgccgaaatacacgaggtacacggcaccgccgatccggatcgcctcgtacagccattcgacctggtgcaacacggccgcgaggccgagcatcgcgagcgaggcccaggcgaccgacgcggtgccgacgccgagcgccgacgcggcgccgaggctgcgccgccccgcgagcgacagttgcgaaatcatgaagaaattcgggccgggggtgatcgcggcgacgagatagacggcggcgatttgcagcaggatcggcaggtagttcatggcggcgcggcccggcggcgggcgcgggaggaacgggcaagccgttaatgtagcgcgcgccgcgcgcgcgctttggccgggggcgaccggaggcgtgatcgactcgcggtcgcggtcgttgttgcgagcgttttgcagccgtttagccgttattgcggatcgaggcgcaggcgcgcgatgtacggcaggtggtccgacagccacgcggcctcgccggacggcgcgcgccattcgagcggcgtcagcccgcgcacgaacatcttgtccagcgcgagcgccggcgagaacgcggggaacgtgcggcccgattcgccgagcagcgtcgcgacctcggacaacccgatctcgcggaacagcgcgaccgaatcgttgcgccagtcgttgaagtcgccggccagcatcagcgggccgtcgcccgcgttgcgcacgatccagtgcgcgatccagtgcatctggcgcagccgcgcggcgcgcgtgagcgcgaggtgcgcgcacagcagcgtgaccggtcgcgcgcccgcgagcgtcgcccgcgcgaccagcagcccgcgccgctcgaagcggtgcgcggagatgtcccagcggccgccgaggtcgagcggatgcggcgacaggatcgcgttgccgtgccgccacgacggcttgaacacgttcggcccgagcgcgatctgccagtcgagcgcctgcgcgatctcggtggcctggcagtgccacacgtcgtcgaccgcgtcgtccatcggcgcgccgaagccggggcgagcatcgggcgcggcatgcggcgcgccatcgcttcctgcaggaaatacacgtcggcgtgcgtcgactgcatccagttgcgcatcgcgttccacgcggtgaagccgagcggcgagcggcccttgtgcaggttccagctcaccgcggtgacttcgtcgggcgcggcgtgcggttcggcgaacggcagggagagagcgtcggcggacatgacgctcaatccttcgcgacgtgcgcgcgcacgcggtacacgaggtgcggacgctgttcgacgagcgtccagtcggtccacgcgtcggcgccgaccgtcaggccggggtggctcgcgacgatttgccgcggcgacgcgggtacgcacggatcgctgcgcgtcgcgttttcgtcgtcgagcgtttcctgcacgtcgagcgcgagcgacacggtgttcgcgccggcatcgacggtgagcggcgcgaccgtcaccgagcgcgagcgctcggtcggcacgacgcgcgcggcattgccgcagccgaccggcacggcggacggatagcgatgggtatcggtgcgggtctgacccacggtggtgcgctgctggaacgtgtcgatggtctgaccgtcgcgtaccacctggatctcccacgcgacggaggccggcgcggggctctgcgcatgggcggcgagcgtgatgctcgcgagcaggacggccaggccgtgtttcagcatgaaacgtctccgggaacgcgcgatagcgggaacggacgcacatcttacgcccgatcgatttcggtcgtgatgtgacaggacgcgtcgcgacaggttcgccgcacgatgcggtcctgttcgaaaggtagggccgcgtcatgcgttttcaaccgaaaaacgcgcgaactccgcgacgctcgcgcgctcggtgacgaggcggttctcgatcgcgtcggggtccgcatggccgagcgacatgccgcaaaccaactgttcgttggcgggaatgccgaggtgttcggtgatgatccggtgaaacggcacgaacgcggcctgcgggcaggtatcgagcccgcgtgcgcgcgcggccgtcatcacgccttgcaggaacatcccgcagtcgagccatgcaccgtgggtcatcacgcggtcgagtgtgaagaacagcgcgaccggcgcatcgaagaaacggaagttgcgcgcgtgctgcgcgtgcatgcgcgccttctcgtcgcggccgatgttcaacaggccgtacaggtcccagccgaccttgcggcgccggtcgatatacggcgacacccactcgcgcgggtagtagtcgtactcggcgacgtatttctcgtcgcgcgcgggatcgtcgtgggccgcggtgagcgcggcggcgagcgcgtcgcgcgtggcgcccgtcgcgacgtacacgcgccacggctggatgttggtgcccgacggcgcgcggctcgcggcttcgaggatcgcctcgagcgtgtcgcgcggcacgggcgtcggcaggaacgcgcggatcgcacggcgcgacgtgagcgccgcgtcgacggcgccggtcgcatcggcatcgacgcgcgggaaagcagtggggacggacatcggcataccttcggggcgagatccgacgcgccgcgcgggcgccgtcggccgggccggtgcggcgggtgggtgaaccgacgatcatacgccgcggtgcgccggcgtgcagcgcgcgcgggtgttagcagcacacgcgcgtggctgcttgcttgcgcggggatgcgggatcgctacactgaaatcgtaagggtctgatgatcgtgtgacagcaagcggcagcgaggttggtatgacgacggcgatggtgaaacaggaactggcggtggcgtccttcagcacggtgtacgacctcgagcaggtcgagacggcgctgagcgacctgaacgagagcgcgagcgacgcactgcgcgccacctacgagaagatgctcaagacgggcaatctgcgcttttgcgtgaagccgaaccggatgccgtcgttcgaagcgctcggcgaggcattgcccaatttcgccgagccgctcgacgacgtgcgcaagcagatcgcgctgtgcctcgaaacggacgaccggctcgaactgatgccgatcctgctgctcgggccccgggcatcggcaagacgcatttcgcgaaagcgctcgcgcgctgctcggcaccgcgtaccactacgtgccgatgagttcgctgacggccggctggatcctgtcgggggcgtcgtcgcaatggaagaacgcgaagcccggcaaggtgttcgatgcgctcgtgaacggcagctacgcgaacccggtgatcgcggtcgacgagatcgacaaggccggcagcgatgcgcaatacgatccgctcggcgcgctgtacgcgttgctcgagcacgacaccgcgcgcgcgttcatcgacgaattcgcggaagtgccgatcgatgcgggcaacgtgatctggatcgcgaccgcgaacgatgcgcaagcgatcccggagccgctgctcaaccggatgaacgtgtacgagatcgagccgcccgatgcggccggcgcgcgccggatcgcgcagacgatctacgacgagatccgcacgtcgcatgcgtggggcggcgcttcccggataccctgggcgacgacgcgctcgacgtgctggccgcgacaccgccgcgcacgatgcgccgcgcgctgctgcacgcattcggcgccgcccggctcgacgggcgcgacgcgatcgggccgcgcgacatccgggccgacgagggcgccgcgaagcgccggccgatcggcttctgaaccggcggcgcgtgcccggcggcgcgtgcccggcggcggcacgcgcgcgccgtgccgtgcggcgtgcaccgtgtcgtcgcgacgcggtgcgcgaccttcggcaagcgggagaaccgggacgtacaattctcttctctccctcgacgcgctaacggcgcgaaacgtcatggagcagatggattgtgtcgtgatcggcgcgggcgtcgtcggtcttgcgattgcgcgcgaactggccgcgcgcgggcgtgaaacgctcgtgctcgagtccgccgatgcgatcggcacgggtacgagctcgcgcaacagcgaagtgattcatgcggggctctactatccgcgcgggtcgctgaaggcgacgtcgtgcgtgcacgggcgcgacctgctgtacgaattctgcgagacgcatcacgtgccgcaccggcgcaccggcaagctgctcgtcgccacgagcgccgcgcaggtgaagcagttgaaggcgatcgccgcgcgcgcggccgaaaacggcgtgctcgacctgatgccgctcacgcgtgccgaggcgcagacgctcgagcccgcgctcgaatgcgtcgaggcgctgttctcgccgtccaccggcatcgtcgacagccaccagctgatgctcgcgctgctcggcgacgccgagcgcgacggcgccgtatgcgcgctgaaatccccggtcgaatcgatcgacgtgctgcgcggcgggcgcttcgtcgtgcgcacgggcggcgacgcgcccgccgagatcgaggccgcgtgcgtgatcaacagcgcgggcctcggcgcgcaggcgctggcgcgccgcacgcgcggcctcgacccgcgctgggtgccgccgctctatctcgcgcgcggcaattacttcagcctgtcgggccgcgcgccgttctcgcacctgatctacccgatgcccgatcgcgcggggctcggcgtgcacctgacgctcgatctcggcgggcaggcgcgcttcggcccggatgtcgagtggtgcgattcgctgcgctacgaagtcgatccggcgcgtgcgaccgcgttttacgcgtcgatccgcgcgttctggccgggcttgcccgacgatgcgctgcagccggcgtacgcgggcatccggccgaagctcgcggggccgggcgagccgccggccgatttcatcgtgcagggcgccgcgcagcatggcgtgcgcgggctcgtgaacctgttcggcatcgagtcgccggggctcaccgcgtcgctcgcgctcgcgcagcgcgtgggcgacatggcggcttaccgctgatgtggcgggcgtgtagcgggcatgtcgcgtgtgcgtgtcggccaggttgcggccaaatggcagccgtgtgaaattccttatctctggaatttcggcgcgcacatttattcgcttgagcgttattctgtcgaacggctgtcgccagaacagctttcaaaccgataacgttggagcgagtccccatgaaaacatcccgtcggagtttcctgattacgagcattggtgccgtgtccgcgctggcgctgtcgcgcgaagcgctggccgatgcgccgatgctgtcggaaaccgatccgaccgccgtggcgctcggctacaaggccgatgccacgaaggtcgacaagacgaagtacccgaaatacgcagcgggccaggattgcgcggcctgcatgctgtaccagggcaagaagggctcggcctggcccgtgcggcgccttcccggcaagcaggtgtcggcgaagggctggtgcagcgccttctcgaagatgggttgaggcccgtgcggcatcgtgcgatgccgcattgtggcgaaaaccgcaaaacgcccgccgtcgaacgatggcgggcgtttttattgcttgaaaacggttccgtcgctttctacactcgctgcaaaccagcgcgccgcgggtacccgcgcgccgcgccgcccgacacggcgtactgacgaggacgaggcacgcatggcgacgattgcgaattcaacgaaaacgatccggcccgagcgtgcgctgaatcgccgcgcggtgttcgccgccgtgatcggcaacgcgctcgagtggtacgacttcacggtgttcggcttcatgacggtcgtgatcgccgagctgttcttcccgacctccagcgaatattcgtcgctgctgctgacaacggcgacgttcggcgtcgcgttcttcatgcgcccgatcggcggcatcgtgttcgggctgtacgcggatcgcgccggccgcaaggccgcgctgtccctcgtgatcctgttgatgacgggcggcatcttcctgctcgcggtcgcgccgccctatgcggcgatcggcatcggcgggccgatcctgatcgtgctgggccgcctgttgcagggcttctccgcgggcggcgaattcggcagcgcgacggcgctgctgatcgaggccgcgccgttctcgaaacgcggcttctacggcagctggcagatggcgagccaggcggccgcgctgctgatcggcgcgctcgtcggcgcggccgtcacgcgcgggctgtcgcacgatgcactgcgcagctggggctggcgcgtgccgttcatcctcgggctcgtgatcggcccgatcggcttctacatccgccgccatctcgccgattccgaagcgttcctgcatgcgcagcagaacgcgcgccgcgcgacgctcggcgaagtgttcacgcgccacccgcgcgaggtgctgtgcggcctcggctcggtgatcgcgctgacggtgacgatctacgtgctgatcagctatctgccgaccttcgcggtgaagcagctgaagctgccctacgcggaatcgttctacgcggtgatcgccggcaacctgctgctgatggtgctgtcgccggtcgcgggcgcgtggtcggaccgcatcggccgcaaggggctgtcgctgtggtcgctggtgctgacgctcgcgctgatgtatccgctgttcgcgtggctcgacgcggcgccgagcatcgcgcggctgatcgcggtgcaggtcgtgctgtcgatcacgctcgcgggctactacgggccgttcggcgcgatgattgccgagctgttcccggccaacgtgcgctcgaccgggctgtcgatcgcgtacaacgtcgcggtgatgctgttcggcggtttcgggcagttcatcgtcacgtggctgatcaaggtcacgggcacgccgctcgcgccgacttactacgtgatggcggggatcgcgctgtcgatcgtcgcggtcgcgttcgtgcccgcgcgcagcgccgatctcgacgcacccgcatgacgacatgacgatttgaagacggtcatcggatcgtttcgcaaaacgcaatgatgtgctgcggaacacgcggaaacggcgtatcgagccttcgtgttcgcgcccgaattgtttagttgccgaacgaaacttgcgcgagatgaacgaaattgtcgctcgcgcgcgttttcgcatttttacccacactaaacatcggcacaaacccgcgcggtcatgtagaagagtttttctccagcttgttgccacatcgttagctcaagtaatatccgcgtacgccggcccctggcgggccggttccgacctggagacctggaggaaacatggaatacaaccgtctgttgcacaccctgcgtgttaccgccattgcaggcgtggcagcggcatcgctcggcgtcgcgggttctgcattcgcacagattccgaacaaaacgctcgtctactgctcagaaggcagcccggcgggtttcgattccgcgcaatttacgaccggcgtcgatttcaccgccgccacgttcaccgtctacaaccgcctcgtcgaattcgagcgcggcggcacgaaggtcgagccgggcctcgccgagaaatgggacgtatcgtccgacggcaaggtgtacacgttccacctgcgccacggcgtgaagttccacacgaccgacttcttcaagccgacgcgcgaattcaacgcggacgacgtgctgttcacgttccagcgcatgctcgacccgaaccaggcgttccgcaaggcgtacccggtgtcgttcccgtacttcaccgacatgggcctcgacaagctgatcacgaaggtcgagaaggtcgatccgtacaccgtgaagttcacgctggccgagccgaatgcgccgttcatccagaacatggcgatggaattcgcgtcgatcctgtcggccgaatacggcgaccagctgatgaaggccggcaaggccgccgacatcaaccagaagccggtcggcacgggcccgttcatcttccgcagctacacgaaggatgcgacgatccggttcgacggcaatcctgattactggaagaagggcgaagtgaagatctcgaagctgatcttctcgatcacgcccgacccgggcgtgcgcgtgcagaagatcaagcgcaacgaatgccaggtgatgagctatccgcgtccggccgacatcgcgacgctgaaggccgattcgggtgtcgacatgccgtcgcaggcaggcttcaacctcggctacctcgcgtacaacgtcgagcacaagccggtcgacaagctcgaggtgcgtcaggcgctcgacatggcgatcaacaagaaggcgatcctcgaatccgtctaccagggcgccggtcaagcggcttccgcgccgatgccgccgacccagtggtcgtacgacaagaacctgaagatggccgcgtacgacaccgcgaaggcgaaggcgctgctggcgaaggccggctatgcgaacggcttcgagatcacgctgtgggcgatgcccgtgcagcgcgcgtacaacccgaacgcccgcctgatggccgagatgatccaggccgactgggcgaagatcggcgtgaaggcgaagatcgtcacgtacgagtggggcgaatacatcaagcgcgcgcactcgggcgagcaggacacgatgctgatcggctggacgggcgacaacggcgacccggacaactggctcggcacgctgctcggctgcgaagcgatcaagggcaacaacttctcgcactggtgctacaagccgttcgacgagctggtccagaagggccgcacgacgacgggccaggacgcgcggacgaagctctacacgcaggcccagcagatcttcgcgcaacagctgccgttctcgccgatcgcgaactcgacggtctaccagccggtgcgcaagaacgtggtcgacatgcgtatcgagccgctcggctacgcccgtttcgacggtgttggcgtgaagtaatacgcctgtcgtaagctgtcgcgaagaccggctaattcatccggcggcgggaggccaaaagcttcccgtcgccggtcgcacatttcccacaagaaaatacgagacgcatcatgttcacattcgtgttgcgccgcgtggggatggtgatcccgaccttcatcggcatcaccatcctggcgtttgcgctgattcacctgataccgggcgaccccatcgaagtgatgatgggcgagcgcggcgtcgatcccgcgatgcatgcggaggcgatgaaacgcctcgggctcgaccagccgctgcccatgcagtacctccactacatcggccgggcgctgcatggcgacctcggcacgtcgatcatcaccaacacgagcgtcgcgggcgagttcttcgcgcgcttcccggcgaccgtcgaactgtcgctgtgcgcgctcgtgttcgcgctcgcggtcggcctgccggccggcgtgatcgccgcgctgcggcgcggctcggtcgtcgatcacggcgtgatgggcaccgcgctcaccggctactcgatgccgatcttctggtgggggctgatcctcatcatggtgttttcgtcatacctcggctggacgcccgtgtcggggcgcatcgccgtcgaatacgacttccccatccgacgggcttcatgctgatcgacgcgctgctcgcgccggacgaaggctcgttcaagtcggcggtcagccacctgatcctgcccgcgatcgtgctcggcacgatcccgctcgcggtgatcgcacggatgacgcgctcgtcgatgctcgaagtgctgcgcgaggactacatccgcaccgcacgcgcgaaggggctgtcgcccgcgcgcgtggtcgtcgtgcatgcgctgcgcaatgcgctgatcccggtcgtcaccgtgatcggcctgcagatcggcacgctgctcgcgggcgccgtgctgaccgagacgctcttttcgtggcccggtgtcggcaagtggctgatcgatgcgatcggccgtcgcgactatccggtcgtccagggcggcatcctgctgatcgcgacgctcgtgatcgtcgtgaacctggtcgtcgacctgctgtacggcgtgctgaatccgcgcatccgccacacgaggtaattccatgagcaatctgcaaaacaccttgccgagcgaatccgcgccggccggcggccgtgcgctcgcgctgcgcgagttctgggccaacttctcgcgcaaccgcggcgccgtcggcgccgggatcgtcgtgatcgtgctgatcctggtcgcgctgctcgcaccggtgctcgcgccgcacagcccggtcgagcaataccgcgactacgtgaagattccgcctgcatggctcgcgggcggcaactggcaattcatcctcggcaccgacgaagcgggccgcgacatcctgtcgcgcctgatgttcggcgcacggatgtcgttctggatcggcttcgtgtcggtcgtgctcgcgctgatccccggcatcgtgctcgggctcgtcgccgcgttcttccagaagtgggccgacacgcccgtgatgcgcatcatggacgtgctgctcgcgctgccgtcgctgctgctcgcggtcgcggtcgtcgcgatcatcggcccgggcctcaccaacacgatgttcgcgatcgcgatcgtcgcgctgccggcctatgtgcgtctcacgcgcgcgtcggcgctcggcgagctgcagaaggagtacgtgacggcgtcgcgcgtggccggtgccggcacgctgcgcctgatgttctcgcaggtgctgcccaactgcacggcgccgctgatcgtgcaggcgacgctcggcttctcgtcggcgatcctcgacgcggccgcgctcggcttcctcggcctcggcgtgcagccgccgaccgccgagtggggcgcgatgctcgcgtccgcgcgcgactacatcgacaacgcatggtggatcgtgacgatgcccggcctgtcgatcctgatttcggtgctcgcgatcaacctgctcggcgacgggctgcgcgatgcgctcgatcccaaactgaagcggatggcatgacatgagcgagaacctactgaccatccgcaatctcgcggtgaacttcaacggcctgcccgccgtcgaccggatcaacctgtcgatcgcgccgggcgaggtggtgggcgtcgtcggcgaatcgggctcgggcaagagcgtgacgatgatggcgctgatgggcctgatcgacgcgccgggcaaggtgacggccgacgaggtcacgttcaacggcgtggacctgctgaaggcatcgccgaaagcgcgccgcaagatcgtcggcaaggacatcgcgatggtgttccaggatgcgctgacgagcctgaacccgagctacaccgtcggttaccagatcaaggaagtgctgaagctgcacgaagggctgcgcggcgacgcgctgcaccggcgcgcgctcgaactgctcgaccaggtcggcattcccgatgcgaagaaccgcatcgcgtcgttcccgcaccagatgtcgggcgggatgaaccagcgcgtgatgatcgcgatggccgtcgcgtgcaacccgaagctgctgatcgccgacgagccgaccaccgcgctcgacgtgacgatccaggcgcagatcatggacctgctcgtgaagctgcagaaggagcgcgggatggcgctcgtgctgatctcgcacgacctggccgtggtgtcggaagtcgcgcagcgtgtcgcggtgatgtacgcgggcgaggtcatcgagaccaatcgcgtgcccgacatcttccgcgcgccgcatcatccgtacaccgaagcgctgctcgccgcgattcccgagcacaataaggggcgcgtcgccttgccgcattgccgggcatggtgccgggccgcgatgatcgcccgtccgggtgcctgttcgcgccgcgatgcaagtacgtcgtcgacgattgccgcaaggcgcggccggcgctcgatacgctggtgccggccaacgatgcgatgcgtgcgcgctgcatcaagccgctcaatgtttccaacctcgacctgacgggaggtgcacgatgaatgcagtcaatcagacgcgtgccacgccgcacgacgaggaagccgtgctggtggccgacggcctcgcgaaacactattcggtgaaacgcgggatgttcgggcagggtacggtgaaggcgctgaacggcgtgtcgttctcgctgaagcgcggcaagacgctcgccgtcgtcggcgaatcgggctgcggaaaatccacgctcgcgcgccagctcacgatgatcgagacgcccaccgcgggccatctgacgatcgacggcaaggacgtcgccggcgcgaaccgcgagacggtcgccgacctgcgccgccgcgtgcagatggtgttccagaacccgttcgcgtcgctgaacccgcgcaagaccgtcgagcagacgctctccgagccgctcgagatcaacgcgaacctgacggccgccgagcgcgcgcagcgcatcgcgcagatcatgcgcacggtcggcctgcggcccgaacacgcgaagcgctatccgcacatgttctcgggcggccagcgccagcgtgtcgcgatcgcgcgcgcgatgatcctcgatccgcgcatcgtcgtcgccgacgagccggtgtccgcgctcgacgtgtcgatccaggcgcagatcctgaacctgttcatggatctgcaggagcagttcaagacgagctacgtgttcatctcgcacaacctgtcggtggtcgagcacgtcgcggacgacgtgatggtgatgtacttcggcagcgtcgccgagctcggcgacaaggcgacgatctacgcgcggccgcgccatccgtacacgcgcgcgctgatgtcggcgacgccggcgatcttcgaggaagaccgccgcgtgcagatcaagctgcagggcgaactgccgtcgccgctcaatccgccgtcgggctgcgcgttccaccagcgctgcccgtatgcggtcgagcgctgccgtgcggaggagccgcagctgcgcgaggtcgacggccggcgcgtggcctgccatcgggccgaggaggtagggaggcgaatgcctgaagcgttggcggcgcgcgcgtccggcgtgcgccgtgcgggggcaggcggcgcgcgcgtgatgcgcgcgtaccgctacgcgcggcgctggggcgtgcgtaccgtcacaggcgccgcgctggccggcgcatgcgtggcggccagcctcgtggttcccgtcgaatccgcgcgcgccgaagggcgcgcgccggccacctcaccgatccatccgtcgcaagtcccgccgcccggcatgagcctgccgggctttcacgcacccgccgtgtcgaacggcacggtcgcgagcggcgcggtgcgcgtgcagcccgcgcgcatgccgttctacgtcgcgaccaaggggcgtgtcacgctctacgtgctcggcacgctgcacacgggcgatccgtccgattacccgagcgcgcagccgttccggccgcgcatcctcgcggcgctcgccgcgtcgccgacgctcgcgctcgagctgtcgcccgacgacctgctcgaatcccaggacgacgtgtcgaagtacggtgtatgccgctacccgtgcctgcagcgcctgctgccggatccgctgtggcagcggctcgcggcgcgcctgcgcggcaacccggccgcgctcgccgagattcgcaagatgcggccgtggctcgcggcgctcgtcgtcgagacctacgattcgctgtcggccggcctgcagaccgagtacggcaccgaggcgcagttgcagaacgtgttcctgaagaagaagggcggccgcgtgatcgggctcgagacgctcgccgaacagatgcgcgcgttcaccgggctgacgctcgccgagcagcgcgagatgctcgcgcaggacatggtgcagacgcccgcacagaacgccgacgacatcaaggcgctgcaccgactgtggcgaattggcgacgccgatgcgatctcggcgtgggccgtcgcgaagagcgaacggctcgcgcgttcgaaggtgttgtcggcgtcgatcgacaacaagatcgtgtacgagcgcaaccgccgcttcgttgcacggatgacggcaatcgccgcaccgaaccggccgctgttcgtcgcgatcggcgcgctgcatctgggcggcccgcgcggcgtgctcgaattgttgcgccagcaaggataccgggtcgacgcgaactgatcgcgcccgacggcccgcaccgatcttccctgtttgattggcctcgcgcacccgcggcgaaacgcgtgcgcgtgggcggcaatcgataaggaaaacccttgaatcgtcggaaaatagcgtttaaaacgattgacatcccgttctgccaatatctattcttcaccccacaagttgaaaaatgaaaagaatagataagttctacggggtagcagaaataagcgcgggttagcgttgccggcacgtgaagcacgtgccggccgcggagtgtctgcatgcacggcggggccaatcatcgtcgtacaaaacatgcatgcaggccgacttgcagataaagcaacgttccgtcgtctgaccggggaatgcagtgatcgggcggcggcggacgtttttaatccggaagatttttccggtcaccgtcgaaagacggtttcgggggcgaatcgacagacggcgaagccgcagcgattacgccaacggaaaagcgccacgagggcgctttttctttgtgcgacggatcaggcagccggccgggtcacgtgcgttcgtcggcctgcagcatgccgggcgcgacgacgtcgacacccaccgcctcgagcgcggcacgaatccgtttcgcgaataccagcgcatgcggcccgtcgccgtgcaggcagacggtctgcgcattgagcatcacccactcgccgccgatcgcgcgcacctgacggctgcgcaccatgtcgagcgtgcgcgcgatcatcgtgtcttcgtcgtcgatcagcgcgccgggctggttgcgcggcacgagcgagccgtccgcgcggtagccgcgatcggcgaacacttcctccaccgcggcgagccccgcgtgccgcgcggccgcgacgaacacgctgttcgcgagcccgaagaccgcgagcgacggatcgaaatcgcggatcgcggacaccaccgcatcggcgatcatcgggtcgcgtgcggcctggttgtacagcgcgccgtgcggtttcacgtgcgcgatgcgcccgccctcggcctgcgcgatcgccgacagcgcgccgagctggtacagcacgcccgcgtagatgtcgccggccggcagctgcatttccttgcggccgaaattctccggatcgtgaaagctcggatgcgcgccgatcgccacgcctttctgcacggcccagcgcacgcagtcgcgcatcgcgttcgcgccgcccgcatgccacccgcatgcgatgttcgcggacgtgacgaggtcgagcagcgcctcgtccgaaccgcagccttcgccgagatcggcattcagatcgatttccatggtgttcctcgtccactgattgcgtggcccgtccttgctgctactgccttcggtactgctaccgccattgtcatgccgcgcgcgactgggcgcggcggcgcgcttcctcacgcaggtcgatcgccacgtcgatctgccgcagataggcacgttctgcggccaggcggcgcgcgcggcgtcgggtgtcgtgcgcacgaagcggaccggcaggttgagccgcgcctgcgcgagtttccacaggtccgcacggatcaccgtgccgatcttcgggtagccgccggtggtctgcgcgtcgtgcatcagcacgatcggctggccgttcggcggtacctggatcgtgccgggcagcaccgcatgcgacagcagctcggccggccgctcgcgcacgagttcgacgcccgcaagccgatagcccatgcggttgctgttcgccgtgacgagccattcctcgtcccagaacgcctgctgcgcatcggcggcgaacgacgcgtagtcggggcccggcagcacgcgcacgggcatcgcccatggcgcatgcgcggggcggtggcggcgcggcggctcgtcgacgcgcgcgaacgcgcaccacgccggcgcctttaccccgaattcgggcgcatcggccgcgaggcagcccatcccggccggaagcacgccgaccgggaggcgatcgccgtcgcgcagcgcgcggccgccgaggccgccgaagcgcgacgcgagatcggtgctgcgcgagccgagcatcggcagcacgtcgatgccgccggcgatgcacaggtagccgcgcatcccgcgtttcgcggccggcagcacgagcgtctgcccggcctcgaccggcaggctccaccacgaatatacgcgccggccgtcgagcgtggcgccgaactcggtgccggtgatcgcgatgcgggtcgcgcgcgtgaagcggaaggcggccgggccgatcgtgatttcgacggccgccgcgtcgggacggttgccgaccagccggttgccgacctcgagcgcgaggctgtcgagcgcgccgccctgcgcgacgccgagatggcgcgtgccgcggcggccgagatcctgcacggtggacagcgggccggcccgcaccacctcgatggtgcccggtgcgttgctctgggtcatcgcgcgtcgactcccgcaatggtgaagcgcacgcggtctccgggcagcagcagcgtcggctgcggccgcgccggatcgaacagcacgtgcgacgtgcggccgatcagttgccagccgccgggagacgtggccgggtagatgcctgtctgcgcgccgccgatgccgaccgagccggccggcacttcgaggcgcggcgccgcgcggcgcggcgtgtgcagcgcggcatcgagcccgccgagatacgcgaagcccggctggaagccgacgaagaacacgacgtaggcgccggctgcgtggcgcgcgacgacctcgtcggccgacaggccggtatgggcggcgacggccgccaggtcgggccggcggcgccgccgtactcgaccgggatttcgacctcgcgaccgtccgcatgctcgacgtcggccgtctcccacgcgtcgcgcagcgccggcgtgagcgattcggccgtcgtggcgagcgcgtcgaacacgatcgtcaggttgttcatgccgggcacgacgtcgaccacgtcgggccacgcgcgcgcgacctcggcaacggcccagacgcggcgctggcaatcgagcgtggcgggcggcggcacctcgcagacgagggcggcatcgccgagcggataaatgcggggttgcgtcatcggactggcacggttcggacggcaatgttagcgcacattgtcaataaaatatcgacaacttcccaataagcgttttcgcctagcccggatgtccgggcttctggcgtacactcggcacaccctgtcatccggcttgctccgtctttacatgaagcgtcctgcgaccaagatcgtgtcatccgaacacctcgtttccgattcgagcgcggagctgtcggagctcgaatacgggctcatcatggcaggcaacgcgttcaaccggtggatggtgcgctgcatgtcggcggccggcgcgaaggacatgacggcggtcgaggtgtcgctgctgcatcacgtcagccaccgtgaacgcaagaagaagctcgccgacatctgcttcgtgctcaatatcgaggatacgcacgtcgcgacctatgcgctgaaaaactgatcgcccgcggctatgtgaagagcgagaagaacggcaaggaagtgttcttcttcgcgaccgacgcgggccgcgacctgtgcctgaagtaccgcgaggtgcgcgagcactgcctgatcgagacgctgaaggacagcgggctcaccaacgagcagatcggcgacgcggcgcagttgctgcgcaacgcatcggggctgtacgacacggccgcgcgcggcggcgtcgctgtaagcggttggcccgggtcgggccggggttgcgccggcggtggcgcgcggcaatgcgctgacgggcgtgcgacgacggacgccgtgccgcccgccgcatcatccggcggccgggtagagcgcgccgtcggtcacgatccagcgcagcgcgagatcgtgcgcttcggccggcagtgcatcgacgcggcacgcttcataggcgatgccgaccgtcacgggcggctggctgcccggccacgcggcgagcgtgcggtcgtaatagccgccgccgtagccgagccggtagcgctgcggatcgaatcccacacagggaatcagcaacaggtcgggcacgacgacgattcccgacgccggttccggaatccggtgatggccttcgcgcatcggcgtatgcgtgtcccatgcatggaactcgagcggcgtgtgccgctcgccgatcacgggcagcgcggcgcgccggccggcaccggccgcgcaccaggcgagcaccgcatcgcgcgcgtcgaattcgcccggcagcggccagtagaacccgaccgtgcgcggcgcgagccgttcgagcagcgtgcgcagccgcgcgtcgagcgcggcgttcgcggcgggttgcgacgcggcgtcgcgacgcgcgccggacagcgttttgcgtagcgcaaccttcgggttcggcacagggttgcgtgctatgctttcgctcacttcgtgctccattcaaaacgatgtcgaacagccttttccgagtatatcgcgcggtcgcgctgacgctttcggccactgcgctcgtcgcgggcacggccgcgtgcgccgcaccgaacgacgatacggtctccggggacgaccagaccttcgtgcagcttcgtgaagccgcgcgccgcaacgacgccgcgaaagccgcgcagctcgcgtcgatgattccgaactatccggtaccgtcctacgtcgagtatttccagatcaagccgcagctgttcgattcgacgggccgcgcgcgcgtggatgcgccggacgcgcccgtgcagtcgttcctgcagcgctacgacggccaggcgatcgccgatcgcctgcgcaacgactacctgctcgtgctcggcgcgcgccacgactggcgcaacttcgacgatcaatacaagcgcttcgtgctcgacgacgacacgcaggtcaagtgttatgcgctcgaatcgcgcgcggcgcgcggcgagaacgtcgccgatgcggcacgcgcgctgctcgtcgagccgaagaattacggcgacgcatgcgtcgacctgatcaccgcgctgacggtcaaccagcagttcacgagcgacgacgtatggcagcaggcgcgcctcgcgtacgagcagaactacacgacgctcggcggcaagatcgtcgacgcgctcggcgcgcgcccggtcggcttcgaccaggcgacgagcgcgccgccgctgtacctcgcgcgcggcgtcggccccgacgcgacgtcgcaccagctcgcgctgatcgcgctcggccgcatggcgcgcaacgatccggacgcggccgccggcatgctcacgacggtcgcgccttcgctgaccaaacaggagcaggcgatcgcgtggggcgcgatcggctaccagggtgcgatcaagcgctcgccgctcgcgtcggtctggtacgcgaaatccgcgaatgcgccgctgtcgaacccgggctacgaatggcgcacgcgcgccgcgctgctcgccggcaactggccgatggtgcgctggtcgatcgagcagatgccgccgtcgctgcgcgacgatccggcctggatctactggcatgcgcgcgcgctcaagcagagcggcgacacgctgcaggcgaaccaggaattcgagcaggtcgccgggcagtacaacttctacgggcagctcgccggcgaagagctcggccagcgcacgacgatcccgccgcgcaagaaggtgagcgacgccgagatcgacgcgatgggcaagattccgggcttcgcgctcgcgcagcgtttctacgcgctgaacctgcgcctcgagggcaaccgcgaatggaactggccgctgcgcggatgaccgatcgccagctgctcgcggccgccgagtacggcaagcgcgtcgacctgctcgaccgcacggtcaacacggccgaccgcacgaaagccgagcacgatttcacgctgcgctacccgtcgccgtaccgcaacatcgtcgagcgctacgcgcagtcgacgggcctcgacaccgaatgggcgtacggcctgatccgccaggagtcgcgcttcatcacgagcgcgcgttcgtcggtgggcgcgggcggcctgatgcagctgatgccggccaccgcgcagatggttgcgaagaagctcggcctcggcacgatctcgcgcacgcagatgcacgacatcgataccaacatccagctcggcacctggtatctggcggacatctacaacaacttcgacagctcgccggtgctcgccacggccggctacaacgcgggcccgggccggccgcgccagtggcgccaggtgttgacgcagccggtcgaaggcgcgatcttcgcagaaacgattccgttcaacgagacgcgcgactacgtgaagaacgtgctgtcgaacaccgtttattacgcggcactcttcgagggcaaaccacagtcgttgaagaagcgcctgggcatgatctcgccctgatccgcactcttcacactgccgcgcgagacgcggcagtgttcaaggggctgttcacgctaataacgggcttgcgaacgtgccttgccggccgcaatgcggccggcaaggcacgttccctgtttggaaaaatcatgcgcggggctggccccggaagggccgatcgccgcgtcatgctcctcgcgaatacgtcgagtaatcgtttcgtttcgtcgcaatccttgcgctcggcccttccggggccagcgcaagcccgttattagcgtgaacagccccttagaggtcccgaccatggatcgccagaccgtcgcgctgctgggcggcaccggcttcatcggcagccggctcgtcaatgcgctgatcgacgccggcaagcaggtacggatcggcacgcgccggcgcgaccacgcgcgccacctgcagatgctgccggtcgaaatcgtcgagctcgaagcgctcgacacgcgcacgctcgcgcgcttcgtcgccggcgcgcacgcggcgatcaacctcgtcggcgtgctgcacggcggccgcggtacgccgtacgggcccggcttcgagcgcgcgcacgtcacgctgccggccgcgctcgcgaccgcctgcaccgaggtgggcgtgcagcgcgtgctgcacatgagcgcgctcggcgccgattcgcatggcgcgagcatgtaccagcgctcgaagggcgacggcgaggccgcgctgcatgcgatcgcggcgaccgattcgctcgcgctgacgatcttccgcccgtcggtcgtgttcggccccggcgatgcgttcctcaacacgttcgcgaacctgcagcgcacgatgcccgtgctgccgctcgcgatgcccgacgcgcgcttccagcccgtgttcgtcggcgatgtcgtgcgcgcgttcgtcaacacgctggatctcgcggccgcgcacggcaagacctacgaactcggcggcccgaccgtctacacgctcgagcagctggtgcgctattgcggcacgctggtcggccggcaggcacgcatcgtgcggctgcccgacgcgctcgcgcggctgcaggcgagcgtgttcgaatgcctgcccggcgagcccgtgctcacgcgcgacaatctcgcgacgatgtcggtgccgaacgtgctgtcggggccgctcgcgccggagctcaggatctcgcccgcgagtctcgaaagcatcgcgcccgcgtatctcggccaggccgcgcagcggtcccggttcgactggttccgctcgcgccgctaggccggcccgggtgccttcgttcagcttcgtccttttcaccttctcgttttccggaacaccgtcatgaaactcgtcattggagacaagaactactcgtcgtggtcgatgcgtccgtggctgctgctcgcgcatttcggcatcccgttcgacgagatcgcgatcgagctgcgccacgacgatacggccgcacgcatcctcgagtattcgccgtccggaaaggtgccgtgcctgatcgacgaccacggcgtcgcgatctgggattcgctcgcgatcgccgagacgctcgccgaacgctatccgcagtttccgatgtggccggccgatccgctcgagcgcgcgcatgcgcgctgcgtcgcggccgagatgcatgcgggcttcgcggcgctgcgcacgcagatgggcatgaacgtgcgcgcgtcgatgccggggcgcggcgcgacgcctgatgcgctcgccgacgtcgcgcgcatcgacgcgttgtggagcgcgtgcctcgaggcgtcgggcgggccgttcctgttcggcgaattcgggattgccgatgcgatgtacgcgcccgtcgtgatgcgcttcaacacgtacgcgccgggcctgtcgccggacgcggccggttatgcggcccgcgtgacggcgctgccggccgtccagcgctggatcgacgccgcgcgccgtgaaacgaacgtgatcgccgaattcgaaccgcagccatgaacatctacgctgtaggcggtgcgatccgcgacgaattgctcggcgtgcccgtgcaggaccgcgactacgtggtggtgggcgcgaccccgagcagatggccgcgcagggtttccggccggtgggcaaggatttcccggtcttcctgcatccgcggacgcaggaggagtacgcgctcgcgcgcaccgagcgcaagacggcggccggttatcacggcttccagttccactacgcgccggatgtgacgctcgacgaggatctcgcgcggcgcgacctgacgatcaacgcgatggcgcgcgaggtgagcccggagggcgagctggtcgggcccgtgatcgacccgttcgacgggcaggccgacctgcgcgcgcgcgtgttccgccatgtgagcgatgcgttcgtcgaggatccggtgcggatcctgcgcatcgcgcgctttgccgcgcggttcgcggacttcacggtcgcggacgaaacgctcgcgctgatgcggcggatggtcgacgcgggcgaggttgatgcgctcgtgcccgaacgcgtctggcaggaaatcgcgcgcgggctcatggaggtgaaaccgtctcggatgttcgcggtgctgcgcgagtgcggcgcgctcgcgcgcatcctgcccgaagtcgatgcgttgtggggcgtgccgcagcgcgccgactaccacccggaggtcgacaccggcgtgcacgtgatgatggtcgtcgaccatgcggcgaagcagggttattcgctgccggtgcgcttcgcggcactcacgcacgatctcggcaaggcgacgacgcctgccgacgtgctgccgcgccatatcggccacgaggggcgcagcgtcgacctgctcaagccgttgtgcgaacggctgcgcgtgccgaacgaatgccgcgatctcgcgctcgtggtcgcgcgcgagcacggcaacctgcatcgcgtgatggagatgggcgcggccgcgctggtgcggctgttcgagcgcagcgacgcgctgcgcaagccggcgcgtttcgccgagatgctgcaggcgtgtgaatcggatgcgcgcgggcggctcgggctcgatacgcagccgtatccgcaggccgagcggctgcgcgtcgcgctcgcggccgcgcgcagcgtcgatgccggcgcgatcgcgcgcggcatcggcaacgacacggagaagatccgggaggccgtgcatcgcgcgcggatcgaggccgtcgcgcaggcgctcgagatcggcgaatagcggcggcgggacgggcgcgcgtcgcgcgcctgcaaagcccgttacggcttcttcttgcgtgccggcttggcggccgccacgcgtttgccggcggccgcgctcggtccggctgccgccttcttgtcctttttcacggtgccggcggcacgatcgcgatccgcccgttcgggcgccggcccgcggcggctcgtgcgcggttcgcccgccgcggcgcgcacgacggggccggtttcgcggtgtccatcgtcgcggacacgaacccggcgcgacggtcgtcgaacagcggcagcgtgccgaccgcgatcacctcggccggcccgtcgcccacgttggcgacccgatgccgcttgcgcgcgtcgaagtgcagcgagtcgccgggcgacagcgggtagttcttcctgccgatcgtgaagcagatccggccggccagcacgtacacgaattcgtcgccgccgtgcgccacccattccgagcggtagccttccatcatccgcaccttgagcgcgttgatctggctgccgtcgaacgtggtggacaggcgttcgtaccattgcgacgtggcgtcgagcgcatacgccttgcggctgccctcgtgcgaatcgggctgcacctggcgcggctggtcgatcagcgcgccgagcggcacgtcgagcgccttcgcgacgttgacgagcgacgacagcgagatgcccgtgagatggcgctcgacctgggacaggaacccgaccgacagtttcgcttcggtcgcgacttccagcagcgtcttcttcgcttcccggcgcaggcggcgaatgcgctggccgatacgcatgatgtctgaatccatgaatctctttcgcggcaacgaatcgggaggcgggcggacgggcggtgcagtcgccggacagggaattccgcgcaccgcacgaagcacggccgccggggcggcgatgccggcgcattgtaccgcgcggtgccgccggacgaacgcccgctgtgcagggatccgcaagcgtcatgccgattttagccctacgaaaatttcagcttgacctcgatttcagcgtgctctagattctgtcgcgcgcatcaaaaagttaagtgagacgaaaattttttaagggcctgccgccgggacggtacggcggcccggcgtcgtgccgcgccgggtcgagcgtcgaccgtgcagcggcgccgggccgcgtcaggcctgctttgggcctgctttgggcctgtaccccgccgcgtcaccgccggccgccgacaacaatgcataacgggcttccgatgatcgatcgactgaaatacagcttctccggccttccccgtacgacacgtccgtcgtcgacacgcaggcgggcctgtcgcgcctgctcgacgccgcgcggctcgacgcggtactggtcacgtcgcaggacgaatacgtgaccgagtacctgccgcgcagcaacaacccgcgttatgcgctgtcgggcttcgacggttcggccggctgcgggatcttcctgagcgcggcgaccgcgcaggcgctcggcgtgccgccgttcgtgctgttcgtcgacggtcgttatcacctgcaggccgagcagcagtgtgatccggcgcgcgtgcgcatcgagaagctcgggatgaacgtgacgatctggcaggcgatggccgactggctggtcgcgcacgggagccggctcgcacgggtcggctacgacgcgcggcggatcagcgtcgcgcagcgcgatcgcctgttcgagcagacgcaggccgcgtcgctcgactggacgagtctcgccgatcgcgagatcgatctcgcgatcgcgttgccgggctgggtcgtcgagcggccgatcttcgaggtgccggaagcgatgaccggcctgagcgtcgcgcagaacctcgacgcgctgaaccgcaagctcgccgcgcataccggcgcgccggacgacaggaccgccttcttcacctgcgcatcggacgacctcgcgtatctgctgaacagccgcggttatcacattccgaatgcgtcgtcgcacctcggcttcctgttcgcggtgggcgggcaggtggcgttgttcctgccggaaggctgcgaccgctgcgaggtcacgctcgagtcgtatccggtgctgcacgtgatccggcgcgatgtcgcggcgctcgagcgctttctcgcgccgttcgcagtcgatcacgtgtgctacggcttcgaatcggtgaactgcgcgctcgtcgacgcggtgaagcgggtgtggccgcaggcgcggcatgccgacttcaacccggtcgaggcgatgcgggccggcaagacgccggcggtgctcgaccggttccgcgacgcgtttgcgcgcagttccgcggcgatcgccgagacgatgcgctgggcgaagacgggcgagccgggcgtgcgccataccgaatacgacctggcgcgcaagatcaacgatgcatacgccgcgcgttcggcggttgcgctgacgtttccgtcgatcgccgcgaacggcgcgaacagcgcgttcgcgcattacacggcggcgagcgccgacgtcgagctgacggaaggcgaactcgtgctgctcgacagcggcgcgtattacgaagccggcttcgcgacggactgcacgcgcgtggtgctgcgccggacgcacccggatacggtcgcgcagccgtggcagcgcgagatctacacggtcgcgctgaaggcctgcatcaaggggctcgtcacgcgcttcccgagcacggcaaagggcggcgacgtcgatgcgctcgtgcggcaggtgtgccgcgatcacggccacgatttcggccacggcaccgggcacggcgtcgggattcacgtgcacgagggcggcgtgcggttcgcgccgggcgcgcagtacgggctcgtgccgaatgcggtgatttccgtcgagccgggcatctacctgccgggcaagggcggcgtgcggatcgagaacatcgtgatcatccgccaggacgacgcgcagccggataccgtgacgttcgagaacatcgtgacggtcggctacgactgggacctgatcgatctcgacctgctggacgacgacgagcgcgcatacctgcgcgactacgagcggctgtgcgtcgagcgcggcacgcaggtcaccgcgtgtccgctgctgtaggcaccgccgcccgcgccggtcagttcagcaggcgcgcccgcgcgaacggcgcgatccgctcggcgagccacgcgtgcgtgcgtgtcgtcgggtgcagcgtgtcccagaacacgaagcgcgccgggtcgcggcagtccgcacgcggcgtctgcgcgctcaggtaggtgagcgacgacggtttcgggatgtcgaggcacgcgcgcttcgcgtcgtcgaagccgtattgggccggatggctcagcaggtcgtcgaacagcgcgtacgcgtcgaacacctcgagccgcagcgtcgcgccgtaacgggcgcgcagcgcggcggccgcgtcggcgaggcgccggttgtagtccttcacctgcgcggcgacgctcgccgtgtcggtgcgcgtcgcgaacaccggtgcgcgcgacacgtccggcagcgtgacgagcatgatccgcgtcgcgccggccgcggcgagccgctcgaggctgtcgcgcaccgcattcgccgcctgctcgggcgagcgcccgtagttcaccaggtcgttgccgcccgcgaacaccgcgaacagcgtgttggcgggccggtagtccggcgcgcgatccatgtattcgcgccacgagtcgatctgctgcacgaggcccggcacgacgaggtactggtcggtcgccgcgccgccgatcgcccagttgtagaacggcagccgcagcgcgttcgcgagatattcggcccacaccgggccgttgctgaagcgtcccgcctgccagctcgtgccgttcggcagcttccactggctcgcgttgaacatgttctgcgtgtcggacaggctgtcgccgaacacgatcagcttgttgacgcgtgcgtcctgttgcgcggcgtcgagggtccacaccgtgtagttgaacgacagcgcgttgtttgccgcgaccgcctgcacgaggtcggacctgatgcctttcgcggccagcgtcttgcggcacacgtcggcgagcgtgtcctgcgtcgtcgtgctgtagaacatgttcttccactgcgtgatgccgtccgcccaccagtagccggacacgcgataccagtcgccgccggcgggtcgcgcgcccattcgtaggtcgcggccggcttcagcggatccgcgtcgatccggtaccagcagcgcaggtacgtgtaggtgtcggacccgcggcgcgacgcgcgcggcgtcgcgcccggcgtacccggcgcggccggcggcacgatgtcggggccggccggcgacagcgacatgtcgcccgtcggcacgggcagcggtgcggcgccggcggcctgcgcggcggaaagcgtcaatgcggcgcccagcgccgcgacggcggaaacggcggcggtgcggtatgaaaacggaatgcggaaatatggcatgcggccctcttctgattgttgtgacgggacggcggcgcggttgcgcagccgtgtatcggaagggaccgtgagtgccgggttcgagcccggtctgtcgaaatgcgggaggccgcgaatggcggcgaggtgctgcgaggtactacgcgatgctacgaggtgcggcagggaaggcagcggcgccgctgccggtcagtcggtgattcagcgcatgagcgccgacacgcgcccgtcggggccatagacgccggccggcgcgggtgccgagcgcagtaccgcgagcgcgcgctcgttgtagtccatccggatccggatcagcatcccgttgttcgcattggcctggcgcgcgcgttcggcggcctgttgcagcagctgccagcggccggcgaggcgcgcatcgcgctcggcggcctggtccatccccttcttgccggccggaaagccgagcgcggaaagctgggtgtcgcgcgtgcgttcgagctgcgcgagccggtcgatcagctcgctcttcttctcgacgatcccgggcagcatctcgagcggctgggccatcgtcagcgcctttcctcgtaggcgagcagggacgcgaacgcctcgaccgtcgcgtgttcgtcgttgaccgtggccagcagctcttctctcatcgcgtcatgctcgtcgcgccggcgcgggttgggcgcgccggcaaaccgggagaccggggaccggccgcgaggccggcttcagttgcccgggcgctgctgctgcagcagctcgcgggcggtattcaatacgccgtcggcgatcttgttcgcgtcgatcgtcaacgtgccgttgttcagcgcgtccttgatcgactggacgaggcccgtgtcgatatcggcgttgccggacgcggataccgaacgcaactggccggacagacccgacaggttcacggtcgtgtcgccgccggtcgaccctgcgtcggccgcctgcgcggacgaagacgaggccgtgccggatggcgcacgggtcgcgccgttgccggtcggcgccaggggctcgggttcggagtggaatcgatcttcacgatgtgtttcctgttcggtttgacccagataacggccgggtcggcccgaactttagcatcgcgagcccgaaatgctccgaataaacaattctttacattcttgccgctggatccgtccctacagcggaatctccacggtgccggcgtccttgacgatcgccgtgacgatctggcccgccgccatccgcaccctgaccgactggccgggcgcggcattcgccagcgcgctgccctcggccgaaatcgtgaaaccgggcccggccgcgacgacccgcaccgtctggccggccgacaccgacgccgcgctcttcagcaggtcctgccgcagcggcagcccggccgagatgcgcgcgagcgcggtcgagccgatcgcctgcgccggatcggtgatcaccgcgagcggcagcaccgtcaggtcgccgtcgcgggcgaccaggtcggccgcggagagcggctcgccgggcgcgatctggcgcgcggcgacgtaataggtggcctgcacggtcactttcgcctgcaggtagacggtccacggccgctcgcccgcgcagcgcacgccgactgtcgtgcggccccacaggcgcgcgccggtcggcatgaacggctcgagcgtcgtgcatgcggcgagcccgcgtggaaacgcggtcgtgaccgtcgcggtggtcttgccgggcaggcccgcgatctgctgctgcaggaacgcgagagccgcgcggcggatcgactcgggatcctgctggccgggcggcgtcgcgggctgggcggcattggctgcattggccgccggagccgcgttggcggaacccggcgtcgcgcgcggcgccggcaatgccgacgcggcgcgggcggccgccatgcgcgaggcgaaggccggctgcggggccggccgtacgggattcgatgcgggttcggccgtgccggcgacgaccgtcgcgatcgcagtcggatcggcggcgcgcggcgtgccgtatccggcgttcgcgcgggcggctgcgtaggtggggcggggcgtgggcgccggtgccaccgcggcagccggcggcgggacggtcgtcacgaccatcgtgccggccggttgcggcgcgtagccggtgccggcggcacccgtgccgctcgccgcacgacccgcgtccggcgcgaggcccgcacccggcgcgatcgccgcattcccgccgaactgcccgccgcttgccgcattggcgtgcgcgagcgcggtttcggccgtctcgccgcgcccgggaatcacgatcatcccgtcgtccgcgtgcgcggccggggcggcgatccacagcgccgcggcgagcgcaaacgcacgccggacgtgcatgagccgcccgttccttccgcgaagtgcgctgccagtcatcgcccgatccccgatccgttgctccgcttcgcattctagggagcggggccgtcgcgcaaacgatgaatagagggggcctttgccgcgttattcgcccgattgccggttgcgtccggcgcctaccatcgctgtcatggaaaaagcctcgggtcgccatccggcgcgaggggcgtgcagcgcttcatacggagagacgcacacatgctggacaaactcgatgcggaattcgcgttcggccgacaggcgctcgacgtgcgcgcctaccggcaggaactgctgtcgtcgaacatcgcgaactccgacacgcccggctaccaggcccgcgacgtcgatttcgcgtcgacgctcgcgcgctcgctgaagcaggccaatggcggcctcgcgccgagcaacgccgcgcaactgccgatgacgcagccggccggcgtgacgagcggcatgtcgatggtgtcgacggcggcgggccacatggccggcaccgcgaagctgatcccgacgggcggcccggcggacgactacggccgcgcgcagtaccggatgccgctgcagccgtcgctcgacggcaacacggtcgatctcgacgtcgagcgcgtgcagttcgcgaacaacgcgctgcactaccagaccgggatgaccgtgatgacccagcagatcaaggcgatgatcgccgcgatcacgacgaaccagtgacggcgcgcaccgcctccgaatccgagcaaaggagcttccatgccttcgttgatgaacatcttcggcgtcgccggctcggcgctgtccgcgcagtcgcagcgcctgaacgtcaccgcgtcgaacctcgcgaacgccgacagcgcgaccggccccgacggcaagccgtacaaggccaagcaggtcgtgttcgcgaccgacccgatcggcggcgcgcgcaccgcgtccggccagggcgtgggcggcgtgcgcgtgacgaaggtgatggacgacccgtcgccgatgaagtcgacctacgacccgtcgaacccggccgccgacgcgaacggctacgtgcagatgccgaacgtcgacccggtgcaggagatggtgaacatgatctcggcgtcgcgctcgtaccaggccaacgtcgagacgctgaacaccgcgaagacgctgatgctcaagacgctgacgatcggctcgtaagccgcgcgccgaccgaccttacagacccgacagttccgaaagtccagacagaaggccacccaggatgacttcctccagcacgacgatcggcagcaacggcacgaacgtgtcgaccctgccgaccgacacgatgaacaccaacaacgtgtcgtcgaccaacggcacgtcggcgagcgacctgcaggcgacgttcctgaagctgctcgtcacgcagttgcagaaccaggacccgaccagcccggtcgacagttcgcagatgacgtcgcagctcgcgcagatcaacacggtgagcggcatcgcgcagctgaatacgtcgctcacgtcgctgtcgtcgcagctcacggccggccagcagacgcaggccgcgctgctgatcggcacgaacgtgctcgcgccgggcaacgcggtcgcggtgaagggcggcgcggcgtcgccgttcggcgtgtcgctgtcgagctcggtgtcgaacctgacgatcaccgtgaagaacgcggcgggcaccgtggtgaacacgatcaaggcgggcgcgcagtcggccggcaccgtgccgttcaactggacgccgaccgactcggcgggcaacgcactgccggacggcaagtacaccgtcagcgcgtcgtacaccgacagcaacggcacgccgcagccggccacgacgctcgcggcctcgacggtgcagagcgtgatcaagcaggcggacggcacggcggggctcgtgctgtcgaacggcacgacggtggggctgacccaggtcgcgtcgatcttcccgaataccgcgtcgtcgtcgccctcgtccggcggcaccacctccaactgatactgatcgagcattctcgaaacggagaccgaaatgggttatcaacagggtctgagcggcctctcgtgcatcgaacgcgctcgacgtgatcggcaacaacatcgccaacgcgaacacggtcggcttcaagtcgagcaccgcgcagttcgccgacatgtacgcgaactcggtcgcgacgtcgaccaacacgcagatcggcatcgggacgcggctgaactcggtcgagcagaacttcggccagggcgggatcaccacgacgaactcgtcgctcaacgtcgcgatcaacggcaacggcttcttccagatgtcgaacaacggcgtgacgacgtactcgcgcgacggcacgttccagcgcgacaagaacggcttcatcatcgactcgcagggccgcaacctgatgggctacgcagccaacacgggcggcgtgatcaacaccgcgcagaccgtgccgctgcaggcgccgacgaccaacctcgcgccgaccgcgacgaccaagatctccgcgcagttcaacctgaactcgcaggacacggtgccgaccaagaagccgttcagcgcgaccgacaacacgacgtacaactactcgacgtcgatccaggtttacgactcgctcggcggctcgcaagcggtcaacatgtatttcgtgaagtcggcggccggcacgtgggaagcgtacgcgggcgtgcagggcggcgcgacgaacgacctcggcacggtcacgttcgactcgtcgggcgcgatccagagcacgacgacgggcacgccggccacgccgaccacgtcgctcggccagttccagttcacggtgccgaacaccgacggctcggcgacgccgcagaacctcacgctcgacctgaccggcacgacgcagtacggcggcaaggacggcgtgaacaacctcgcgcaggacggcttcgcgagcggcacgctgacgacctacacgatcggcaccgacggcaagctgaccggcaattactcgaacggccagaccgccgtgctcggccagatcgcgctcgcgaacttcaacaacccgaacgggctggtgaacctcggcggcaaccagtacgtggaaagctccgcgtcgggcgtgccgcagatctcggcgccgggcagcacgaaccacggcacgttgcagggcagcgcgctcgagagctcgaacgtcgacctcacgtcgcagctcgtcaacctgatcaccgcgcagcgcaactaccaggcgaacgcgcagacgatcaagacgcagcagaccgtcgaccagacgctcatcaacctgtaagcgcggataacgggcagccatggaccgactgatctacacggcgatgacgggcgcgtcgcagtcgctcgaccagcaggcgatcgtcgcgaacaacctcgcgaacgcgtcgacgacgggctttcgcgcgcagctcgcgacgtatcgcgcggtgccgatgaatttcggcgacggcagcaacatcgacccgacgacgacgcgcacctacgtgctcgcgtcgacgcccggcgccgattacgcgccgggtccgatcacgcgcaccggcaacccgctcgacgtcgccgtgcagggcgccggctggctggcggtgcaggcggccgacggcagcgaggcgtacacgcgcgccggcaacctgcacgtcgacgagaacggccagctcgtcaccgcgagcaacctgccggtggtcggcaacggcggcccgatctcggtgccgccgaacgcggaagtgacgatcggcaaggacggcacggtgtccgcgctgatgccgggcgacccgccgacggcggtcgcgatcgtcgaccagatgaagctcgtcaatcccgatccggccacgctcacgcgcggcaacgacgggttgttccgcaccgccgacggcaatccggccgacgccgacccgaacgtggtcgtcacgccgaattcgctcgagggcagcaacgtcaacccggtgaccgcgatggtcgcgatgatcgacaacgcgcgcgcgttccagcttcagtcgaagctgatccagacggccgaccagaacgagcagtcggcgaaccagctgctcaacttcagctgagcgcccgcgccagcttacgcaggagaatcgacaagtgaaccgttcgctctacatcgccgccaccggcatgaatgcgcagcaggcgcagatggacgtgatttcgaacaacctcgcgaacaccagcacgaacggcttcaaggcgtcgcgcgcggtgttcgaggatctgctgtaccagaccatccgccagccgggcgcgaactcgacgcagcagaccgagctgccgtcgggcctgcagctcggcaccggcgtgcagcaggtcgcgaccgagcgcctgtacacgcagggcggcctcacgcagaccggcaactcgaaggacgtcgcgatcaacggcgcgggcttcttccaggtgctgatgccggacggcacgaacgcgtacacgcgcgacggctcgttccagaccaacgcgcagggccagctcgtcacgtcgagcggctaccagatcctgccggcgatcacgatcccgcagaacgcgacgtcgctgacgatcggcaaggacggcgtcgtgtcggtcacgcaggcgggctcgaccaactcggtgcagatcggctcgctgcagatcgcgaccttcatcaacccggccggcctcgaggcgcgcggcgagaacctgttctccgaaaccacgtcgtcgggcgcgccgaacgtgtcgcagccgggcctgaacggcgcgggcgtgctcaaccagaactacgtcgaagcgtcgaacgtgaacgtcgtgcaggagctcgtcaacatgatccagacgcagcgtgcctacgagatcaacagcaaggccgtgacgacgtccgaccagatgctgcagaccgtcacgcagatgaagagctaaccggaaagtcccgtcgtcgccatgaagcaggttcgcctcctcccgtcagccaccgtccgcgccgcatgcgcggtcgcggtggcggcgctcgccgccggttgcgcgcagattccgcgcgatccgatcatccagcagccgatgacggcgcagccgccgatgccgatgtcgatgcaggcgcccggctcgatctacaaccccggctacgcggggcggccgctgttcgaggatcagcggccgcgcaacgtcggcgacatcctgacgatcatgatcgcggagaacatcaacgcgaccaagtcgtcgggcgcgaacacgaaccggcagggcaacaccgacttcaacgtgccgacggccggcttcctcggcgggctgttcgcgaaggcgaacctgtcggccgccggcaacaacaagttcgcggcgaccggcggcgcgagcgcggcgaacacgttcaacggcacgatcacggtgaccgtcaccaacgtgctgccgaacggcaacctggtggtcagcggcgagaagcagatgctgatcaaccagggcaacgaattcgtgcgcttctcgggcgtcgtgaacccgaacacgatctcgggcgcgaactcggtctactcgacgcaggtcgccgacgcgaagatcgaatactcgtcgaagggctacatcaacgaagccgagacgatgggtgcagcgcttcttcctcaacatcgcgccgtggtgatgacgatgcagaagaccctgttcgaccgcctgtcggcccgcgcgcatggcgccgcgcggctcgccctcgtgttcgcggcgatgccgcggcgtgcgtgctcggcgcggcgcccgcgcacgcggaacgcctgaaggatctcgcgcagatccagggcgtgcgcgacaacccgctgatcggctatggcctcgtcgtcggtctcgacggcacgggcgaccagacgatgcagacgccgttcacgacgcagacgctcgcgaacatgctcgcgaacctcggcatctcgatcaacaacggttcggccaacggcggcccgtcgtcgctgagcaacatcagctgaagaacgtcgcggccgtgatggtgaccgcacgctgccgccgttcgcgcggccgggcgaggcgctcgacgtcaccgtgtcgtcgctcggcaacgcgaaaagcctgcgcggcggcacgctgctgctgacgccgctgaagggcgcggacggccagctatgcgctcgcgcagggcaacatggcggtcggcggcgcgggcgccagcgcgaacggcagccgcgtgcaggtgaaccagctcgcggccggccggatcgtcggcggcgcgatcgtcgagcgtgcggtgccgaacgcgatcgcgcagatgaacggcgtgctgcggctgcagctgaacgacatggactacggcaccgcgcagcggatcgtgtccgcggtcaattcgagcttcggcccgggcaccgcgacgcgctcgggccgcacgatccagcgccgcgccggccgattcggcgcagcaggtcgcgttcatggcgcgcctgcagaacctcgacgtgagcccggacaaggccgcggcgaaggtgatcctgaacgcgcgcaccggcgatcgcaggcacgatgcgagctggctgcgcgcggcaacctgcgcacggcaaccgccggtggtccgcagcagccgtctcgcacgggaagacggtctcggccggcagtcgcaggcccagtcaagcaggtgatcagcatgcgcaggtggtggcggcggccgactcgaagacgccgtactggcgctgaaacgcgtggcgcatgaccgcccgcgcgagcaggcgatgaaggagcgcggctggcgcgccgacctggatcgatctgagcgattcgcatgagaatctcttcgaacggcagccggtgcgcgcttcgcctgcacgtcgagtcggcgcctgcagtcgaatgtcgcggcacccggcggtcgcgggttcgacggatgtcgatgctgctcgcatggcgacgttcgccgccggggacgattccgcacggaaggcgtcgaatcgaccaggctcgcgcagcagatgtcgacgcgggagcggccgtcgcctgacggccgatggctgcatccgatgcggcgcacgggccgggcggcgtggcggatcgcgtgcgcgccggtatcgggcgcggcggcccgcatgtccggcaatcggcctgacgcgatgaacgcgatggcgaacgctacgcgaacggcggcgcaccggcggcgcggcctcgcggccgtgacggttgcgctgacggcccgtcgctgaagggcgcgagcggcgtgcatgacgcccgcgttcccgaccggctcgccgggccggccgcgccgcgctgctgcaggcgcgcttcccgcgagaacctggccgcctatctcgtgccgtccgccgatccccacctgtccgaatatctgccggagcgctggctggcccgccgctggctgtccggcttcacgggctacggtcggcacgctggtcgtgaccgcggagttcgcgcgctgggtcgacagccgcgatgaccgcggccgatgccgaactggccggcacgggcgtgcaactgatgaagatgaagggcgggcagcggagcgcgccgcacgtcgaccggctacgcgcagaacgatggcggcgggggcgacggtcggcgtcgacggcgcggtgctcggcgtcgcggccgcgcgcggctgacggccgcgctgaacgcgcgcggcatcgcgctgcgcaccgacctcgacctgctcgacgcgatctgcccgagcggccggggctgcccgtcggcccggttttcgcgcaccggttgcccaggccgacacgacgcgcgcgagcaatgctggccgaagtgcgccgcgcgatgcgtgcgcagggcgcgcagtggcatttcgtctcgacgctcgacgacctcgcatggctgttcaacctgcgcggcgccgacgtcaacttcaatcccgtattcgttgcgcacgcaatgatcggcgccgatcgcgcgacgctgttcgtcgccgacggcaaggtgtcgccggcactggccgcgtcgctcgcgcaggacggcgtcgacgtccgcgcctacgacgcgcgcgcgcgccgcgctcgcggcactgcccgacggcgcgacgctgctgatcgacccgcgccgcgtgacgttcggcacgctcgaggccgtgccggccggcgtgaagctcgtcgaggccgtgaatccgtcgacgttcgcgaagtcgcgcaagacatccaccgagatcgagcacgtgcgcgtgacgatggagcacgacggcgccgcgctcgcggaattcttctcctggttcgaacaggccgtgaaccgcgagacgatcaccgaactgacgatcgacgagaagctcactgccgcgcgcgcgcggcgcccggctacgtgtcgccgagcttcgcgacgatcgcgggcttcaacgcgaacggcgcgatgccgcattaccgcgcgacgccggagtcgcacgcgacgatcgccggcgacgggctgctgctgatcgattcgggcggccagtacgtgacgggtacgaccgacatcacgcgcgtcgtgccggtcggcaccgtcagcgacctgcagcggcgcgatttcacgatcgtgctgaaatcgatgatggcgctgtcgcgtgcccgattcccgcgcggcatccgctcgccgatgctcgacgcgatcgcgcgcgcaccgatgtgggcggccgggctcgactatgggcacggcacggggcacggcgtcggctagaacgtgcacgaaggcccgcaggtgatctcgcattacgcgccggccgagccgtatacggcgatggaagagggcatgatcacgtcgatcgagccgggcgtgtaccgtcccggccagtggggcatccggatcgagaacctggtcgtgaaccgcgcggccgggcagaccgagttcggcgatttcctcgcgttcgagacgctgacgctgtgcccgatcgacacgcgctgcgtgctgatcgagatgctgcatgaagaagaacgcgcgtggctgaacgcgtatcacgcaacggtgcgcgagcgcgtcggccgccatctgagcggcgatgccaaggcgtggctcgacgcgcgcacgcagccgatctgacgcaacgcggaaagcggccgggtgccggccgaacaacaacagcgagggcgacgatggcggacacggcagtgatcgtggtcgacatgcaacgcgggctggtggagcgggcaaggcccgcgtaccggctcgatgacgtggtgtcgggcatcaaccggttgacggcggcggcgcgtgcggcgaacgcgcccgtgtttcgtgcagcacgacggcgacgcggacgacgacgtcgtgcccggcacgccgggctgggaactgcacgcggggctggtcgtcgggaacgatgactggcgggtgcgcaagcagatgagcgattcgtttcacgatacgccgctcgcggcgcaactcgagcgccacggcatccgttcggtgctgatctgcggttatgcgaccgagttctgcgtcgattcggccgcgcgccgcgcagcgctgctcggctaccggacgaccgtcgtgtccgacctgcacaccacgaacgagcgcacgcacctgtcggccgcgcagatcgtcgcgcatcatcacttcgtatgggaaaacaattcgctgtcgggcaagccggtgatgccgcgcccgctcgcggatgtccttgcgacggagttcgcatgacgatcaaggccgtggtgttcgatttcggcggcgtgctgatcgactggagccccgagtacctttaccgggaactgattcccgacgacaccgagcgtcgctggttcttcacgcatgtgtgcacgatggattgggtggtccgccaggacggcgggcagacgatcgaagagggacggccgagctcgtcgcgaagtttccggcgcacgaggggctgatccgcgcgttctatgcgcgctggcacgagatgatcggcggcgtgctcgacgaaggcgccgcgctcgtcgaccggctcgacgcgcaggggatgccgctgttcgggctgacgaactggtccgcgcagacgtttccgtatgcgtgggacaacttcccggtgctgcggcgtttcagggatatcgtcgtgtcgggccgtgtgaagctcgtgaaacccgatccggcgatctaccgcgagatgcatgcgcggatcgagccgcacttgccgggcatcgcgccgcacgaactcgtgttcatcgacgacaacgcgaagaacgccgcggccgcgacggcgctcggctggcacggcattcatcacacgagtgcggcggcgaccgaggcacggctgcgtgaactgggcgcgctggcgtaaacggcaagccgtcagccagccaccggataaaaacgggccagcggcccgttttttgttgttccgcttccggagcgaccagcctcggtgcccgttcctgcgttaccgcagtgccgggagccagccgcgccgcttagcggctgatcggcttgtagcgcagacgcttcggcttcgcggcttcctcgccgaggcgcgcacgcttgtcggcttcgtattcctgatagttgccgtcgaagaacgtgacctgcgaatcgccttcgaatgcgaggatgtgcgtcgcgatccggtcgaggaaccagcgatcgtgcgagatcaccatcaccgagcccgcgaattcgagcagcgcgtcttccagcgcgcgcagcgtttcgacgtcgaggtcgttcgacggttcgtccagcagcagcacgttgccgcccgagatcagcgtcttcgcgaggtgcaggcggccgcgttcaccgccggacaggttgccgacgatcttctgctggtcgccgcccttgaagttgaagcggccgatatacgcgcgcgacggcgtttcgtacttgcccaccgtcagcacgtcggcgccgcccgagatttcctcgaacaccgtcttcgtgccgtcgagcgcgtcgcggctctggtcgacgtacgcgagcttcacggtcggccccatcacgacttcgcccgaatccggctgctccttgcccgtcagcatccggaacagcgtcgacttgccggcgccgttcgggccgatgatgccgacgatcgcgccggccgggatcttcaggttcaggttgtcgatcagcagacggtcgccgaacgccttgctgacgttcttgaactcgatcacttcattgccgaggcgatcgccgaccgggatgaagatttcctgcgtctcgttgcgcttctggtattcctggctgttcagctcctcgaagcgcgcgatacgtgccttcgacttcgcctgccggcccttcgggttctggcgcacccactccagttccttcttgatcgccttctggcgcgccgattccgacgcttcttcctgcttcaggcgctcttccttctggtcgagccaactgctgtagttgcccttccacggaatgccgtggccgcggtcgagttcgagaatccactcggccgcgttgtcgaggaagtagcgatcgtgggtgaccgcgacgacggtgcccggaagcgcaccaggaactgctcgagccagtcgaccgattccgcgtcgaggtggttggtcggttcgtcgagcagcagcatgtcgggtttttcgagcagcagcttgcacagcgcgacgcggcgcttctcaccgcccgaaagatgctcgatctttgcatcccatgacggcaggcgcagtgcgtcggcggccacttcgagctgctgctcggggctgccgccgtcgctcgacgcgaggatcgcttcgtacttcgcctgctcggccgcgagcgcgtcgaagtcggcgtccggctccgcgtacgccgcgtagatttcctcgagcttcttgttggcctggaacaggtcgccgaggccttcctcgacggcttcgcgcaccgtcttcgtcgggtcgagctgcggctcctgcggcagatagccgatgttcaggttcggcatcggcgtcgcttcgccttcgatgtccttgtcgacgcccgccatgatgcggatcagcgtcgacttgcccgagccgttcaggccgagcacgccgatcttcgcgccgggaaagaacgacagcgagatgtccttcaggatctggcgcttgggcggcacgatcttgccgacccggttcatcgtgaaaacgtattgggccatttgggtgtgaaagtcagaaatggttgagactgccgcgcagcgcgggcgtggcggcgtcgggtgattcggtacggagcgtgccgcgcacggcgcggcggcgtcgccgcgtgtcggcggcgcgagcggctattgtacttcgccgccggccgccgctggcgcgacacctggcctttggccggggctgcgctcacagccacgcggcgacgccgccgtgccccgagcacgtgccgcgccgatggcggctgaagctgtaggtgccgtcgcggcagcgcgcgctcgcgccttcgggcacgcggcccgatttcgaatgcgcgggtgcgtgcacggtttcgccgtcgcggttgcgatacgtgtcgtgacggtcgagatcggcttcgttgccgtagccgggcggtgcgcggtacgcgtgtgcgggttagcaacgcggcgcaggcgacgaagaagacggcggacagtgccgcgatgcgtgtcgtgcggcagaacagggcaggcatggtctctcccggtcggcttgttgttatcgatgtcgggcggatggcccgcgccgcatgttagcggatcggcgcccggccggtaccggcgcggcggcgtgacgctacgccgcgcccgacatcgaggccgcgccgtcggcctgcgcggcctcgaggatccaccggcgaaaagcggtgaccttcggccgctcggcgtgatgcggcggatagacgaggtagtacgcgaaatcgtcgagccaggcggcgtcggcgagctgcacgagccggccgcttgccagctcgccgcgcaccatcgcggccggcagcagcccggcgccctggccggcgacaatcgcctgcagcaacaggcccgagtcgtcgaacgcgggccgcgcggcgggccgatatcgtcgatccgctgcgcgccgaaccagatgtgccagcccttgcgctcggcgtcatgcagctgcggccagccgaccagatcggcgggcgtcgccggcatgccgagccgcgcgacaaggtcgggcgacgcgagcgcgacgatctccaccgtcagcaggcgctcgctgcacaggccgatgtagcgcccgaggccatgacggattgcaacgtcgacgccgtcgcgcgaaaaatccgcgagtgcgtggctcgtgacgacctgcaggtcgacgtcagggcacgcgtgccggaattgcgcgaggcgcgggacgagccacgcggatgcgaagaacggggtgacgctcaccgtcagcacgccgctgtcggcggcgcccgacacgcgctgcgacgcgtcggcgatctgccggaacgcattgcgcaccggcggcaggtagtcgcgaccggcggccgtcagcaggatgccgcggttgacgcgctcgaacagctgcacgccgaggtgcgtctcgagcgtgcggatcatctggctcaccgcgccgggcgtgaccgacagctcctcggccgccgatttcaccgacaggtggcgggcggctgcttcgaatgcacgcagcgcgttgagcggcggcaggcgggaacgattcattgagtttttctaaagcgaatggccgatgaaatatcgtttgaggcggcgcgcgtgcacgagtaccgttgtcgcatccgattgcgtgcttgggggctgcattgcaacgaccaatgcgatcaacatagttcaactatatccacgaggcaaaccggacgccgtgacgtgtccggcgggacctgagaggagcatcgtcatgaaccgcccgggcgcatcgcgccatttctacggctggtacgtggtcgcggctgcgttcgccgtcacgttcgtcggattcggcagcgcctatacgttcagtgcgttcgtcgagtcgttgcagcgggacttcgccgcgtcgcgcggccagatctcgctcgtgttctcgctcgccggcttcctgtatttcggtttcggcatcgtcagcgggccgctggccgaccgcttcggctcgcggcggctcgccgtcgccgggatgctgctgacgggcgccgggctcgcggctgccggcgccgcgcacacgctgttgcaggtctatgtcgcgtacgggcttggtgtcggtttcggcgtcggctgcgcatacgtaccggcggtcggcgccgtgcagcgctggttcgtgcgccggcgcggcttcgcatcggggctcgcggtcgcggggatcggtgtcggcacgctggtgatgccgccgctcgcgtccacgctgatcgcgcaggtcggctggcgcggcgcgtatttcacgctggccgtgatcgcggtcgtgatcggcgcggggatgtcgctgctgatcgagaacgacccgcgcgggcggggctgctgccggacgggaggccgcgcatgagcccggcggcggggcgcaagtcgccgggcgcggtgcggggcctcggtgtccggtgccgccgcgggcgtcagccggtcgccgcttcggcgcctgccggcgcgacggtgcgcgaagccgtcatgtcgcggccgttcgcgagcctgtacgccgcatgcctcgcctgctcgttcggcgtgttcgtcccgttcgttcacctcgtgccgtacgcgctcgatcatggcgtcgcgccgtcgacggccgtgctgctgctcggcgcgatcggcgtcggcagcacggccggccgcttcttcctcggcggcctcgccgaccgcttcggccgccgtgcgtcgctgctcgcgatgttcgcgggcatggccgtcgcgctcgtcgcgtgggccggtgccggcaccgttgcgacgcttgccgcgttcgcgctcgtgttcggcgtgttctacggcggctgggtcgccgtgctgccggcggtcgtgatggactacttcggcgggcgcaacgtgagcgggatcatcggcgtgctttatacgagcgtcgcattcggcacgctgatcgggccggccgcggccggtttcatctacgacgcgggcggcggctatctcgtgccgatcctggccagcgccgccgcgaatgcgatcgccttcgcgatcgtcgcgacgacggggcgtgcgccggtggtcgcacgtgcggcgcgcggataggcgcacgtcccgcggcgtgccttcgcgaattccggtagggtggccggatcgtgaaccgaagaagtgcagccgggaggcctcatgacattcgacgaagtccgccagatcgcgctggcatggcgcggcgtcgaggaaggtacgtcgtacggcacgcctgcgctcaaggtgaggggcaagatgctcgcgcggctgcgcgaggacggcgacacgctcgtcgtgaaaggtgtcggccccgacgagcgcgcgtggctgatcgaatcggaaccggacgtgtattacgtgacggatcactacgtcggctggccgatcgtgctggtgcggctgtcggcggcccgtccggacgccgtgaaaaactgcttctgcgagaatggcaggccgtcgtccccgccaaatggcgcgacgagagggtgcacggcgcgaactgacacgccggttgcggcccgctgcccggcgtcgccgggcgctggcgcggctcgcgcgccggcccgaacgggtacgagcgttgcatcgatcgacgtcgatgcaacgagtggttccatcgaaattcttcaattggttcttagtgaagaaccgtttggtgcttacactccttcgcttcgaaggcagctgacgaaagccgacggaaacggcgcacgcgatgcgtcggcgcaccgcgcgccgcatcgcacccgcagcttcgcagactgcgcggcgcgccgatccgaacggtcccatccggccgcatggccgcgtgcgatgcacgcgcgctcgcagccggattcaagaacgacaactccctgctgccttcacgcgacacccggccataccggaaccgtttttggagagagacagatgagtggaagcaacacaggcctcggtacaggcctgaagcagcggcacgtgacgatgatgtcgattgccggcgtgatcggcgcgggcctgttcgtcggctccggccacgcgatcgcggaagccggcccggcgtcgatcctcgcgtatgcgatcgcgggcgtgctggtggtgctggtgatgcgcatgctcggcgagatggccgtcgcgcatccggacagcggttcgttctccacctatgccgatcgcgcgatcggccactgggccggtttctcgatcggctggctgtactggtggttctgggtgctcgtgatcccgatcgaggcgaccgccgccgcgaccatcctcaatgcatggttccccggcgttgcaacctgggtcttcgcgctcggcatcacgctggtgctgacggtgaccaacctcttctcggtcaagaactacggcgaattcgaattctggttcgcgctgatcaaggtcgtcgcgatcgtcgtgttcctgtgcatcggcggcgcggcgatcgtcggcatcattcccgcccctgcggtgtcgggcgtatcgaacctgttcgcgcatggcggcttcatgccgcacggtgccggtgcggtgctcgcggcgatgctgacgacgatgttctcgttcctcggcacggagatcgtgacgatcgcggccgccgaatcggacaacccgcaacgccagatcgtgcgcgcaaccaactcggtgatctggcgcatcacgctgttctatctcggctcgatcctgatcgtcgcggccatcgtgccgtggaacgatccgctgctgccgaagcacggttcgtatcagcgcgcgatggagctgatcggcatcccgaacgcgaaggcgatcatcgacgtgatcgtgctcgtgtcggtcgcgagctgcctgaattctgcgctgtacaccgcgtcgcggatgctgttctcgctgtcgaagcgcaaggacgcgcccgcgtttctgcaccgcacggattcgaccggcacgccgcgcgcggccgtgctcgcatcgaccgcattcgggttcctgaccgtgattgcgaactacctgatgccggaacaggtcttcggattcctgctcgcgacgtcgggcgcgatcgcgctgctcgtgtatctcgtgatcgcgatctcgcagctgcggatgcgcaagacgctcgaagcgaccggcgcggacctgacgctgcggatgtggctgttcccctggctcacgtggctggtgatcctgttcatctgcggcacgctgaccgtgatgctcgtcagcgaggatcaccgtatggaagtgggcgcgacggccgtgctggcgctgatcgtgctgctggcatcgtggctgaacaagcgcggccgcgatgcgcaggcgagcgcggggcggcgggtgtcggcgacgtgatgccgtgacgaagcggcggcggacgcacggtgttcgccgccggctggcagaacgtcctgcaatgaaatggcccgacggcgcttgccgtcgggccattcgtttttcgtgccgggcacgcgttgcgcgatgccgtgtgattcacacggcatcggccgatgcaagggtcagacgttgaacaggaagttcatcacgtcgccgtcgtgcacgacatattccttcccttcggcgcgcatcttgccggcttccttcgcgccttgctcgcccttgtacgtgatgaagtcgtcgaacgcgatcgtctgcgcgcggatgaagccgcgctcgaagtcggtgtggatcacgccggccgcctgcggtgccgtgtcgccgatatggatcgtccacgcgcgcacttccttcacgcccgcggtgaagtaggtctgcaggccgagcagcttgaagcccgcgcggatcacgcggtcgaggcccggctcctccatgcccatgtcggcgaggaatgcttccttgtcggcatcgtcgagatccgcgatttccgcctcgattgccgcgcacacggcgaccaccggcgcattttcgctttccgcgtacttgcgcacggcatccaggtgcgggttgttctcgaaaccgtcgtccttcacgttggccacgtacatggccggcttcgcggtgatcaggcagaacggcttgagcagcgcctcttcgtcgtccgacagcgcgagaccgcgcacggccttgccctggtcgagctgcgcgcgcaccttctcgagcaccgcgacgagcttcgccgcttccttgtcgttgcccgacttcgcggccttcgaatagcgcgtgagcgccttctcgacggtgccgaggtcggcgagcgcgagttcggtattgatcacttcgatgtcgtcgatcgggctgaccttgccggcgacgtgaatgacgttctcgtcctcgaagcaacgcacgacgtgcgtgattgcatcggtttcgcgaatgttggcgaggaactggttgccgaggccttcacccttgctcgcgcccgcgacgaggcccgcgatgtcgacgaactcgacgacggccggcacgacacgctccggcttgacgatctcggagagcgccttcaggcgcgtatcgggcacttcgacgatgccgacgttcggctcgatcgtgcagaacgggtagttctcggcggcgatgccggccttggtcagcgcattgaacagggtggacttgccgacgttgggcaagccgacgatgccgcatttgagactcatggaatccttcggacgggtaaggcggcgcggccggacagggcacggcggcgcgggaaaaagggcggccggcgcttggggcgcggcgggccgacggtcaaagacgctattgtaccgtgccgacgcccccggattgcgggccggcgccgaacggccgatgcggcgccgccgcgcggcatcggccgcctgcgattctgctgatttcccgcaaagtccggccgcgtaagggtttggccccgcggctataatgcccgccatgactgcccaccactccttcgacgtcgccgtggtcggcggcgggctcgtcggcaagactgccgcgctcgcgctgacccagtccggctacaagactgccttgctcgcccagccggccgcgccgcgccccgccgatctcgtattcgacacgcgcgtctacgcgctgtcttccagttcgcaggcgttgctcgagcggctgcgggtctggcaggcgctcgaccatggccgcctcgcaccggtctacgacatgcgcgtgtacggcgatgcgcacgcggaactgcatttttccgcgtaccaggcatccgtgccgcagctcgcgtggatcgccgaatcgtcgctggtcgaggcgtcgctcgacgccgcgctgcggttccagccgaacctcacgtggttcgaggcgcgcgcgcagggcttcgacgtacacgacgacgcagccgtgctcacgctgtcgtcggggcaggtgctggaagcggatctcgtcgtcggcgcggacggcgcgcattcgtgggtgcgctcgcaaatgggggccaaagtcgagcggcgcgactaccggcaaaccggtgtcgtcgcgaacttcaaggcgtcgctgccgcatcgcgagacggcctaccagtggtttcacgaaggcgagatcgtcgcgctgctgccgctgccggacggccatgtgtcgctcgtctggtccgcgcacaccgcgcatgcggacgaattgctcgcactcgatccggcgcagctcgcggccgaggtcgagcgcgtgtctcatggccaggtcggcacgctcgactgcgtgacgccggccgccggcttccgctggcgctgcagacggtcgacaagctgatcgcgccgcgcgtcgcgctcgtcggcgatgccgcgcacctgatccacccgctcgcgggacagggatgaacctcggcctgcgcgatgtggcggcgcttgccgacgcgatcgccggcaaggaaagtttccgcaacctcggcgatacggtgctgctgcgccgctacgagcgttcgcgccgcgaggacatccgcgcgctgatggtcgcaaccgacggcctgcagcggttgttcgcggtgccgggctcgctcgcgaaggccgtgcgcaatgcgggcatggccttcgtcggtgcgcagccgctcgtgaagcgctggctcgtgtcggccgcactcggctgatcgaaccttcggccgcttcgccggtcggacacggttccgttacggcgtacactgtgccgtgaacaccgattgagctgaaggaagatttcgatgaaaaacgatccgcatcgcgtcgctggcgctggccgtcacgatggcgacgcttggctgcaccgcgcaggccgaccagaccaccgacaagctgaaagccacgctgcaggcccgcctcggcaacgatgcgccgatcaagagcgtgtcgaaatcgccggtcgcgggcctgtacgaagtgaacctcggctcgcagatcatctatagcgatgcggcgggcgactacgtgctgctcggcgatctcgtcgacaccaagacgcacaagaacctgaccgacgcccgcctgtccgaaatcaacaagatcgacttcgcgagcctgccgttcgcgaatgcgatcaaggtcgtcaagggcaacggcgcccgcaagatcgcggtgttctccgatccgaactgcccgtactgcaagaagctcgagacgacgctgcagtcggtcgacaacgtgaccgtctacacgttcctgtacccggtgctgtcgccggattcgaccgcgaagtcgaaggcgatctggtgtgcgaccgatcgcgcgaaaacgtggagagctggatgctcgaccatcgcgcaccgaccggcgccggtacctgcgataccgccgcactcgacaagaacctcgcgctcggccgcgggatgaacgtcacgggcacgccgacgatcttcctgccggacggccgccgcctgccgggcgccgtatcggccgaccagctcaaccaggcgctcgcgtcgagcaagtaaccgaccagacgccgggccgcatggcccggccagcgaggcgcccgcgtgacctgccggcgcctctcttcgtttccgccgccgtattcgaccgtccgattgccacgatgacccagccgatccgctattcgattgtcccgaaagatcttgccgcgcacctgttcgaagtgtcggtgacggtcaccgatcccgaccccgaaggccagcgcttttcgctgccggtgtggattccgggcagctacctcgtgcgcgagttcgcgcgcaacatcgtgacgctcggcgcattcaacgacgcgggccgcaaggtgcggatcgcaaagaccgagcacacgtggcaggccgcacccgtgaacggcacgctgacgctgcgctacgacgtgtacgcgtgggacctgtcggtgcgctccgcgtatctcgacgaatcgggcggcttcttcaacgcgacggctgtgttcctgagcgtcgccggccgcgaggacgcgccgtgtgaagtcgacatcgggaagccggccggcgcggcgttccgcacgtggcgcgtcggcactgcgttgcccgaggcgcgcggcacgaagcgctacgggtcggcgcgtaccgcgcagcgaactacgacgagctttccgaccatccggtgacgatcggcgaattcgcgctggcgacgttcgacgcgcacggcgtgccgcacgacatcgtgatcgcggggcgtgtgacgcagctcgacatggagcgcctgcgcaccgacctgaagcgcgtgtgcgaagcacagatcgcgctgttcgagccgaaatcgaagaaggcgccgatggaccgttacgtgttcatgacgcttgcggtctgcgacggttacggcggcctcgagcatcgcgcgtcgaccgcgctgatctgcaaccgcaccgacctgccggcgaaggggcgacccgaaacgacggaaggctatcgcacgtacctcggtctctgcagtcacgagtacttccatacctggaacgtgaagcgcatcaagccggcggcgttcgtgccgtacgacctgacgcgcgagaattacacgtcgctgctgtggctgttcgaaggcttcacgtcgtattacgacgacctgatgctggtgcgcagcgggctgatgtcgcaggacgaatatttcgcggcgctcggccgcacggtcggcggcgtgctgcgcggcacgggccggctcaagcaaagcgtcgcggaaagctcgttcgacgcgtggatcaagtactaccgccaggacgagaacgcgaccaacgcgatcgtcagctattacacgaagggttcgctggtcgcgctcgcgttcgatctcgcgatccgcgcgcagacgcgcaaccggaagtcgctcgacgacgtgatgcgcctgctgtggcagcgctacggccgcgatttctaccgcggcaagcaggcgggcgtcgaggagaacgaagtcgagacgctgatcgaggaagcgacgggcgtcgcgctcggccgcctgttcaccgatgccgtgcacggcacgcgcgacctgccgctcgccgagctgctcgcaccgttcggcgtgacgctcacgccggatgtcgcgaacggcgcggccgcgaagccgacgatcggcgcacgcctgcgcggcggggcggactgcacgttcgcggcggtctacgaaggcggcgccgcgcatcgcgcgggctgtcggccggcgacacgctgatcgcggtcgacgggctgcgcgtcacgggcaccaacctcgacgcgctgctcgcgcgctaccggccgggcgacaaggtcgaggttcacgcattccggcgcgacgagctgcgcaccgcgaaactgaagctcgacggccccgaagtcacgcgctaccggctgacggcggccgcgaagccggcggcggtatcgaaggcccgggaagcctggctgaagggctgatcgtacgaaggcgggtatcggggcgcgatcgaggattgttctgttgttgcaacaatccgtcgccctgaacccgctttttcgcggtcatgcggccacgcacaatgacgtcactcgcgctaccgaagcgcaaccctactggagcctgacatgacgaccattctgcaaatcaattccgcggcgcgttcgcaaggtgcgcaatccacgctgctggccaacgaactgacggcaaagctgcaacaatcgaaccccggcgcgaaggtcgtggttcgtgacctgctggccgatgcgctgccgcactcgacgaatcggtgctcggcgcgttcttcacgccggccgacaagcgcaccgcggaacagaatgcgatcgtcgcgaagagcgatgcactgatcgccgaactgcaagccgccgacatcatcgtgatcggcgcaccgatgtacaacttcggcgtgtcgtcgcaactgaaggcgtatttcgactggatcgcccgtgcaggcgtcacgttccgctacaccgagaacggcccggaaggcctgatcaagggcaagaaggttcacgtggtgacggcccgcggcggcaagtacctgggtacgccgaacgacagccagacgccgtacctgcgctcgttcctcggcttcatcggcctgaccgacgtgaacttcattcacgctgaaggcctgaacctcgggccggacgcgcagagcgccgcgctcgccagcgcacgcgaagcgatcgccgccgcgtaaggaaggccgacgcgggtgcgacgcacctgctgcattaaaaaacgccgcgttcccgaaagggacgcggcgtttttgcatgcttgccggcacgaaggaaccggcagcgcgttacgcgagcgtttcggcgacttccggcaggcgccagtcgatcggctcgcggccggcatcgaccagatagtcgttcgcgagcgcgaaatggcggcaaccgaggaaaccgcggtgcgcggacagcggcgacggatgcggcgcctcgagcacgcaatgcgcgcttgcgtcgaacagcgcgcgcttcgcctgcgcgtgtgcgccccacagcatgaacacgagcccgcgatggcggccggcgagttcgcggatcagcgtgtccgtgcactgctcccagccgcgcttcgcatggctcgcggccgcgccgcgctcgaccgtcagcaccgtgttgagcagcagcacgccctggcgtgcccaggtgtcgaggcagccgtggcgtggcgtgtcatgaccgaagttcgcggcgatttccttgaagatgttgcgaagcgacggcggcgtgcgcacggcgggcggcaccgagaatgcgagcccgtgcgcctgcggcgtgccgcgatcgtcgccgtgatacggatcctggccgaggatcacgactttcacgtcgtccgggctcgtcaggcgcagcgcgcggaacacgtcggtcgggtagaccgtcttgccggccgcacgctcgtcgtcgacgaagcggcacagcggcgcatatgcgtcgctgtcggtaagggtttcagcacgtcgcgccagacggcaggcagcgcgtcgaattgcgcggcgaggtgcggaacgttggcggcggcaggctgcggggccgccggtgccgctggtgccgcagccgatgcggcggctttggcgggcttgcgcccggccgcgggcgctcggaaggcggggacggatgatcggccggtgccgtttccggcacgggatcgtcgaacagcgacgcctgttgcggcgcgcgggaagtcttgcgggttgccatgcgtgatgcgtgttattgcgcgcgcagccggtagccgcgctgcgcctgctgatgttttcgggagcgaggcccggcagcgcctgctgcagttcggcggcgagcgttgcgagcgccgcttccgggccgtcgatcagttcgagttcgatttcgctgatcggttcgcggcgcgtttcgtgttccgcctggacgacgatctcgccgatgtccaccgcggcttcgacggttgcgccgccgattgcgatgcgccacagcgtacgcgaaaaatccgtgcggaacagcgcacgcagcgcgccggccgcgtcattcagcgcggcggcggcctccggcacgtcgcaggccgcgacgagcgcatcgatctcgagcgcgtcgccggcgaccggcagctcccattcgtggcggcggtgcaggccgccttccgcgctgccgaccgtcttgaacgtctgcagccagccctgcgcgcgcggcgcacgcgcaccgcgctcttcgagcgggccagcgcgagatcgggcgtgtcgtagtagacgttcgcgagcgtgatgtcgtggccgggttcgccggtcagcgtctcgaagaagcgtcgcgcggcctcggcctggccggccggcagcgcgagcttgatttccttttcaatcgccatcagaagaacatccgtgcgagctcctcgcccggctggtcggcacgcatgagcgcttctccgacgaggaacgtgttcacgttcgccgcgcgcatcgtgtcgacatcggtgcgcgacaggatccccgactcggtcacgacgatgcggtccgccggaatcatgtcgagcatgtcgagcgtggtctggatcgacgtctcgaacgtgcgcaggttgcggttgttgatgccgagcagcggcgtcttgagcgtcagcgcctgttccatctcgttgcggtcgtgcacttcgaccagcaccgcgaggccgagcgagtgagcatacgcttcgagatcctgcatcagcggcgtgtcgagcgcggcggcgatcagcaggatcgcgtccgccccctcatcgcgcgcttccacgatctggtacgcgtcgacgatgaagtccttgcgcagcaccggcagcgtgcaggcgcgcgcgcgcttcctcgagatagcggacgctgccctggaagaactgctcgtcggtcagcaccgacaggcacgcggcgccgtgctccgcatacgaacgggcgatgtcggccggcacgaaatgctcgcgcagcacgcccttcgacgggctggccttcttgatttcggaaatcacggccgcgtggccggctgcgtgtttcgcgcgcagtgcgccgacgaagtcgcgcaggtcgcgcgcggaggcttccagtttcagtgcctcgagcggcgcgctgcgcatggccgccgcgacttcttcgcgcttgacggcgatgattcggtcgagaatgtcgctcatgtgggttcctgcttgattcgtaagggagtcagcgcttgaactgctgcgtgaagcgcacgagttcgtcgaccttcgcgcgggccttgccgctcgcgatcgcttcgcgggcgagctggatgccgtccgcgatcgattcggcgacgttcgccgcatagagtgcggtgcccgcgttcagcgtgacgatctcgcgcgcgacgcccggctggttgtccagcgcgccgagcagcatcgtgcgcgattcgtcggcattttccaccttcagcgtgcggttcgacaccatccaggccgaaatcttccggatggatctcgtattcgtgcaccttgccgtcgcgcaattcaccgacgagcgtcgcggcgccgagcgaaacctcgtccatccgtccttgccgtacaccacgagcacgtgctgtgcgccgagacgctgcatcacgcgcacctggatgccgacgaggtcggggtggaacacgcccatcagctggttcggcgcgccggccggattggtcagcgggccgaggatgttgaagatcgtgcgcacgccgagttcgcggcgcacggccgcgatgttcttcatcgccgggtgatggttcggcgcgaacatgaagcccatgccggtttcggcgatcgacgcggcaacctgctccgaccaggtcgatgttcacgccgagcgcctcgagcacgtcggcgctgccggacttgctcgatacgccgcggttgccgtgcttcgcgaccttcgcgccggccgcggccgtgacgaacatcgacgcggtcgagatgttgaacgtatgcgagccgtcgccgccggtgccgacgatgtcgacgaagttcgagttgtcctgcacctcgacgtggttcgcgaattcgcgcattacggtcgcggccgcggcgatctcgccgatcgtctccttcttcacgcgcagcccggtgatgatcgcggccgccatcacgggcgacatgtcgccgcgcatgatgagccgcatcaggtgcagcatctcgtcgtggaagatctcgcggtgttcgatcgtgcagcgcttcctgcggggtaatcgtcatcgtgaggtcccgtcaggcggcttcgcggctgcggcgcgtgcctgtttcaggaaattctcgagcagtgcatggccatgctcggacaggatcgattccgggtggaactgtacgccttcgatcggcagcgtcttgtggcgcacgcccatgatctcgccgtcgtcggtccacgcggacacctcgaggcagtcgggcagcgattcgcgctcgatcgcgagcgagtggtagcgcgtgacgtcgaaatgcttcggcaggtcggcgaacacgccgcggcagtcggtttcgatcttgcttaccttgccgtgcatgatggtcttcgcacgacgcggccgccgaatgcctcgccgatcgcctgatggccgaggcagacgccgaggatcggcttcttgcccgaaaattcacgcgcagcacgccgagcgtgacgctgttgcgggcgacgggcagacggcgtcgggattcaggcgcgcgatctcgtcgagcgtgatttcgtcgttgcggtaggtgcgtacgtcctcgccgagttcgccgaagtactggaccaggttgtaaaacgagtcgtagttgtcgatcatgagcagcatggtcagtctccggtcagaagtcgctatcgaggccgtcctggacctgttcggccgcacgcagcaccgcgcgcgccttttctctcttgccattcggattcgggcaccgaatccgcgacgacgccggccgccgcttgcacatacaggttgccgttgtggatcaggcccgtccggatcgcgatcgcgagatccatctcgcccgagaacgacaggtagccgacggcgccgccgtacaacccgcgcttgaccggctcgagctcgtcgatcagttccatcgcgcgcaccttcggcgcgccggacaacgtgcccgccgggaacgtcgcgcgcagcacgtcgtagttcgtcatcccgggtttcagcttgccttcgaccgagctgacgatgtgctgcacgtgcgagtatttctcgatgaccatcttgtcggtcacctgcaccgagccgatttccgcgatgcggccgacgtcgttgcgcgcgaggtcgatcagcatcacgtgctcggcgatctccttcggatcgttgagcagttcggtcgcgagttcggcatcgcgctcgggcgtgttgccgcgcgggcgcgtgccggcgagcggacggatcgtgacgatctggtcttcgccgcgcttctcctggcgcacgaggatttccggcgacgcgccgaccacgtggaaatcgccgaagttgtagtagtacatgtacggcgacgggttcagcgaacgcagcgcacgatacagcgacagcggattgtcgcggtacggcttcgtcagccgctggccgacctggatctgcatcagctcgccggccgcgatgtattccttcgcctggcgcacggcggccagatagtcgtctttcttgaactcgcggaaggtttcggtgcgcacgctcgccgacgtgacgggcggctgcacggtcgtgcgcaggcgctgtttcagttcgcgcaggcgctgtttcgccttcgtgtaggcttcggcctggctcgggtccgcgtagatgatcaggtacagcttgccggcgaggttgtcgatgaccgcgacttcctcggtcagcagcaactggatgtcgggcaggccgagatcgtcgcgcggcgcggtgttcgcgagtttcttctcgatgtagcgcaccgcgtcgtagccgaagtagccggcgagaccgccgcagaagcgcggcaggcccgggcgctgcgccaccttgaagcgcgcctggaacgattcgatgaactggaacgggtcaccttcatgcgtctcgacgacctggccgtcgcgcacgacttccgacacgccgttacgggtgcggacgagcgtgcgggccggcaggccgatgaacgagtagcggccgaagcgttcgccgccgaccaccgattccagcaggaacgagttggcgcccgcgcgttcgggctgggccagcttcaggtagagggacagcggcgtttcgagatcggcgagggcttccgcgatcagcgggatgcggttgtagccttcgttcgcgagcgattggaattcgagttcggtcatgttccggtcctgttcgggacgagcggcgcgtgcgccagggatcatttgacgctgcgcgggttgccgtcggcgaaagggcggtcgatcgagaagtgcctgttgccggccggcactccgggcgtgaacgtcgcgagcctgcggccgatcctgaacgcaagcgttcggacgcggtggaactcgaggtggtgcgacggtcggcgcgcggatgcgcagcgagataaaaacggcgctgaagacgtgcttcagcgtacctcatcgaagaggttagcgcgaccagcgacgccagggccaggctccccggtcgatgctgctcagactccgtttttattcagaaacatgcagatggaagaaataatcagatggttggccggccggtgttgtgcgcggtaattgcgcgagctgcgaccagcaacgaatcgactataccatccgaatttatcgtttgtatagctttgccgtggttgtagccgtacggcacagtcagcgtcgccatcccggccgcgcggccggccagcgcatcgttttccgagtcgccgatcgcgactgccgcatccgagcgacgccgagcgcgttgcaggccgtcagcatcggcagcggatcgggcttctgc

SEQ ID NO: 2 - DNA, 134720 bp, Burkholderia cepacia strain SSG
atgatcaggaaggcgaacacgccgcagacgagatcacgagcgcgagcgcgggccccgcgctctgcaaatccacccgcaccgaggaagaggccggtgccgatcgcaccgccatcgcgatcatctgcacgtgccgcggcttccagctgcttcgcgtaacctgcttcgtgcgatgcaaacatcgcgtcggggtcggcatgacgggaatccgcgccgccggcggaccggccgggcgctcgctgctgtggttcatcgtgagtctccgtagtttcttgatgtgtcgcccgcgcgcgagcgctgatgaaatgacggcccgccgggcgctcaacgcgcgcgccggcggccttcagccggcgtcaaagcacgcgcggccggatcagcgcttcgggctgaagcgcttcgtcgacctgcgcatcggtcatccactggcgttcgagaacgacctcgcgaatcgacttgccggtcgcgtgcgcttcggccgcgacggcggtcgcgcgcttgtagccgatgtacggattcagcgcggtcgcgagcgcgaccgagcgctccatcgttcgcgcagccgctcggggttcgcggtgatcccgctcacgcaacgctgcgccagcgtcgtgcaggcggccgtcaggtggctgaagctgcggaacagcgcgctggcgatcaccggctcgaacgcgttgagctgaagctgcccggcctcggcggcgaaggtcacagtcaggtcgttgccgaacacctcgaacgcgacctggttgacgacttccgggatcaccggattcaccttgccgggcatgatcgacgagccggcctgcaccggcggcaggttgatctcgccgaaccccgcgcgcgggccgctcgacagcagccgcaggtcgttgcagatcttcgacagcttcggcgatccgcttgagcacacccgagacctgcacgaacgcgccgcaatcctgggtcgcctcgatcaggttcggcgcggtgctcaggtcgagcccggtaatgcgccgcagcgccgccagcgccttctccgcgtactgcggatgcgcggtgatgcccgtgccgatcgcggtcgcgccgaggttgatctcgcgaatcagccagccggcttcctgcaggcgtgcaatgtcttccgtcagcatcaccgcgtaggtcgagaattcctggccgagcgtcatcggcaccgcgtcctgcaattgcgtgcggccgagcttcagcaggccggcgaacgcgtcggccgctccgcgaacgcatcgcgcaggcgcgccatcgcttcgagcaggtgctcgagcgcgaaacaggtcgcgacgcggatcgcggtcggatagacgtcgttggtgctctgcgcgagattgacgtgttcgttcggatgcaggtattcgtactgcccgcgcgcgtgccccatgagttcgagcgcgcggttgcagatcacctcgttcgcattcatgttggtcgacgtgccggccccgccctggatcgtcgacgacgaactggtcgtcaggcgcccttcgcgaatctcgacgcacgcggcggcgatcgcatcgcggtacggtcgcggcagcagcccgagctcgcagttcgcgtcggccgcggcctccttcacggcggcgagcgccatcacgaggtacggcagcgacgcgatggtgcggcccgaaatgtcgaagttctctttcgcgcgcagcgtatggacgccgtaatacgcgtcgtccggaatacttcgtttgcctaaaagatccgcttcgacgcggaagccgttttctgtcatcgtgccctcctggatgtctcgtaccgctcgtcgttcgccgcttcccgacgcgacgggttcgcattctatgcctttgcaaaaacaagctcgcttatgtattatcgaaagcggttttgcgtgggacgcaacagcgagaatcgaatgaaaaaaggcgcgagagaaaccggcatcgatcacatgggcgcgatgcgcgcgttcgtgagtggtcgaaacagggagttttcggcggtcgcgaaggagatgcacgtgtcgacgtcgacggtcgcgcgcaaggtcacggcgatcgaggaggcactcggcgtcgcgctgctgcaccgctcgacacagcgtcacgctgaccgaggccggccacatctacctggaacgcgccgtcacgctgatcgccgatctcgacgacacgctgcgtgtcgtcgccggtgaatgcgcagccgagcggcccgctgaagctcaccgcgccggttgcgttcggccgccgccatctcgcccgctggtcgcgccgtttctcgcgcgctacccgacgatccagctcgacgtgcgcctcaccgacaaccacaacgacctcgtggccggcggcttcgacctcgacattcacgaaggcgagaactacctggacaacctcgtcgtccaccgcctgtcgcgcaacgacagcatcctgtgcgcaacgcccggctatctcgaccgctgcgggcgccgtccacgccggacgacctcaagcaacacaactgcctgcgctacgtgcaccccgaaggcgatccgcgctgggagctcgtgaacggcgacgcgcatcacaacctgctgccggtcggcaacctcgtcaccgaccattcggagctgctgctcgaagcgacctgcgcggggctcggcatcgcggagttcgagatctggctggtgcgcgacctgctcgcgagcgggcggctcgaagccgtgctgccgcgctaccggctgctgaaccggctgacgggcgaatacatctacatcgcgtatctggcgaaccggcgcagctcggcgaagctgcgcgtcctgaaggactttctcgcggaacatcgcgcacatcggcgagctgtcagcgctggagctggggaagattcgcggcgcgcgcgtagcgcccgcgttcacgcccgcgcctgccagccggccggcaggcatgtgcccgccgccgcgctcggcccgcagcgcgggccgtcggcagcggcgcatccgcgccggtcaggccggctgcaattcgaacgggaacgtggcgtgcccgatctcgacgccctgcgtgttgcgcatcggcggccgatggaaagcggccagttgcgcgcgctgcccggccgtgccgatctgcaaccgctcgaggagttcgctgacgaccatgtagagcacgtcgagattgccgtcctcgatcttcaccgagatgccgagcgcgccatcggcgcccagttgccgcgtgcgcgccgacgcacacgccgatccgtagcacgcatcggcgccgagcttgccgaccacctgcccgtcgaacgctttcatcagcaccgtgcaatagcgcccgtcgccggccaccagttccggatacgcggtcatcgcacgatgaatgcgcgccagcgcacgcacgcgatcgctgattgcgtcaccgcccgcctccaccgtatccgcccgtcggccagcgatgcgtacaggcgcgccagccggtccagcggaaacgccggcgtcggcaggttgcaccgtcgatcgcccagcccacttcgtcctcgcgcagcccgcacgcatcggccatcacctgtttcacgcgcacctgcatcggatgctcgggcagatggtaatcggcgatcgcggcgccgatcgcctgcgcgccggccagcatcccgacatgcttgcccgaacagttgctgcatacgccggtcggcgtgtagtcgcgcttgatccacgcgcggtacaccgcgtcggacaacggcggatggccgccgcaacgcaagtccgattcctgcgcggcgacttttgcgagcatcgcgcgtgcgttcgatatgccggtcctcgctgctgtgcgacgcgcacatcagcgcgatgtccgcatcgtcgaagccgaagcgctcgggcgcgcccgtctcgattaccgacagcgcctgggccggcttcgccgccgaccgcgcgagcgtcatccggaacggatcgccgaaccgggccagcagcctgccgcgtgcatcgaccaccgccacatcggcgacgtgcgtgttctcgatcgccttgccgcggtacgtgacgactgctgcgcgttgggtgtccatcttatgttgtctccatgctcggggcctgcttgccggggcccttccaaccggtacggcagtgtagcgagtcgccgcgccacgccggcccggccatggaaagcggtgttgcatgcgacgcaaaggcgatcgcgccccacgaagacctgaccgaattagtacaaaaaccattcaatcgtttacagaattagtaccaatccgtagaattgcgaccgcaaacgcgaatcatacgcatttacattgacgttttccgatgttccgcactgcccggcctgcatcgagagacgcgcctgctcaccgaatcttctgctgcctctcgatatgcccgcccagttcaagacgaggcctcgcgccctcgtgtcggcgctgacctgctccgttttcctgacccgctgctcgcctccgccgaaacggcaccgcccccgccgccgaccggccggccccgtccgccgacgtgcaggcgacgctgccgacgatcacgatccagtcgtccgcgccgtcggacatgcaggtgaagcaatcgccgtcgtacaagttcaccgcgccgctgctcgatacgccgcgctcggtcacggtgatcccgagcaactgatcaaggaaagaacgtcacgtcgttcgcggacgcgctgcgctcggtaccgggcatcacgttcctcggcggcgatgcggccgcgaacccgtcggccgaccgcccggtgatccgcggcttcgaatcgcgcaactcgatcttcgtggacgggatgcgcgactcgaggctgcagaaccgcgaaacgttcgcggtcgagcagatcagcgtgatcaagggccccgattcggtctatgcgggccgcggctcggtgggcggcagcatcgacatcgtcacgaagacgccgaagaacgacgacttcatcaacagcagcatcggcttcggcaccgacggctacaagcgcgcgacggtcgacgcgaaccgcaagatcaacgacacgacggccgtgcgcctgaacgtgatgggtcacgacgcgaaccaggccggccgcaacgacgtgtacaacaagcgctggggtgtcgcgccgtcgatcgtgttcgggctgaatacgccgaccacggtcacggtcagctattaccacatgaactcgtacgacatgccggacttcagcgtgccgttccgcgcgtcgggcggcacgccggtgccgaccgatcgcgggcagttcttcgggttgaacacgcgcgactaccgctacgggcagaccgacaccgccgaagtgcgcgtcgagcacaagctcaacgacgactggaagctgaagaacacgacgatgttcggccgctcgacgctcgattacgtcgcgacgaacccgcagatcctcgcatcgaacccgaacatgctgagcctgcaggcgaagagcgaaatacgcgctcaacggcttctcgaaccagaccgaggtgaccggcagcgcgagcctgttcggcatgaagcacacgatgacggccggcgtcgagttcagccatgaacaggcgcgctacgagggctacctcgtgtcggattcggccggccacaacatccgctcgggcggcccgtgctcgtggccgaagcagctgccgctcgcgggcggctggaacgaacatgccgtggaccggcagcatcgtgctgaacggcgacaagggcttccccggcgcgacgacgaacacgcgcaccgacaccgtgtcggcgtacatcttcgataccgtgaagctgtccgagcgctggcagttcaacacggggctgcgcttcgaccgctacgacacgaccggcaaacaggccggcgtcgccgacctgtcgaacacgtcgaacctgttcagctaccagttcggcctcgtgttcaagccggtgagcaacgtgagcctgtatgcgtcgtacggcacgtcgtcgaacccgccggggtcgaacggcggcctcggcggcggcaccaccagatcaccgcgacgaaccaggacctcgcgccggagcgctcgcgcaacatcgagatcggcgcgaagtgggacgtgctgcgggatcaactgtcgctgacgtcggcgctgttccagaccgaagaccaacgcgcgcgtgagcgacggcctcggtcacacggtcaacgcgggcaagcagcgcgtgcgcggtttcgaattcggcttcgcgggcaacatgacgccgaagtggcacgtgttcggcggctactcgtacctgaacgcgatcacgaccgacgcgggccccggcaacccgggcgcatcgggcctgccgatggtgatggtgccgaagcacaacttcacgctgtggacgagctacgacgtgatgccgaagctcacgctcggcgccggtgcgacggtgatgagccagacctatgcatcggtgtccgcgacgacgaagaaatggacgcccggctacgcgcgcttcgacgcggccgccacctggcgcgtgaacaagacgatggacgtccagctgaacgtgcagaacctgttcgacaaagtattacgcgagcgcgtacccgatctacgcgacttgggcgccgggccgttcggcgatggtcacgctcaacttctatcagtaacgcggtcggcggcgggagggcgtggtacgcctcctcgccgcgctcaccacggcagcgaatacgtcttcacgttcgtgaagctcttcatcgcttcctgcacgccttccttgtaccccagccccgaatccttcacgccgccgaacggcgtcagctcgagccggtagcccggcacttcgcgcacgttcacgctgccgacttccagctcggtgatgaagcgcgtgatgtgatcgaagcgattcgtgcacaccgacgacgacagcgcatagtcggtgctgttcgacatcggatcgcttcgtcgatgtcgcggaaacgcatgatcggcgacacgggcccgaacgtctcgtatttcacgagcggcatgtcgggcgtcacgcgatcgatcaccgtcggcgaatacagcgcgccgtcgcgcacgttgccgaccagcagtcgcgcccgcgcgcgatcgcgtcgttcacctgccgctcgcagaacttcgcggccgcttcgtcgatcaccgtgcccatgtccaccgacggatcggccggattgccgtacgaccacgcacgcgtttttcaacgaccagcccggtgaagcgatcggccaccgactcgtgcacgagcatccgcttgatcgcggtgcagcgctgccccgagttcctgtacgaacccgacaccgcgagcgtgctcgcttcgtcgagatcggcgtcttccatcacgatgatcggatcgttgccgccgagttcgagcaccgcgcgccggtagcccatccgcgccgcgatcgacttgccgatcgagacgcgccgcccgtgaacgtgatgaggtcgatcgccgggttcgtgatcagttcgtcggcgatctccttcgggtcgccggtgagcacctgcaacatctgcggcggcaggcccgcttcgtacaggatgtccgcgaacaggtagcacgacagcggcaccttctcggacggcttcgacgatccggttgttggtcgcgacggacggcacgatcttgtgcgcgacctggttcatcgggtggttgaacggcgtgatcgccgaaatcacgccgagcagcggatcgcgctgcgtgtacacgcggcgcttcttgccgtgcggggtcaggtcgcacgagaagatctgcccgtcgtccttcaacacttcgccggcgccgaacgtcagcacgtcggccacgcggcccgcctcgtacgtcgaatccttgatgcaccccggcctcggcggtgatcagcgccgcgatctccgccgtgcgcgcacgcacgatgtcggccgcgcggcgcaggatcgccgcgcgatcgtggcgcgtgagcgccggctggtatgcatgcgcggccgcgaacgcgcgcacgtcgtcggcgtcgccttcggcacggtgccgaccagcgcgccgtcgtacgggttgcgcacttcgatcaccgcgtcgcgccacacgcgctgccgtcgatgcgcaacgcttcgtgccgcacgtcggatgcgggaatcggcttcaggaccgtgctcatgtcgtctccgttgtcgtgatgcgtgatcgtggccacgctaccgggtgccgcggcgcgtaccgcaccgaccagccagccttcgtattcgaggcagcggcacgacgtcgcccatgccggcgagtcgggccactcgcgcgcgccggtgtcgatgcggccgtccgtattcgcgcgatgcacgccagcagcgtatgcgcgatgccgctgcgtcgataggcgggttccacgtacaaccgcgcaagcgacggcgatcgcgcggcacgccgccgccgtcgtcgatgccgagttcgccgatcgcctcgtcgtcgcgatacgcgaccgccgtcgcgcgtgtcgtcgaacacgatgcggatcacacgctcgcagcgatcctgaacacgacgacgtgcatggcctcctccttcgcatcacgatgcgggcgaacgcgatgcgcgcacgccctcccgcgcccgcgtaccggggagttatccggatcgtccaggggcgacgagttgagtatcgtcttgccacgtcggcgcgcagtagtgccagacgacacctttcattgagtccacatccgcggcgcgacgcgcgtattctcgcgaaaccgcgcctctcgcgggccacgcgcacccggcgcgcaccgcctcgcgtttcccgtaccgatctggaggagaggcatgccgagtcgtaccccgaccgccctatgggcccagcagttccggcggtcgtcggcgtcgagcctgcaggaccagatccggcggatgctcgtggccgcgatcctcgacggccagctcgcccccgatgccgcgctgccgtcgagccgcgagctcgccgaccagctcggcgtcgcgcgcaacaccgtcgtgctcgcgtaccagatgctcgtcgaggagggctacctgatctcgcgcgaacgcagcgcgccgtgaacgaagatgctcgagggcgtgcccggcttcgcggcggccaagcccggcgagaaccggacggcgacgacgccgggccgccctgcgtgggaaagcgcatcgcgcatccgccgtcgaggcagcgcaacatcgtgaagcgcgaactggcagcactacgaatttcgttcatctacgggcaattcgaccagtcgctgtttccgaccaacgactggcgcgaatgctgcctgaaggcgctgtcggtgatggagatccgcaactgggcgcccgacctgatcgagcgcgacgacgaatcgctgatccagcagatccgcacgcgcgtgctgccgcggcgcggcgtgttcgcgatgcccgacgagatcgtcgtcacgaacggctgccagcaggcgctgtacctgatcgcggacctgctgtgcggcaagcgcacgacggtcggcttcgagaatcccggctatcccgacgcgcgcaacatcttcgagaaccgcaacgcacggctgctgccgctgcccgtcgacggccacgggatcgcgcccgatgcgctcgccgatacgctggcgcgctgcgactacgtgtacgtgacgccgagccaccagtgcccgaccaccgcgacgatgccggtcgaacgccgccgcgcgctcgactgcgcgcggcagcacatttcgtgatcgtcgaggacgactacgaggcgagaacacgttctccgcacgccgcatccggcattgaagagcctcgacacggccgaccgcgtgatctacgtcggcagcctgtcgaagacgttcgcgccggggctgcggctcggctacgtggtcgggccgcgcgagctgatccgcgagttgcgcgcgctgcggcggctgatggtgcgccatccggtcgcgtatatccagcgtgcattcgcgacctttctcgcgctcggtcatcacgacgcgctgctgcgccggctcgcgcatgcgtacagcgaacgctcgcaggcgcgctgatggccactcgatgcgcatctgccggaagcgcgtcacgtgcgtgtgacgggcggtgcgtcgtgctgggtcgagggccgccgtggctcgatgccacgcgcctcgcgaccgacgcgcaggcggccgggatcctcatcgagccggggaacgtgttcttcatggacgatacgggcgacgcgcgacgctgcttccggatggggttctccgcgattccgctcgagcggatcgagcctggtgtgcgggcgctggcggtgcgtgcgggcgcagccgggcgcctgaccggatgcggaagggcgtcgcgccaccgattgcgtgaccgccctcgcccctcgtgcacaatcacgcagccggaaacgatcccgactttcgttgcgcgggaagcatgccgccggtttcgcgcgcgtcgctcccgtgcgatgcgcgcaggtgccgatcgtaacgatcgatcgggttgtgctgccgggcagcaggctgcctttcgggtagaggtcgcgttcacgtgcgcacgcaacgtgcgcgccccgatcggcacgttgtttctcgccttgtcgtagaacccctgcattcgccacccgctcgctgaatccgttgcacccgccgataccgcgccaccgcctgcacatcgtttccactcgtttagtaaatctaataaaaacattacaaatccgttattcggattgacagcgaattcatacgaatcctagtgttacgacgcaacacgacagcaacaacccactgcgatcccgggattcgatcgtcgggatcgtcaaggcaaaggcatctccgactggaggacgatcatgagtcgattcacgacgctcgcggcgttgctggccgcggcgtgcgcattgagcgggtgcggaggcggtgacggcagcgacggaacggcggcgatactggccgcatccggcggaatcgtcggccggtgcggccgacaccaacctcgacgacaaccgcagcctgtcgttgacgcggtatgtcgacccggtgatcggcacgcgctcgcgagcaattcgccgaacccggtgccggcaggacgggctggcggcgtcgtgccggccgccgggctgccgtcgggcatggtgcaatgggcgcccgacaccgaacaccacgccggcgccgatcggcgcgctcggcgtgaccgacgtcgcgctgttcggacgcgtacgatccgctgatccgccatgcgcgtcgtcgcgtcgcccgacgcgcgcggcgcgctgccgggcgaaacggccgccgacgtcgcaggccgcgcgctcgcggacgtgcggcgcctgttcgtcgagcgcggcgaccggatcgccgcgctgatcgtcgagccgctcgtgcagtgcgcggccggcatggcgatgcacgatccgtcgtacgtgcgcggcgcgcgcgtgcgacgaattcggcgtgcacctgatcgccgacgagatcgcggtcggctgcggccgcaccggcaccttcttcgcgtgcgagcaggccggcgtctggcccgatttcctgtgcctgtcgaaaggcatcagcggcggctacctgccgctgtcgctcgtgctcacgcgcgacgacgtgttcgccgcgttctacgacgacgacacgacgcgcggcttcctgcactcgcactcgtacaccggcaacccgctcgcgtgccgcgcggcggtcgcgacgctcgacctcttcgcacgcgacgacgtgctcgcggcgaacgcgcgcaagtcggccacgctgggtgccgcgctcgcgccgctcgacgcacatccgcaggtacgccacctgcgcgagcgcggcacgctgttcgcgttcgacgtcgcgctcgacggcgatgcggcgcgcggcttctcgcgacgcttcttcgaacgcgcgctggaacgcgagctgctgctgcgcccgatcggcacgaccgtgtacctgatgccgccgtacgtgatgagcgacgacgacatcgcgtggctcgcgcaacgcacgcgcgacacgctcgacgccacgctcgcggagatcgcacgatgacgcacccgctgctcgacgcgctgcaacgcggcctcgccgacctcgacgcccagggctgcgccgcgtgcgccgcaccgccgacaccgcgtgcgacgcgcgcatgaccgtcgacggccgcgagatcgtcggcttcgccagcaacgactatctcggcctcgccgcgcatccggcgctcgtcgccgcgttcgccgaaggcgcgcagcgctacggcgccggcagcggcggctcgcacctgctcggcggccattcgcgcgcgcacgcgacgctcgaagaggaactcgcggccttctcgggcggcttctccgacgcgccgcgcgcgctgtacttcagcaccggctacatggcgaacctcgccgcgatgacggcgctcaccggcaagcgcgccaccgtcttctccgacgcgctgaaccacgcgtcgctgatcgacggcatgcggctgtcgcgcgcgaacgtacaggtctatccgcacgcggacacggccgcgctcgccgcgctgctcgacgcgtcggatgccgaaacgaagctgatcgtcagcgacaccgtgttcagcatggacggcgacatcgcgccgctcgccgaactcgtcgcgctggccgagcgccatggcgcgtggctcgtcgtcgacgacgcacacggcttcggcgtgctcggcccgcagggccgcggcgcgctcgcggccgccgcgctgcgttcgccgcatctcgtgtacgtcggcacgctcggcaaggccgccggcgtcgcgggcgcattcgtgatcgcgcacgagacggtaatcgaatggatgatccagcgcgcgcgcagctacatcttcacgacggccgcgccgccggccgtcgcgcacgcggtatccgcgagcctgaaggtgatcgcgggcgacgaaggcgatgcgcggcgcgcgcatctcgccgcgctgatcgaacgcacgcgcgcgctgctgcgcaatacgcgctgggagccggtcgattcgcacacggccgtgcagccgctcgtgatcggcagcaacgacgcgacgctcgcggcgatgcgcgcgctcgacgcgcacggcctgtgggtgcccgcgatccggccgccgacggtgcccgtcggcacgtcgcggctgcgcgtgtcgctgtcggccgcgcattcgttcgacgatctcgcgcggctcgaagccgcgctggtcgaagccagcgagggagccgcagcctccgctgacgcggccccgcgggaggtcgcggcatgaccgccccgctctcgcttttcgtcacgggcaccgacaccgaaatcggcaagaccttcgtgtcggccgcgatgctgcacggcttcgcgcggcacggcctgcgtgccgccgcgctgaaacccgtcgcggccggcgcatatgaacgcgacggcgtgtggcgcaacgaggatgccgaccagctcgacgcggccgcgaacgtcgtgctgccgcccgagctgcgcacgccgttcctgctgaaggcaccggccgcgccgcatatcgtcgccgcgcgggaaggcgtgacgctcgacatcgacacgatcgtcgcgtgccatcgcgaagcgctgacgcgcgcggatatcgtcgtcgtcgaaggcgccggcggcttccgcgtgccgatgaacgacacgcaggacatggccgatctcgcggtcgcgctcggcgtgccggtcgtgctcgtcgtcggcgtgcggctcggctgcatcagccatgcgctgctcaccgccgacgcgattcgccaacgcggcctcaagctcgccggctgggtcgcaaaccacgtcgacccggcgatgtcgttcccgacgagaacgtcgcgacgatgcgcgactggctcgcccgcgagcacggcgcgccgctgctcggccgcattccgcacatgagcccggccgcccccgaatccgccgcggcgatgctcgacatcgccgcgctcgtcgatacgctgcgcgccgcgcggcattgacccgacagaaacagatccccgatccctcatccccgaccaggacaggaaaacgatatgacccaagcccagaccgccgccaccgtgcaacccgacgcgattcccgtggccgctccggcctcgcaacgctggcgcgtcgccgacgtcgtcgcgctgttcgagctgccgttcaacgacctgatcttccgcgcgcagcaggtgcaccgcgagcacttcgacgcgaacgcggtgcagctgtcgacgctgctgtcgatcaagacgggcggctgcgaggaagattgcggctactgctcgcagtcgtcgcaccacgacacgggcctgaaggccgagaagctgatggacgtcgacgcggtgctggatgccgcccgcgcggcgaaggcgaacggcgcgagccgcttctgcatgggcgccgcgtggcgcaacccgaaggagcgccacatgccggcgctgaccgagatggtgcgcggcgtgaaggaactcggcctcgagacctgcatgacgctcggcatgctggaagacgaacaggcgcaggaactcgcgaatgcgggcctcgactactacaaccacaacctcgacacgtcgccggagttctacggccaggtgatctcgacgcgtacctaccaggatcgcctcgacacgctcgaccgcgtgcgcgacgccggcatcaacgtgtgctgcggcggcatcatcgggatgggcgaatcgcgccgcgaacgcgcgggcctgatctcgcagctcgcgaacctgaacccgtatccggattcggtgccgatcaacaacctcgtcgcaatcgaaggcacgccgctcgaaggcaccgcgccgctcgacccgttcgaattcgtgcgcacgatcgcggtcgcgcggatcacgatgccgaaggccgtcgtgcgcctgtcggccggccgcgaacagctcgacgacgggttgcaggcgatgtgcttctcgccggcgcgaactcgatgttctacggcgaccagctgctgacgacgagcaacccgcaatcgcagaaggatcgcgcgctgttcgagcgcctcggcatccgcgcgagcgacgcggacgcgatgtcggcgaacgcgtaagcggagcggccgtcgggccggatctgcaaacggaaaagccggggatgccccggcttttccgtatccggccccgtcgttcaggccgcgccgccgagcgcgcgcggctccatgaacgtgtgccggaaataatcgcgcaccgcgtgcatcgcgggctcaactcgatgtccttgcgccaagcaagaccgacgctcatcggcggcaccgcatcgcgcagcacgatcgtctcgatgcgccgcccttcgagcgaccacggccgatacaccatgtcggacaggatcgcgacgccgctgccattcgcgaccatgctgcggaccgcctcgaccgacgacgtgcgcaggatcacgttcggccggtacggcgtctcgttccagtaacgcagcgccgtctgccccgcctcgtcgaccgtcagcatcacgaacggctcgcgcgcgacttccgcgaacgtgacgctctcgtgcctgagcagcggatgatgcgcgccgacccacagccgccgcaccgagtgaatcaccggctccagcacgagcgccggattcgacacgttcgacgtgagcagcacggccatgtcgtagcggcccgcgatcagcccttcctcgatcgactcgcggttcagctcgtgcaggtggatcgtcagccgcggatacagcgtgttcaggcgcagcacgtggtgcggcaggaaatagccgagcaccgtgtagctcgcggcgatcgcgagcgtgccggccagtgtgctttcgaggttcggaatccgcatcgcctcgtcaaccgacgacaggatcgtgtacgcgtgattcaggaagcgccgccccgtgtcggtgagcgtcacacccgacggcgtgcgcaggaacagttgcgtgccgaggctgtcctccagttccctgatcgcgctcgtcacggccgactgcgaaatcgtgagctggatcgcggcctgcgagatctggccgagctcggcggtcgcgacgaaatacttgagctgtctgagggtcagggccatggtcgatgagaaaacagatgggcacgcgacaaacatcataacaaccgtgccgtgcccatgaaccagacctcgtggaaaccctgccgttcctgctgcggcggcacctggcagccgttttccacggtatcgaaaaatcgatacggtcgcatataaaaatagaactttttgacgcaccccacgcggctaacctgcgttcaacacggttttggcatgcgccacgacgcacgcgaaccggagaaccaggaggagcacatcgtatgaggaagcacagcgtcgacctgaactccgacatgggagaaggcttcggcccgtggacgatcggcgacggcgtcgacgagcagatcatgccgctgatcagctcggcaaacatcgccaccggttttcacgccggcgatccgaacatcatggcgcgcacggtgcagctcgcgcgcgacgccggcgtcggcatcggcgcgcacccgggctttcgcgatctcgtcggcttcggccgccgcacgatcgccgaaacgccgcaggcgctcgtcaacgacatcctgtaccagctcggcgcactgcgcgagttcgcgcgcctgaacggcgtcagcctgcagcacgtgaagccgcacggcgcgctctacatgcatgcggcaggcaacgaagcgttctcgcggatgctgatcgaaacgctgcaacgcgtcgatccgggcctgtggctgtactgcatggaggcgtcggtcacgtaccgcgtcgccgtcgagtacgggcagccggtcgtccgtgagttctacgcagatcgcgactacgaccgcagcggctcgatcgtgttcacgcgccgcgtcggccgcctcgatccgcgccaggtcgccgacaaggtgctgcgcgcgtgcatcgacggcaaggtgcggacgatcgatggcgacgacatcgacatcgatttcgattcggtctgcatccacagcgacacgccgggcgcgctcgacctcgtgcgcgaaacgcgccacgcgctgatccgcgaaggcatccggaccgccgggccgcaaccgctcgccgcccatcactgattcaaggagacacacgatggcattgcacgatatcgtcagcccgctgccgggcaccttctaccggcgtccgtcgcccgatgcggactactacgtcgcggtcgatgcgacggtcgccgccggcgcggtggtcggcctcgtcgaggtgatgaagcagttcaccgagatcgaaaccgatgcggcagggcgcgttgtcgaactgctcgtcgaggacggcgagccagtcgacgcgggccaggtgctgatgcggatcgaggggtgatgcgatgaatccggcaacctcctccagcgcgttctaccggccgtcgcgcatccgtacagtgctggtcgcgaaccgcggcgagatcgcggtgcgcgtgatccgtgccgcgcgcgagctaggcatgcgtgcggtcgccgtggtcagcgacgcggaccgcgacagcctcgccgcgcgcatggccgacgaagccgtccacatcggctcgtcacacgcggcgaagagctacctgaatcccgccgcgatcctcgacgccgcgcggcagtgcggcgcggacgcgatccatcccggctacggcttcctgtccgaaaatgccgccttcgccgcgcaggtcgaggcggccggcctgatcttcgtcggcccggactcgcaggtgatcgccacgatgggcgacaaggcccgcgcacgcgaaaccgcgcggcgcgccaacgtgccgaccgtgcccggcagcgacggcgtcgtgcagtcgctcgacgaggcgcgggacgtcgccgcgcgcatcggctacccgatcatgatcaaggcggccgccggcggcggcgggcgcggcatccgcgtcgcgcatgacgccgcgcagctcgacgccgagctgccgctcgcgcagcgcgaggcgcaggcggcgttcggcgacggcggcgtgtacctcgaacgcttcatcacgcgggcgcgccacatcgaggtgcaggtgctcggcgacggccgtcacgtcgtccacctgttcgagcgcgaatgctcgctgcagcggcggcgccagaaaatcctcgaggaagcgccgtcgccttcgctcacgcccgcgcagcgcgacgcactgtgcgcgtcggccacgcggctcgcgcaggcggtcggctatcgcagcgcgggcacgctcgaatacctgttcgatgacgcgcgcggcgagttctacttcatcgagatgaacacgcgcatccaggtcgagcatccggtgaccgaggcgatcaccggcatcgatctcgtgcgcgagacgctgcgcatcgccgacggcgagccgctgcgcttcgcgcagcaggacatcgcgatgcgcggcgcggcgctcgaatgccggatcaacgcggaagatccgttgcaggatttccgcccgagccccggccggatcgacacactggtgtggccgaccggccccggcgtgcgcgtcgattcgctgctctatccgggctacgtcgtgccgccgttctacgattcgctgctcgcgaagctgatcgtgcacgacgagagccgtgcggccgcgctgcagcgcctggcccgcgcgctgggcgagctgcacgtcggcggcctgaagacgaccgcgccgctgcacgtcgcgctgctcgccgacgacgacgtacgcgccgggcactatcacacgaatttcctcgaagcgtggatgccgcaatggcgtgaggccgcaacagccgccacgcagcaacacgcagccgaacatgcagacgccgtgcgcgtcggggaggcgatgtgacgaccagttataccttcggcggcgacgaattcgtgttcgtcgaaatcagcgaatcgatgtcgctcgacgcattcttcaagggcacggcgatcacgcgcgaactgcagcgccgcgcggtgccgggcatcaccgagatctgtccggcgaatgcgtcctaccaggtgcgctacgacccggacgtgatcgagcccgatgcgcttgtcgcgctgttgaagacgatcgaggccgaagtcggcgacgcgccactcgaactcgatacgcgcatcgtcgaggtgccagtgctgtacaacgacccatggacgcacgagacgctgatgcggtttcgcgaacgccaccaggatccgtcgtcgaccgatctcgaatacgcggcgcgcatcaacggcaagcgcgacgtcgatgccttcatcgccgcgcactcggggtcgccatggttcgtgtcgatggtcggcttcgtcgcgggcctgccgttcatgtaccagatggtcgagcgcgaacgccagctcgaagtgccgaaatacctgcggccgcgcaccgacacgccgaagctcaccgtgggccacggcggctgtttcggctgcatctactcggtacgcggcgcgggcggctaccagatgttcggcgtgacgccggcgccgatcttcgacccgcgcagcggctcgactacctgcgcgagttcatggtgttcttccggcccggcgacatcgtgaaattccagccgatcgatcgcgtgacctacgacgccgcggtggccgacgtcgaggccggcacctttccctgcgcgtgcgcccggtgaaattctcgctcgacgcattcctgcgcgatcccgatgcgtacaaccgctctctcgtcgaggtgctgcatgcaagctgacgcgcacaacctgatcgaggtcgtgaaacccggcctcgcgacgtcggtccaggacatgggccggcaaggctactaccacgtcggcatcccgccgtcgggctcgctcgaccagtacgcatcgcgcgcggcgaatctgctggtcggcaatcccgaagaagccgccgtactcgaatgcacgctgctcggccccgagctgctgttccatacggatgcgctgatcgccgtcaccggcgccgagatgacgccgaagatcgacggcatcggccagcgctgcaacgtcgcgctgcggatcggcgcaggcagcgtgctgtcgttcaattacgtgaaggcgggcgcacgcgcgtatctcgccgtcgcgggcggcatcgacgtgccggtcgtgctcggcagccgctcgacttacgcgctcggcgcgatcggcggccacgcgggccggcgcctgcagaaaggcgaccggttgccgctgggcgccccgtcggcacacatcgcgaagggcgcgagctgccggcggccgtgagccggccgctcgacaaccaggtcgagctgcgggtcctgacgggcctgtaccactaccggctcaccgacgattcggcgcgcaccttcttcgacgacgaatggacggtcgcgcccgaagccgatcgcatcggctatcgctacaagaacggccgcgcgttgcagttccggccgcgcgagcagccattcggcgcgggcgccgatccgtcgaacatcgtcgacgcgtgctacccgatcggctcgatccaggtgccggccgggctcgagccgatcatcctgcaccgcgacgcggtgtcgggcggcggctacgcgacgatcggcacggtcatcagcgccgacatggacctgatcggccagatgcagcccaaccaccgcgcgcgcttcgtgcgcgtgacgatggccgacgcgctcgccgcgcgccgcgagtaccagcggcgcctcgcgctgctgcgcgccgtgctgcgggactgagcaccgggcgcccggttcgcgtgccgggcgccgttcgtcgccgccccttttcgctgtccgtcttccgcccgcccggccgagcgccgcgcggcggggacgcctgcgcgctgttcctgccgaaccggttgcccgcccgacgtcggggcaaccctgcggatcgcctgtgccgcggccgagacgtcgttcgcaacttctacgcatcaaggagcacgatcatggccaacctggctcaggcccgtaccgacgaggatctcgacctgtcgacgctcgccgtccccgaccacgcgcgcatgccgcccttctcgctgacgatggcgtggtgggccgtgtgcagcgcggtgttctacatcgtcgtgggcgccacgctcgcgctcacctatggcgcgcgcaacgcgctgatcgggatggcgctgtcggtcgtgtcgtacggcctcgtcaacacgatcatcagccgctatgcgatccgcacgggactctcggtcgcgctgttctcgcgcgtgctgttcggcagcgccggcgcggcgctcgcgacactgatcttcttcgcgaccgcgatctactacgcggtgttcgagggctcggtgatcgcggttgccgcgcaccaccagtttccggcgctcgactacaaatgggccgcggtgctcgtcgtctgctacagcgtgccgctcgtgttcggcagcgtgcagcactggctcgacaagttcaacggcgtgctgctgccgttctacctgctcgggctcctcgcggcggtcgggctcgcgacggccgaatacggctacaacgcggcgtggctcgatttcgggccggccggcaacgcgccggccggcggctggtggcactgcttcgtctactacatgggcgtgtgggtgctgatgatgttcacgttcgactacgcgcgcttcggccgcaaggaagacgcgggttatcacggccgcttcaacttcgggatgccgttttacctcgtcacgtttctcgtcaacggcgcggccggcatctatctcgtcagcacgattccggggctcggtacgctttccgaagtatcggtcgtgctcgcgctgctgaagctgatgggggtgtggggattgctgttcgtgtgggtcacgcaatcccgcatcaacaccgcgaactactacctcgcgaccgtcaacatgcaggcgttcttcctgaaggtggccggcgtgcgcgcgccgaagttcgtgtgggcactcgtggtcggcgcggtcgtctatgcgctgatgatggcggacatcttctcgcgaatcctgcaggcgctcgcgtaccagggcatcttcgtcgtcgcgtgggtcggcgtcgcgctcgcgcacatcctgtccggccggtacgggcaactcgtcggcgacgacgtcgaatgccgcgacgcccatgtgccgaccttcaatccgggcgggctgaccgcatggttcgccggcgcgttcacgggactcgcgctgaaccaggcgacggggttcgccgcgtcgctgtcggcgcccgcgacgttcgtcgtgtcgtgggccgtctatcgcgcgctgctgggcaccgcgaaacgtacctggttcgtgcgcaatacgtgacggggtacgcgtgccgccgcgggccgcgcgatcgtctgccgcgcgctggcgtgattcgtcgcgccgtggcagccgcacgcctcacacgtgcgacgcggccccgtcgatggtcgcacgcaccttcgcgacgagcagttcgtcgaccggtgccagcacctcgccgcgcggccgcacgcccgagccgaaatgcaccgcgcgcacgccggtcgcgcggacgaaatcgccgaccgcatcgaccgtgagccccgagccggccagcaccgtgcaggtcgagcctgctgtctgccgcaccagccgcgtgatcgtcgcgaccgcgtcgagcaccgacggatggccgcccgacgtcagcaccgacgtgacggccggcacgcgcagcagcgcgtcgaacgcggcgttgagatcgcgcgacacgtcgaacgcgcggtggaacgtcagcgcgcggccgtccgccgcggccgcgatgcgggccagcgcgcccagatcgacgtcgccgcgcgcgtcgagcgcgccgaacacgacgccgttcgcaccggccgcgacggccgcgcgcacgtcgcgctcgatcacgcgcaggtcgtcggcgtcgtagacgaacgaccggctgtgcggccgcacgatcacgttgacgggaatcggcacggcggccacgacggcttcgatcaggccgacgctcggcgtcagcccgccttcggtgatcgcagtcacgagttcgaggcggtcggcgcccgcgcgggcggcggccttcgcgtcgccgacggtcgtggcgatcacttcgaggaggacggaagaagcggcgtttcggctcatgggcggcccgcgaatcgtcaggacaattcgcgcatcctagccgagccgcgcgacgggcgccagcgtgacggggccccgccgtcagcggcgcccgatcagtcccatcgcgagtcgcaccgtcagccgcgccgcgcgagccacacgccgacgagcgcggacaagccggtcaccacggcgccgggcgcgaaccggaacatccgcgcgttcacgtcgacgccctgctgctgcatcacgtcgacgatccccggcgccagcaggagcgtcacccagccgatcatcccgaacgcggtggtcgcggacgcgacgagcagtgcgatgcccgcaccacgcgcgcgcggccggaacgcgccggcgaacgcgcccacggccaggaacacggccgacagcatgaacaacacggcaacgaacacgagcatcgcgcgcgtatggccgagcttcatgaacgccatcatctgcgcggtgatcacgcacatgcccgcgatcgcgaacagcacgatcgcgagcgcgttgcgcacgacgctcatgcgctcgcctgacggaaatacgcggtcgcggggcgccggaacagcaggtagacgaacagggcgaacagcaggaagccggggatcagcaccgcgaacatcgacgccggcatgttgacgaacgagaacgcgaaaccgaacacggccgtcacgatataggccttgcgcgaccattcgcggcccttgaggatcgcgatgccgatcacgacgttcacggcttcgatgagcacgctgatgccgagcgtcgcccagacgggcagcaggtagtgcgacagcagcgcctgggtggtcggcatgccgatcgtgaatggcgtatagatgcacgtgatcgcgttggtcacgatgatgatccacgcgagaatggtcagcgaaatcggtcttttcattgtgttttccttgttattcgccgccatggtggccccgggacggcgcgcccgcggtcacgatggccgcggtcgcgccattgtcggggaagcgcggggcgagcgcaacgggccgcccgcgccggcccggatcgccctgctcgccgcctgcggtgcgcgcgtcgctagccggcgtccgcttcgtcgtcggcccagtcgatatcgccgcacagcacgcgctgcgtatcgccgacgcgcacagccaccgacagcgtcacgcacggctgcgcctcgttgatcgacaggtacggccgcgtgacctgcacccgccccggctcggcgattgccgagcggaaatacggccggcgcagccagttcgcgccctgtgcgtccgccagcggcgaaaagcgtgcctcggcgagcgcgcggtcggcgcgcagcacgacgttgcggcccgactggcggccgtgcgcgtcgagcaggaagcagcgcgcggccgcgtcgagcgcgaggaagttccagcacacctcgtcgagcggctcgccggccgcgaggcgctcggccgcgcgttcgaacgcgcgcaggtacggcgcgagccgctgcgcatcgcgccgctcgcgcgcctcggtctgctggcgaaaacgctcggtcagctcgccgatgcagcccgtcgcggccgcgctgtcgggcagccccggcgccggccggccgaagtagtagccctgcacgaaatcggcctcgcacgacagcgcgatctgcgcctcgtgctcggtctcgatccctcgacgagcaccagcttgccggcctcgtgcagcagcgtcacgagcccgtgcaggatcgcggtgagcccggtgcggtgcgccgcgtgcgacagcatgatccggtcgagcttcacgatgtccgggttcagttgccagatccgctcgagattcgagtggcccgcgccgaaatcgtcgagcgcgatcaggaaaccgtgcgtgcggaattcgcgcacggcctcggccagccgctcgacgtcctccgcacgctgctcgagcacttcgagcacgatgcggcgcggcggcatgccgagccgcttcaggttcgcgagcagcgcggccgcctggaacgggtcggtgagcactcccggatgcacgttgaggaacagccactcgcgctcggcgccgagcagcgcgaagttctcgagatgcagcgcctgcgcgagccggtcgagctgcagcagttcgccctggcgcgcggcttcgccgaacacgtcgagcggcgacaccgcgcggtcgagcgcatcgtgcgcgcgcagcagcgcctcgtagcccaccgcacgctggtgcgacaggctgaaaatcggctggaacacggtcgtgagcgtcaggtcgcggtgctgcgtcgccagacgttcgaggccggaactcacctcccgctcgaaccggtacggcgatgcagcggccggacgctcctgttgcacgatcgtcatgccttcctcctggtaatgccttcgaacgcagcgcccggcaaggcgaacggcgcgtgcaatgtcatggttggaccctcggttgcccggtcgaagccggacggttgaccagcatcaagcaagctccgtgcaaggcgcgtagaacccatgcgccgcgcgggctcaccgggccgccgcaccaccgtggcacacgcgcgacgcaccagtttcgtgcgcacgcaccggccgctcgaacgcacccgtcacgctgtcacgctacactccgtacgatcgtttcattcccgtattcgccgtatcgatggaaatcgtcttcaccgtcctgatcctgctgctgaccgtcgcgctgtccggcgccgtcacgcgcatcctgccgttccagctgccgttgccgctgatgcagatcgccttcggcgcgatgctcgcgtggccgaagctgaacctgcatgtcacgttcgatcccgaaatcttcatgctgctgttcattccgccgctgctgttcgcggacggctggcggattccgaagcgcgagctgtacctgcagcgccgcgcgatcctgatgctcgcattcgggctcgtgttcatgacggtactcgcagtgggctacttcgcgcactggctgatacccgagttgccgctgccgatcgcgttcgcgctcgcggccgtgctgtcgcccaccgacgcggtcgcgctgtcgggcatcgcaggaaagggccggattccgccgcagctgatgcacatcctcgaaggcgaggcgctgatgaacgacgcgtcgggcctcgtcgcgctgaaattcgcgatcgcggccgcgctgacgggcatgttctcgctgcgcgatgcgtcgatcacgttcgtgatcgtcgcggccggcggccttgcgacgggcgcgatcgtgtcgtgggcgttcagcgcgctgtcgacgcgcttcctgaacgccgagcaggaaggcgatccggccccggcatcgtgatgacgctgctcgtgccgttcgcggcctacctgttcgccgagcacctcgagctgtcaggcgtgctggcggccgtgtcggccgggatgatgatgaattacacgagcttctcgcgcaaaagcaccgtcgcatcgcgcgtgcgcgccgaaagcacgtgggcgatgatcgagttcgtgttcaacggcatggtgttcatcatgctcgggctgcagttgccgcacatcatcggccgcacgctcgtcgacgcgcaccacacgagcgacgcgctcgtcggccggatgatcttcaacgtctgcgcgatgatgctcgcgctgtacgcgatccgcttcctgtgggtctggctgctgcgctggttcgcgagccgtcgcgccgcgcgccagggcctcgccggcacgatggccggcacccgcacgatcgcggtgatgacggtcggcggcgtgcgcggcgcggtcacgctcgccggcgtgctgtcgattccggtcgcgctgtccgacggcgtgccgctgccgggccgcgacaccgcggtcttcgtcgcgtcggcggtgatcctcggctcgctcgtcgtcgcggtgatcggcctgccgctgctgctgcgcggcgtgcgttcgtcgcgcagcccgctcggcgacgaggaacgcgccgcgcgcgcggccgccgcgcaggccgcgatccgcgcgatcgactcgtcgcacgacgcgatctcggccaatctcgacgaatcgggcgccgcgcgctgcgcggatatctccgcacgcgtgatggaccagtaccgccgccgcctcgcgacgctcgccgaggacggccccacgccgcgcgccgaagcaaagcaggccgaaacgatggaactgcagatgcggatcgcggccgtgcgcgcggaacgcaccgcgctgtaccggctgcgcagcgacagcaagatttccgacgagacgctgacgaaactgctgcgcgagatcgacctgtcggaaacggcgctgtcgacgcgcaagaaaggcattctctgacggaacggcggctgccggcacgcagccgtcgacgtacataaaaacggcgacgcaccagcgtcgccgttttcacatccgcccgagcgcgcgttacttcgcgaccacgaccggaatcccttcagcatgcccgcgcccttcatctcgtcgagcgcgtgctgcacggccgcgctcgtcgccgcgtcgatgccgagctgcagtgcgagctcgcgctccgcgcgcttcacgccggccaggttgcgcaccttcacgtgaccgaagccgcgcacgcgggcatgcaggtcggccagttgcgcgaccagcgccgcattgccggccgtcatcgcggcgagcgcccgtgcgagcgtcgtctcgtagtcgtcggcgagtgcacgttccatcctgcgctcgacggtgcggccgaacgggtcgagccacgtgccgcgcaggctgcgcacgcgcgccagcacgccgaacaccggccacatccactggccgaacacgcgcttcttcggcacgctgccgtcgctgccggccttcgcgaccgtcggcggcgcgaggttgaacttcacgcgataggcctgccccggcacgccttcgaactgcgcttcgagcgccgtgcggaacgcatcgtccgtgtacagacgcgcgacctcgtattcgtccttcaccgcgagcagccggtagaacgtcgtcgcgaccgcgcgcgtgagcacgtcgtcgcccttcgcacgcgccgcgctcacgagcgcacggtagcgctcgacatagcgggcgccgccgtacgcatcgagacgcgcttcgcgatcggcgatcagctcggcgagcgtctccggcgcggcatgcgcggccaccgtgtggcgcgcgttccacaacgcatcgaggcccgccgcatcgccggccgccatccggccgatcgagaacgcgagcttgttcatcggcaccgcgacgttgttcagttcgatcgcgcgcatcatcgccgcgagcgacaccggcacgaggccgagctgccatgcataaccgagcatcaggatgttcgcgccgatcgagtcgccgaggaacttcgcggcgagcgcctgcgcgtcgcagctcgacaggtagccgtcgccggccgcgtgacgcatcttctcgagcagcgcgtccgcatgcaggttcgcgtcggggttctgcacgaacgatgcattcggaatccggtgcgtgttgacgacgatccgcgaacgttcgtgacgcaccgtctgcaatgcctcggcgctcgcgccgacgaccatgtcgcacgcgagcagcacgtcggcctgctgcgtgtcgatgcgcacctggttcagccaccggtcgctcgacgcgatccgcacgaacgacagcaccgagccgcccttctgcgcgaagcccatgaagtcgagcaccgacgcgctcttgccttcgaggtgcgcggccatgctgatcagcgcgccgaccgtcacgacgcccgtgccgccgacgcccgtcacgagcatgtcgaacggcgccgcgtcgagatgcgtcgcgggcaccggcagcgcatcgacgcgcgcggcgagcgcggcttcgtcgaatgcggcaccggcggccttcttcagcgccgcgccttcgaccgtcacgaagctcgggcagaagccgttcacgcacgaatagtccttgttgcacgacgactggtcgatgcggcgcttgcggccgagcggcgtctcgagcggctcgaccgacaggcagttcgactgcacgccgcagtcaccgcagccttcgcacaccgcgtcgttgatgaacaggcgcttgtccgggtcggggaattcgcccttcttgcggcggcggcgtttctcggccgcgcaggtctggtcgtagatcagcacggtgacgcccggcgtctcgcgcagctcgcgctgcaccgtgtcgagttcgctgcggtgatggaacgtcgtgcctttcgggaacagcccgtggtgaccgtcgtacttctccggttcgtcggacacgacgacgaagcgcgacacgccttccgcctcgacctgccgcgcgatctgcggcaccgagatgctgccgtcgaccggctggccgcccgtcatcgcgaccgcgtcgttgtagaggatcttgtacgtgatgttcgctttcgcggcgaccgcctggcggattgcgaggatgcccgagtggaagtaggtgccgtcgccgaggttctggaacacgtgcttcgtgttggtgaacatcgcgtgcgcggcccagtcgacgccctcgccgcccatctggatcagccccgtcgtgtcgcgctccatccacgacgccatgaagtggcagccgatgccggcctgcgcgatcgagccttccggcaccttcgtcgacgtgttgtgcgggcagcccgaacagaagtacggcgtgcgcttcacggcatccgcctcgttcgacaggatctgcggcgcgacaagatcgacgacgcgctcgcggcggtcgagcgccggcttgtggcgcgcgagccattcggcgaacacgggcaggatgcgcgacgggcgcagctcgccgagctcggacagcaggcaggcgccttcggcatcgtgcttgcctagcacgcgcgggcgcgcgccctcggtgcggttgtacagatagtccttgatctgctgctcgatgaccgggcccttctcctcgatcacgagcacttcggcgagcccgtcgacgaaggtctcgatgcgcgtcatctcgagcggatacgacaggccgaccttgtagatccgcacgccggccgcgtcgaggtcggccaccgtcaggtcgaggcggcgcagtgcttccatcaggtcgaggtgcgccttgccgcaggtcacgatgccgacgttcgcctgcgcgctcggtgcgatccacttgtcgatgctgtgggtgcgcgcgaaatggcgcaccgcgtcgagcttcgcggcgaggcgcgcttcgatcgtcaggctcggcaggtccggccagcggttgtgcaggccgcccgccggcggcgtgaagccttcaggcgccggccagtgcgtctgcagcgcgtcgaggtcgacggtcgagcccgactcgaccgtttcggagatcgccttgaaaccgacccacgcgcccgagtagcgcgacagcgcccagccgtacaggccgaattcgagcatgtcggcgatgttcgccgggttcacgaccggcatgtgccacgcgatcatcgcgaagtcgctctggtgcggcatcgacgacgacacgcagccgtggtcgtcgcccgcgacgaccagcacgccgccatgcggcgacgaaccgtacgcgttgccgtgcttcagcgcgtcgcccgcgcgatcgacgcccgggcccttgccgtaccacatcgcatacacgccctcgaccgtgcgctcgggatcggcctcgacgcgctgcgtgccgagcacggccgtgccgccgagttcctcgttgatcgcgggcaggaaacgcacgccgccggcgtcgagcagcttcttcgccttccacagctgctggtcgaccatgccgagcggcgaaccgcgatagccgctgacgaagccagccgtgttgagcccctgttcggcgtcgaccgtgcgctgcatcagcagcaggcggaccagcgcctgcgtgccggtcaggaagatccggccgcgcgtcgcggtcaggttgtcggtcaggcggtagtcggacaaggcgggcgtgccatcgacgggcaagcgggcggtcatggggaagtctcctgattgtgttctctcactggcgcgatcgcgaagccggtgcaatgcggccgcgtcgcggcgggtcaatgcagctatttttcagcgacaaaggaagatttttttctgatctttgcgatcggccgccaacgtgagcaaaaacacaacgggaagtgacgatcaggaggaaaatcttgcccggcatgccgggggctgtccggcgcctcgccgtcaggtggcgatggcgcgccgcagtcgcaacacggcgtcccgcatattgcccggcagcgtcgcgccaaaaccgatcacgagcccggcctcgccaccgccacggtagtgcggcgacagcggtggagtctgcagcccgagtgccgtcgcggcctcccacaccgcgagatccgcgtccggcgtagccgcgccacgcagcttcgcgacgagatgcaggccggcgtcgggcgcggcccccagtcgagtacgtcagcgcagtggcattcgagcgccgccagcagcgcatcccggcgctccccgtaaagcatgcgcatacgccgcaggtgcgtcgcgaaatgcccttcgccgatgaattccgcgagcgtgacctgcaacggagtcggcgattgccggtcgaccaacgcgcgggcatgggcgaaggctccggcgagccccggtggcgcgatcaggaagccgatccgcaacccgggcgcgaggactttcgcaaacgtgccgacgtagatcacgcgattcgcggcagactgccggcccagcgcgcgcaacgggtgcagcggccggccggcgtatcggtagtcgccgtcgcaatcgtcctcgacgatccaggcgtcggcgcgctcggcccagtccagcaacgcgagccggcgccgcaggctcatggtcacgccgagcgggtattggtgcgacggcgtgaccaccgccagccgcgcgcccgcagccagccgcacacccgcctcgacatcgaggccctctgcatcgaccggcaccggcacgacacgggcgcccgcactttcaaccgcgctgtgtcccgcgacgaaccccgggttttcgacccacactgcggcacccgcgtcgatcagcaagcgcgccgccagttcgatcgcgtgctgggagcccgacgtgatcacgacgtcgtccgcatcgcacgacagaccacgtgtgacgcccaggtgctcggcaatcgcttcgcgcagcgggcggtatccggccggatcggcatagccgagctggtcggcagccggccggctgcgccagaaacgggcggaaagacgcgtccacgtgtcgtacggaaacgcatcgaacgccggcgtgccgggcgcgagcaggcccggttcgcgcggcaccggcgtgaccggcaggttgacgaggtgacgcccccgctccgacagcgccggatacgcttcgccgtgcgccgcggcaacggacggccgcgccgcggcagcgggcagcgagaggtcctccggcaacacgtccggcacatagatgccggagccgcgctgcccgtgtgcataaccctccgccacgagccggtcgtacgccagtacgacggtctgcctcgacacgcccaggtcggccgcgaacgatcgcgtcgacggcagacgtgcgccgggacgcagatggccgcgcagcaccgcctcgcgaaggtggccggcgatctgctcctggagcggcagcgcagcggcaggatcgaccgcgaaggcgccccagacgggtggcgtggtgcgtttgctcatggcttgaaagtggattgatccggttttcgaaagtgggcttagttgattgtgccacctgttgctatcgtgcaagccatgtcatttctttccctgttacgcgcatgactatcgaagcgtccccctgcgccgccgcctcgcgctcgcgtcgctctacaccggcgtgttcctcccaccgctggactacttcatcgtcaatctggcgttgccgtcgatccacgtcggcctgaaagccagcgacgcgcagattcagttcaccgtctccgcgtacgcgctcgcgtatgcggtcgtcctgatcaccggcgggcgcctcggcgacctgtacggacgcaagcggatcttcatgatcggcatggcagccttcgtcctggcatcggcactgtgcgggatggcgacgagcggcacggtgctggttgcgagccgggtcatacagggcgtcagcgcagcgctgatcaccccgcaggtcctcgcatcgatccgtaccgtcttccccgcacacatgcaggcgcgcctgatgggcatttacggattcgtgttcgggctcgcatcggtggccgggcaaatcggtggcggcgcgctgatcgatctgcgtccgtgggggctcgactggcgcatcgtatttctcgtgaacgtgccgatcggcatgctcgccctggccggcacctggcggtatctgccggagagccgcgcggcgcgcgcgcgcatcgacatcccgggcatgaccgcgctgacgattgcgctgctgctgctcatctatccgctgaccgtcggccgcgaattgcactggcccgcgtggacgttctggagtctgggcctgtgcgtccccgcgttcgtcgccttcatccggatcgagcgccgcatcgcgcggcggtccggcgatccgctcgtcgacgtcgcggtgttgagccagccggtcgtggcgatcggcctgttgcttgcgttcctgttctacagcatcgccgcgttcttcctgacctatggcatctaccagcaggaaggactcggctggaccccgctgcaatcgggcctcggcctcgctccctacggcgcaggctatctgcttgcaccgctcgcgacaccatggctcgcgcgccgcatcggagagggtctgatgccgctcgggttcggttgcctcgccggtggcttcggcctgtgcgcatcgcaactgggacacggcgcgcctgaactgccgttttacatcggtctcctgattgcaggaaccgggcaaggattggccctaccgtcgctgcaacggatcgtgctcgcggacgtcgacgcgcgccatgccggcatgaccgcgggcgcgatagtcgcgatgctctacatcggcgccgcggtcgccgccgcgtccatcggcagtgctttcttcggcgcgctcggcgagagtggtggtgccgcggcccacacgcacgcgatgcgcatcggcctcgaatggatgctggttccgctcgttgcaggattcctggtcagcgtatggatggtgtggcgtcgcgagcgggcgacgagcgccgtacgcggcatctgatgcgtcgcagcgcacacgacgcagtcccgcaagggcaatcacgccgcgtccgtcacgcggtccttgctgccatacgacgcagcgattgcgcgaagcgcatgtctcgcacgctcgccgagcgagccgctgtgcaagacgacatccgagccgggcagcgacggcaacccgaatcgggggccgacctcgacggatcctgccggcgcgacgggcctggccagcgcggcgacggccacgccggcggatacggcggccgcgaccgcattcacgcctccgcccacgaagacctcgagccacggaatgcccgcgtcgtcgagcgcccgagcggccatcatgcgtaccctgcacgtggccggcaacgacgcgagacgtagcggcgtccccggttcgaaatgcaggttcggcgacgcataccagccgatctgctcgttggcgatcacgcagccgtcgtcgcgcccctcgacgcgccgtacgatagcggcgtcgagattccggctgtcgagttcggcgagcagccggcgggaattgtcgacacgcacttcgaccgtcagcgcgggatcgaacacgtgaagagacgacagcaatgccgttaattccgtgccgacgagattgtggctcacgccgagcgccagacgtgcgggaggcagtgccggtccgcgcaacgcacggtcatgcgcggcgacgaattcgcgcgcaggctcgacgaatgcatccccttctcgcgacaatcttacgctgcgcggcgtgcgatcgagcaaccgatagcccaggcgttcctccaggcgtttcaatttcacgctcaccacaccctgagtcgtatcgagaaaatccgccgccttcgtaaaactttccaattctgcaaccaatagaaatacacgaacagcatcaacatcgagcgtggccatggtcaatcatccatatttgttgtgattgatataattatttcgatattcaacacatactcagggaactccataattctgtcaacacgccgcaaatgatagcgattcgtgaagaatattatcgagagggccacgtgaataatttcatccgcgtaaccaagcgatcgatttcatcgcatttgtgcatcttttcaaccggataggccgcccgcgcggacttgcgcttcgcgtaccggacgcgtcggccactatgacggggccaccgcggcgggatgacgcgagccggtccgccgctccgggtcccgcaatcggaattcagtgattcccgctgcccggcaaattcccgggacggtgaggagaaccgtttttgatgcaaaagttatttactaattgcattcaaaaagctttccgactccatatgacactccatcgaatatcggcggagatggatcggctcgccattaattacgctgaattaccaaacacactgatttaatctggcagaaaaattttcaaatgcgtcaccttgccttgcgcgacttgacgtagcacggtcccgtccgccttgaccttgaaaacgactttcaattttgcagtgctaatgatttgcgaggaaatcatgaacgagcaacgcaatcctcccgttttggtccccgcaccggcacacctgcggcgcgagttgccggtcgagcgcgacgagatgcaattcgtcgacgaatctcaagctgcgatccgacgcatcctggatggcagcgacgatcggcttctggtgatcgtcggcccctgctcggtgcacgagccggccgcggcgctcgactatgcggcgcgcctgtccgacgtccggcgcacgctgcatcgcgacctggagatcgtgatgcgcgtctatttcgagaagccgagaacctgtcttggctggaaagggttgatcaacgatccgcacctcgacgagtcgcatgatgtcgatgccggcctgcggatcgcgcgccggttgatgctggacgtctcgtcgctgcgtgtgccgatcgctaccgagttcgtcgacgtcctgagtcagcactatctcgcggacctcgtatcgtggggcgcgatcggcgcccgcaccacggagtcccagatccaccgtgaaatggcatccgggctcgcgtgtccgatcggattcaagaacggcaccgacggcaacctgaaggtcgcgatcgacgcgatccgctcggctcgcagccgccatcgctttctcggcgtcgatggcgatggccgattcgtccggtactcgacggaaggaaacggccatggtcatctggtgcttcgcggcggcaaggtgcccaactacgatgcgcagaacgtggccgcagcctgcgagttgctcgtcacgaacggactcgcaccacgtgtcgtcatcgatgcgagccacggcaacagcggcaaattgcacgagaaccagctccctgtatgtgcatcgattgccgcgcgcatcgtggccggcgacgccagcatcgccggcgtcatgatcgagtcgaatctcgtcgccggtagccagccactcggcgccgatacggcgctcgtctatggccagagcatcaccgacgcgtgcatcggctggagcgacacgaccgccacgctcgagcggctcgccgccgcggtccgtgctcgccggcagttcgttgccggtacccgcgccgatctggcgtcactttcgtctaccgcatgaccgacggccgccaccgcctgcctcgaccggcagtcggatcgggcacgcaccccggcatggcgaaactcgactcactcactttcggctccatggacaacctcacgcaggcgccgagcgcgccccatgaacgcgaggtcgatcggcaccgccggtcgatcaacgcgatcgatcacgaattgctccgtctgctcaatcgccgcagcgaacacgctcagcagatcggtttgtcgaaacggcgcgcggggctgacgattccccaaccgtctcgagagcaagggattctcgacgaactcaagcggctcaacgccgggccgctacgccctgcacaagtcgaccagatctggagagagatcttctccgcgtcgcggagccttcagcagggcgcaccgattgccttcctcggcccgaacggaacctatagcgaggatgcggtgatctcgtttttcggcgacgccgccctgcgcatcggttgcgcgacgctcgacgacgcattcgacgcagtcgcgtcgggcgcggcctctgccgcggtcgtaccgttcgagaattccgcacacggctgcatcgcggacacgctcgatctgctcgcccgcaccgggctgcccgcaagcggcgaagtgatcctgccgatcgtgcactgccttctgtcgcatgcgagtgaccttggcacggtcgactgcgtgctcggtcatccgcaggcgctcgcgcaatgccggaactggctcgaccgccacttgccgagcgtcgagcggcgcgccgtatcgagcaatgccgccgccgcgaaggcagcgagcgaaagcaccacgcacgcggcactcgccggcgagcgggccggccggctctacggcatcaagatgctgtctcgcgcgattcaagaccagccatcgaatcgcacgcgattcctgatcgtcggcgacgtgccgcgcatctcgacgagcagcggcaagacgctgatacgcgtcgagatcgaacatcgcgcaggcagtctcgccggtttgcttgccccctgcaaacccacggcgtctcgatcgagttcctcgagacgcgcccgctcggcaacggcgcgtggacgtactgcttctatctcgagctttccggctttcctcacgaggcgccggttgccgaggcgctggcggaaatgacgcgccgggcgtcgacgcttgccgtgctcggcgcgtatgcacgctcggccatgtgtgctgtgccctccgtctcgctccccgagccaccgacgaggagcgtgcgcaatgattcggccacccgaccatgcaatgcaccgcgtcaaacggatcttcacgtcacttgacgaccgcctgatcgtgctgcttcgatgcacgccgcacacgctcgtgcgtcgcgacacgatgaagtgcctgaacgcactgcgctccgcgtacgaggacgatctggaaatcgtgccgtttctcgcagcggattgccggcgcaccttgcccgagacagtcgaacgaacgcttggacgccgggttcgtcgcacgggcttctcgctggctgtcgagcacaccggcatgcgcggggccggcatgccgtcctcgtggtggttgtgggacggcggcgcatcgctgcgaatcccggccgatacaccggtcatcgccacgctctggccgtccgtcccgccggaggacctcggttgggcgctgccgctcgccgatggcgagtgcctgaccaaacgcctcgcgaccctcgacgagggggcgttgccggtcaacggccggcgcctgctggtcgacctgcgctcgcaaggcgccagcggcatgcacatgctccggcatacccggctggcagccgaaacgatcggctcgcatcgcgatgtgctgggtggcgccgtgctcgacctgcgcaatctggtcgacctgcgcataccgcccgccctgccgtcacgcgacaccggcgtcgatctcgacaccgtcaaggcgttgctcgacgcattggcgaacgtggtcacgcattgccgcattgcgacctatacgcgtgcaggcacgtcgctatggcggcgcctctagtccccggaaagcggacaagccgacacggacgctcctttcgtttgcaaccgtttcctttcctctcccgattcacctctccacccaaggctccacgacatgacgacgaccaaggcaaaactgaaattcgacccgctcgatccgctgcagatcacccgggaactgtccgacgatgaaaatgcgtaccgcgaacgcgtgcgcacgttcgcgacaagcgtactcgcgccgcgcgtgcgcagcgcgttccggtacgagcatgaggatcgggcgatctttcgggaaatgggcgcgcatggcctgttcggctgcatggtgcctgaccagtacggcggcgaagcgcgcaacgccgtctgctacggcatcgcatcgcatgaagtcgaacgcgtggattcaggttaccgctcgctgctgacgatccaggcatcgctcgtcatcttccccatcctgcatttcggtaccgatgcacagcgggaacgttacctgccgaagctcgtgtccggcgaatgggtgggctgcttcggcatgaccgaagcgaacctcggctccgatcccgccgcgatgcagacacgtgccaccaaagtacctggcggctatcgcctgaacggcgagaagaactggatcacgaacgcacccatcgcggatgtactgatcgtctgggcgaaggcggaggacggcaacgtgctcggcttcatcgtcgaacgaaatgccgccggactgtcgacgccagtcatcgagggcaagatggcattgcgtgcgtcgacgacggggaaaatcgtgctggacgacgtgatgattccggattcccaggtgttgccgggcgtgaagcgcctgtccgatctcttcagttgcctgaattccgcacgctacgggatctcgtggggcgcgctcggcgccgcggccgcctgctacgaaaccgctcgcgattacacgctcgcccgcaatcagttcggcaggcccctggccgcaaaccagctgatccagaagaagttcgccgacatgctgaccgaaatctcgctcgggatgctcggctgccttcgcttcggtcgaatgaccgacgacggcatcgcgagcgtcgagctgacgtcgatcctgaagcgcaactcgtgcggcaaggcgctggacattgcccgtgttgcgcgcgacatgctcggcggcaacggtatctccgacgagtactgcgtgatacgccacctgctgaatctcgaagtcgtcaatacatacgagggcacgcacgacatccacgcgctcgtgctgggcaaggcgatcaccgggctgagcgcgttcgcgaactgagcccaatccatctacaccggagatgaacatgcaccacatggaggagatgctcgtcgtcgcggaacggatcggtcgggttgcccatctgcaactcaaccggcccaagaaggcgaacgtactcaatgttgaactgatggcggcgctgtccgcccacctggcgcacctcgatggcgacgacgaagtcagcgtgatcgtcatttcggggcatccgaagttcttcgcggccggcgcggacgtcgccgccatggtcgagcgcagcgcgtcggacgtgattcgcgaacgctttctcaccggagcctgggaatgcgtcgggcgcgtgcgcaagcccgtcgtcgccgcggtgacgggctatgcgaccggaggcgggtgcgaactcgcgcaggcctgcgatgcaatcatcgcgggcgaatccgcccgcttcgggcagccggaactggcgctcggcacgatccccgggctcggcggcacgcaacgcctgcctcgctggatcggccggatgcgcgcgatggactggtgcctccgcgcccgcgtcgtcaccgcacgagaggcgcacgacgcaggcctcgtcacgcaggtggtcgccgacgccgacgtcgtcacgcacgcgatcgcgtacgcccaggagattgcggcctactcgcttccggcactgatcctgttgaaggaagccatcaatcgcaccgccgagatgcctttgtccgccgggctcgatctcgagaaacgcctgttctacgcgacctttgcgttcgaggacaggcgcgaaggcatggccgcatttctcgcgaagcgcccccgtattccggcacgcgtgacgcacgcgccatttcactttcaagaggagcctcccgatcaccatgccgaaacgtcacttcactcagcagatcatcgtccgctattcggatatcgactacatggggcacgtcagcaacgcggtctattaccagtacctgcaagacgcgtacgtgaaattcatgtacggattgctcgacgcgccgttcagcgaacgcatctcgcagatcaccgtgaagacggtatgcgagtacctcgatcaggtgcggctcggcgaggtgctgaacctgcgcgccagcgtcatccggttcggtacgcggagtttcgacatcgagtatctgctggcgcgccgggacaacgaggaccatcttgtcgcacgcggcctgtcaacccacgtcacgttcgactatgcgaccaacgcgtcgatcctgctgccggacgatctgaaggcgagcgtgctcgcttatcagggcagtctgtagtctgcagtcgttgccgcccattccaccggcctgtctgtcggtgcgccagttggcgtccgtcagacgatccggcaccttgccacgcaggcgcgatctccgtcgtcgacgcaacgccccggagccgcacggcattactcgacagggcctgaacatgtcccacgctcatcgacagcacgacgacgtgtccgccagggacaccgcagggccaagccatctggacggtccggagacgatccgcgaaagcggttgccggatctgtctcgtcggactgatgggcaccggcaagacgactgtggggcgacacctcgcgcaacacctgtcgatcgacttcgtcgatgccgacgcattgctcgaagcccggctgggctacccgatccgggaatgcttcgcgcgcgacggcgagcgggtctttcgtgaccgggaatcgaacatcatcgaggaaatcgcccgccgccccgaagtcgtcctgtcgaccggcggcggcgccgtgctgtgcgcgcgcacccgttcgacactgaaacgccgcttcaccgtcgtacatctgacggcaaccgtcgaagagatccacgccaggacacggcacgacccgtcgcgcccgctattgcagaccgacgatccgatcgcgacgctacaaagcctgctgctgcagcgacaagcgctctacgaggcctgcgccgacctcacggtcgacacgaccgcccggtccgtcccggcgatcgcgatgcaactggcccgcgcgctccggtcggtcgatgtgcatgatccggactcgtcgcactgaagccgcgcacgatcaacgctcgcctactcggacgctcaccgttagaatgcacagcctttcgagtgccccgcgccgggatgctcatcggaatcggcgacgcaacctgtccgatcgggtgttcaccctcacccttggaattcacagcgtttcgagtgtcttcgggtggggaatatccacaaggtggcgcgtgcgcgatctccatcgcgcgctcactctcaccgttggattgcacagcatttcgatccctgtcggatgtatgttatccacaatcgcgacgctgcaacccgacacactcgccggtcctcacctgtgaaatgcacagcgcgacgagtcgtttccgggcaggatatccacatcgtcgccgggacggaatgcacttgatcaggtacgctcgctcaccctggaaattcacagcatttcgcgtcgtgcgagcggtcggttatccacaccccggattccgcgatccgccgcatcgggtcatcctcaccgatgatctgcacagcctgtcgagtcgtttgccgtggtgatatccacaaccggctgtgcgaagcgtccttcattcgtcatcggcgaggcggcgcgcggaaaccggccgatggccgggaagccttgccccgtcgtcctcggcggcaccctcacccttcaaatgcacagcgtttcgagtcgcctcggggtgggttatccacatccgtccggctcggctgcgtccaatcggctcgcgccccgcgcggcgttactcggcaatcgaccggatgaccgctgccggattgccgccgaccagcacattcggcacaacatcccgcgtgacaacggccccggccgcgaccaccgagttctcgcccaccgtcacgccgccgacgatcgtcgcgccggcgccgatccatacgttgcgttcgatcacgatcggcttcgcgacgacgaaatcgcgccgccgcgaaggttcgacgggatggcccgacgtgatgagactgacgttcggcccgatcatcacgtcgtcgccgatcgcgagcccgccgagatcgtagaacgtgcagttctggttgacgaacacgttgcgcccgagcttcatgccggtgccgcccgtcgcatgaaacggcgggatcagcacgaagccgtcgtccaccggcgtgccgatcagttcgccgaacaatgcgcggacttccgcggcatcgtcgaatgtcaggcggttgatccgcgcggcgatcgccatcgcccgcttgatctcggccaccatcgccgccgactccggcgttcttcccggaatgatcgtggcgcgatcgtcgtttgccatgcgtgagttgtctcccatgatttccctgtttcgtgtcgtatcggcgaatgcagccggatgcgagtcttgccgtgcgcacgggcactgcgggcgtcacgacgccgggcagtgacgccggcttcgccggaatttttcatcccgttcataactagtattaatatgactagttattcgtttacttccttgtcacatcgagctttgcccggttttccactcgaaacgccacgcgtccggccatcgctcgcagatggccgccctcaccgggcgcccctgtccgaacctccggcgctcgggtacgcttgagcatccaccggaccgacagctgcacccaatcacggaggcacgatgaagctctactactggccgaagacccgggcattccgggcgttgtggatgctcgaagagctcggtgtggtgtacgaactcgtgccgatcgacctgcgctcgcacgaacagggcagcgacgcgttcgtgcaggtcaacccgatggccaagctgcccgcgctcgacgatggcagcgtgccgttcgccgaatcgggcgccgtgctgctctatcttgccgaccgctgcccgggtgccgggctcggcatcgcgcccgacgatccgctgcgcggccgctttctccaatggatgttcttcacgccgacctgcctcgaaccggcgatggccgaaaattcaccggcgcgtcgggcaatccggtcgcattcggctggggcaacatcacgcgcgtgcaacgcgcactcgcgcaaacgctcgcccatcatccatggctcgtcggcgaccgcttcaccgcggccgacctgctgctcgccagcacgctgaagatcgcgttcgacgcgcatctgctgccgcacgaaggcgtgctcggcgactatgtcgcgcgcgccgaggaccgcgacgcattccgccgcgcggtcgcgatcgaacagcgcgaagcggcgcgcctgctgcatgcgtgacgcgtcgcgcgcgggcggtgccgccaatcgcccgcgggcgtacctacgcggccgggcccggcgccgctgcatcggcatcgaccaccgcgcccggcgagccgcgctcgtcggtatcggtgtcgaccggcacgacttcatgaaaatgcgtgtagtcgatgtgcgtgatgccgtcttcgtcgtgcatcaggtcgacatagcggtgacgccagcggatttcgccatgcacccacgtgtgacgcgcctgcatcacctgcgcggtcgtctcgtccgagccttcgatcgtgatcagcaacgacgcgtcgcgcgcggcgagcgattcgggcgtctcgccgaacagcgcgctcgattcgtcgatcacgtgcatcaggttccagccgagcaggaaaatcgggtgctcgctgcgcacgagcggcaggtcgtggatcttgcgcagcgtgtagccctcgtgcgtgccctcgatccgcatcagccgcaatttcgcctgcgcctcggcaatcacgttctggcgcgcgttcgcggcgcgtaccatcagcgtcatcctgccgttcagcggccggacgatcgcgtagcgcgcgaacaggatcttcgcctgcggtcgcgaaaaccgcgcgaacacgagccccgtggccagcgcgatgcccgacatcccgatgaagatctcgaacgtcgcgaccaggtgcgcatagacggtctgcggatgcatgtcgccgtagccgacggtcgcgagcgtctcgacgctgaagaaaaacgcgccgccgaacccggccggagactggttcgcgatcgacgcatggccaagcaggtagagcattgcaaagccgccgttgagcagcaggaacagcacggcgagcgacaggaagaaaacgggccagctcaccgtcagcgcgcggtgatagaggtcgcgccagccgagcggcggcatcccgtacgcaatgaccgggcgtgtgcccgaccagatcttgcggccacggccgcgggaggctggggaggacgaatcgacattcatcgcgcggcgccggaagcaggaaggcgatgagcgtagcacgcgcggccgcagccgggtatgcgtgccggtttggaatgagcgtccgccgcgccgccggccgccaggcacaaaagccggccgcggaagcggccggctgcgtcgtcagcgtgcggacaggcgcgcggggcgcgcggcgctcacttccggtcgacgatcacctggtcgaacgtgccgccgtccgcgaaatgcgtcttctgcgcgttcgcccaactgccgaagacctgctcgacgctgaacgtcttcagcggtttgaactcggcagcatgcttcttcagcacgttcgcgtcgcgcgggcgcagatggtgctgcgcgatgatctcctgcgcttccggcgtgtacaggtagtcgagatacgcctgcgcgaccttgcgcgtgcccttcttgtccacgaccttgtcgacgacggcgacgggcggctccgcgaggatgctcgccgacggatacacggcgtcgaactgcgcgcccgacacaccggtgtccatcagcgcgacttcgttttcgaacgtgaccagcacgtcgccgatgccgcgctgcgtgaacgtcgtcgtcgcgccccggccgccggagtcgagcaccggcacgttgcggaagatcgccttctcgaagtcgatcgcctgctggtcggtcgcgcccttctgcttctggaagccccatgcggcgagatacgcataacgaccgttgcccgacgtcttcgggttcgcgatgatcacctggacacccggcttcgcgagatcgctccagtccttgatcgccttcgggttgcccttgcgcaccaggaacaccatcgtggtcgagtacggcgagctgttgtccgggaaacgcgcacgccagtccttcggcagcaactggccgcgctcggcgagcaggtcgatgtcgttcggctggttcatcgtcacgacgtcggcctgcagccctgcagcaccgacagcgcctgcgcgctcgacgcgccgtgcgactgcttgatcgcgaccgtctcgccggtcttctgcttgtacgcggcggcaaagcccgtgttgatgtccttgtacagctcgcgcgtcacgtcgtacgacacgttcaggatcgacgtgtccgcgtgcgcggccgacgccgccacgaccagcgccgccgccgcgcccgtgtgcagccagcggccgatccccttcatgcttgccatcgtgatatgccccgcttccagtggtggtgaatgtgcgtgacggcacgcgtacgcgctgtcatcgaaacgtaagcgggcattctagcggccgggcgcggcgcgctttccaatcagtcgtggaaagcaaatctcgattcctgctaaacggcggcggacactcgcgtgcgcatcgaatccggtgttaagatcgccgctcagcccattcacggttcctccatgtccgctgccctgcgctcgcttccgatcctcgccgccgtcgcggcaggcgcgcgcggccgggctgaaactgaaaaacgactcctcgactgacggggacgtcgcgtcccgtcaggcgaatgccggacgggatgcccgcaggtcgtttcattctccttgcacgcatgcctcgctccggccctccgccggcggaacggttccttcccacccgtttccaccatgaggctttgcatgaacacacgtttcgaaggtatctggctgccgatcatcacgccgttccaccacggcgaagtcgaccatgccgcgctcgcgcgactcgcgcgccactatgcgggcgcgggcatcgcgggcttcgtcgcgggcgcgacgacgggtgaaggcgtgctgctcgacgcacgcgaacaggacgccgtgttcgcgacgctgcgcgacgcggcgcccggactgccgatcgtcgtcgggctgaccgcgagcgcgacgcatttcgcggccgcgcgtgcgcgcgaactcgcgacattgcggccggacgggctgctcgtcacgccgcccgtgtacgtgcggccaacgcaggacggcatccgccgccacgtcgaggcgatcgtcgacgcggccgacctaccggtgctcgtctacaacatcccgtaccgcaccggcgtgaacgtcgaactggacacgctgcaggcgcttgcgcgcgacccgcgcgtcgcgggcatcaaggaatgcggcggcacgctcgaccggatgagccggctcgtgcacgacacgccgctcgcgatcctgtccggcgacgacaaccagaacttcgcggcgatgtgcgccggtgcgcacggcgcgatcgcgagcagcgcgcacgtgctgcccgaatggcatgtgcacatccatgcactgctgcgcgacggccggctcgccgatgcgcggcgcctgtcggtcgcgctgcagccgctcgtcgcggcgctgttcgcagagccgaatccggcaccggtgaaggccgtgctggccgcgcaaggttggtgcgaggacgggttgcggctgccgttcgtgccggcgagcgaaggattgcgtgaacggctggccgcgctctgcgcggaactggacgaaaccgcaccggacgccgcagcggcatgacccgtgacgccccgtgaggcgccggcgaccgacggctttcgtgccgacaaatcgctccaaactgtcagaacgagagacaggccgtaccgtgcaagatgggtatcggccgtcacgagctgaagcggctcgagccgtgcctgcgcggccagcaagcgatcgaacggaccgcgatggtggtgcggcaaatcgcgcgctgccgcgccatgcacggcacgaaccggtaactcgcgaatcccgctcgagccgatcgctcggatcagcttgccgacgtcgatatcgagcttcccaagccggccttgatggcggcctcccagctactcgcgctgctgacgaagcgctcgtcggcggccgaaatcagtcagcgcgcccgtgcgctgagcttggggtcatcggtcacgatccacaaaaagacgtgcgtgtcgagcaacagccgcatcagcgcccttcaaatgcatccagcaggtaatcgggcagcggcgcatcgaaatcgtccgcgatccgggcctgcccttgcaggacaccgaaccgaacgggcggattggcagacacgagtcgaccggctgacgccccgtcgccgcggatcgtggtatctgcccgttgggccggatcgaccgcaccggcgccgggcgtattcgcgttttgcatgacgacctccgtttcaagtgatcatcactgtagtcaggttcacccgatcgatccattcggccaatcggcagagggactgccaaaccgcaacccgcggcggcaatcgaacgtttcgtcacgccgccagcgccgccaccgccctccgtcgcatcccgcaccgcctgcgtcacgatccacgcgagccggtcgacggtcggcgtcgccgacgacgtgcgccgcagcaggatcagcggcaggctcggcaacgcaggcaatccgagcgaagccgcatcgagcacgcgcaccgacgcgggcagtccgtaatgcgaacgcaccgtcagcccgaggccggccgccgccgcggcccataacccggcgagactcggcgtggtgaatgcaatgcgccacggcacgcccgcgcggtcgagcgcatcggtcgcggcgccgaagaaccggcacggccggtcgaacacgacgagcggcagcgcctcgcccgcggcacggccgcccgccgaggcgtgcgcggcagccgccccgacttccgcgccctcgtcggccccacccggcacgccgaacccgcccgcccccgccgccccgacccactgcatcggcacctgcgcgatcacctcgctgtcgatacccggccgcgacagcagcgcagccgacaccggatcgccccacaccagcgcgagatcgagctggttcgcgtcgagccggtcgagcaggtcggcattgcgcgccacgcgcgcctcgatcctcaccttcggatgcgcgcgcgcgaaccgcccgagcacgtcgggcaaaatcgcctcccgaaatcctcctgcaacccgacgcgcacccagccgtcgagattgacgccgcgcacggccgcggccgcctcgtcgttcagctcgatcatccgccgcgcataacgcagcatcgcgtcgccggcatcggtcagcgcaagcccgcgcccggatttcacgaacaacggcgtgccggcctgctcctcgagcttgcggatctgcgcgctcaccgccgacgacgagcgcgcgacgcggtcggctgccttcgcgaaactgccgagatccacgcccgcgacgaggctgcgcagcgccgccacgtcgaagttgggccgggccagcgcggcatcggccagcgcgagcgactcgccgccgccgcgtggaatgtcttgtccgggcatttcaaccatcctgttttatcgaacgattcatcaagaactttccgattttcaggatgaatgtaggtcgccagactgtggatgtcaatttccaaccgggccttccgccatggatacaacctgcatcgcctcccctcctcgcccacccgcgatgtacgcggcccggcccatcgctggcgcgtgctggccgccggcgtggccgcgaacatgagcttttcggccgcggcggccggcatcccgaccaccgccgtgtggatgcgctcggcctaccacctcgacaacggcgcactcggcctcgtgctcggcgcgctcggcttcggcgtcgcgctgtccgagctgccgtggggatcgccgccgaccgcttcggcgatcgccgcgtgctgctgaccgggctcgtcgcgacggccgcgatgctcgcgctgatggtgtgcacgatcgtcccgagcgcgcacgcggtgccgccgctggcgcgcgtcgtcgtggcgatgtgctgcgtcggcctgctcggcggcagcgtgaacggatcgagcggacgcgcggtgatgcgctggttcggcgagcgcgaacgcgggctcgcgatgagcatccgccagacggccgtgccgctcggcggcggcgtcggcgcggcgctgctgccgtcgctcgcgtcgcatctgggcttcgcggcggtattcggtgcgctgatgctgctgtgcgccgggtcggccgtgctgacttggcgctggctgcacgaaccgcccgccgaaccggctgtcgcacacggtgccgcgcatcgaccggccgctcggccgcaacccgcgcaacccacgcaacccacgcaacccgcgcggctcgcgcacggcccgctcgcgagcgcccgcgtgtggcgcatcgtgctcggcatcggcctgctgtgcgcgccgcagttcgcggtgctcacgttcgcgacggtgttcctgcacgacttcggccggctcggcctcgccggcatcagcgcggcgatggtcgtgttgcagctcggcgcgatggtgatgcgcgtctggagcggccgccataccgaccggcacggcaaccggcgcgcgtacctgcgcggctcggtgctcgtcgcggccggatcgttcacgctgcttgccgccgcgacggccggcagcccgcacgtgccgctcgccgcgatcgtcgcgattctggtgttcgcgggcgtgtgcgtatcggcgtggcatggcgtcgcgtacacggagctcgcgacgctcgcgggtgcgaaccacgcgggcaccgcgctcgggatggcgaacacggtcgtctacctcgggctattcgcgacgccgctcgcgatcccgccgctgctcgccgtcagttcgtggagcgtggtctggctcgcggccgcgctggttgccggcgcgacgtatccgctgttcgccacgcgctagcggcacgcgggcaccgcggcccccgccacggcgcccgcacctcggtcaggccgcttcgcgcgcaagcgcgcggcgcacggccggccggtcggcctcgcgctgcgcatgcgcggtccatgcggggtgccgcgccatgtcgagcccgatcgcgacaccccagcgatacagcacgaacaggaacggatcgacgatcgaatgcgcgcccggctcggcccacgtgcggccgtcggcgagcgcggcttcgatcgtctcgttcgcggcttcgatcacgccgcgcccgtgcgtgctgactgccccgtgcagcgcgggatcgccgatgaagcggcccggccgccacagcgcaccgtagccgacgccatgcacccagccgaccagccaggcgagccattcgtggcatcgcgcctcgcgcagcgggtcgccgagcggcagcagttgcgcgtccgggtaacggcgcgcgagatacgtgaggatcgcgggcgtttcggtcagcacgcgcggctcgcccggaatctcgagcacgggcacgcgtgccttcgcgttgatcgcgagataacgcgcttcgaggttctgctgcttctgcacggagacgatctcgacgtcgaacggcgcgccggtttcctccagcgcgatgtgagcggcgagcgagcaggcgcccggcgaaagatagagacgatatgcgttcatggtggcgtggcccgacgggactgtggaagacggaaccgagtgtaggaacgcgtgcatgcccgccgcaaacgatgaattgtcgtgctcgggcattagtgctactaataccagcatgaaacgcatccaccttcctccgctgcagacgctgcgcgcgttcgagaccgccgtgcggttgcagagcttcacgcgcgcggccgacgcgctcgcgctcacgcaaggcgccgtcagccagcacatccgcgcgctcgaggcgcagctcggctacccgctcttcacgcgcgagcgcaacggcgcgacaccgacgcacgcagcacacgcgctcgcgctgcaggtgcgccagggcctcagcgtgctcgagcgcgcgttcgagccggccctcgccacgcgcagccgcccgcgcacctgcgacgtcacgctgaacgtcagcgtgctgccgagcgtcgccgaacgctggctcgcgccgcgcctgccgcgcttctcggccgtgcatccgcacatcgcgatcgcgctgcacccggacgtggcgctcgcgccgctgcgcaagcgcgaccgcatcgacgtcgcgctgcgctacgggcccggcacgtggccgggcgtggtcgccgagaagctgatgaacgagacgatcttcccggtcgcgagccccgcgtaccgcaatcgcgacggcgtcgcaccgcgcacgccggccgatctcgtgcgcgccacgctgctgcgccatcccgcgcagccgtgggaaccgtggctccaggccgcgcggctcgatctcaccgaatccgcgcgtgcgccgcgtttcaccgatgcgaacgcgctgatcgacgcaaccttgaaagggcgcggcgtcgccctcgcgcgccgctcgctgatcgagcccgaactcgcggacggcacgctcgtgcgcgtatcgtcggtgcgcgtgaccgacgtgtatgcgcactacgtcgtgtggcgccccggccatccgcacgaatcggcgatccgaacctggctcgactggctgcgcagcgaagtgcggcggcgcacgccgcggcactgacgcgacgcgatcggttgctcgcgttcatcgtcaacggtcaggctgccttggacgcgttcacgcatcgcatcgcgcgcccgggtaaaagtgcccgcctcgcaacgtccgccgggaaatattgcgcgcccgccacgccgtgcaggcggatggtcaggatatcgaaagcaatccgcgatcacgcgacagtcgcaaacgattcaccgaaacgtcgcatcgcaccggcatactcgaaaacgtttcccgatcagcctgccaggagagaagtcatgcgtcgcgtttccgccgtcgtcgtttttgtgccgccgctttcgtcgccgcctgcagcgacgacgcgccgcacgacgcacgcacgaccgacgcgtcccagcaggccggcgcatcggccggctccgccagcgcattcaaccgcgatgcatccgcgaacgccgccgcatccgacgccgcgccgctcgcgccgcccgtcgtgcactacccgcccgatgacgacgacgacgcaaaacccgcggcaaatgcggccgcgtcgagtgccgccgcgtcgtcgccgggctgaccccgccgcttccgtccccgaccgcagaaccgaggtgaaataacatgacgtcatcgagccgccgccgtttcctgcataccgtcgcacaatccgcgggcgccgccgtcgcgctcaacgccttccccgaatcgatccgccgcgcgctcgcgattcccgccgcgcgcggcaccggcacgatccgcgatgtcgagcacatcgtcgtgttcatgcaggaaaaccgctcgttcgaccattacttcggacacctgcgcggcgtacgcggctacaacgaccgcttcccgatcccgctgcccaacggcaagccggtgtggtaccagccgtcgaaggccgaccccggcaagccggtgctgccgttccggctgaacacgctgacgacgagcgcgcagtgcgtcggcgatctcgaccactcgtggtacaagacgcacgcggcgatcgacggcgcggccggcacgttctcgcgccgtttcgcgggccacgtcgaaaacggccggccgagctattcggatccggcggcggtgcggcccgtgtccgcggcataagcgcgacggcacggcatggcgcggcccccgccgcgccgcacgggtcgcccgcccggcccggcggaatcagatcgcgggcgcgagcgcgcgatcgacgagcgcggcctcgaagccgtcgtccgcgtcgcgaaagcgcagcggtgccgcgcagtggacgagcgtgtcgatgaagtacttcgcgcgcggccacggcccgaagccggccgcggtgttgatgtgcccggcgtcgccgaggttcacgaacgcgctgcccaggtgctgcgcgagcgtgcgcgcgtcggcaagcggcatccacggatcggtctcgctgccgatcacgatcgacggcacggcgagccggcgcgcgtcgaacggcccggcaaacgtgaatttcttcggactggcgggcgcgacgagcagcacgcctgcgacatcgcccgtacgcggccactgcgcgagcgcatgcgcggtcgcgaggcagccgaagctgtgcgcggccagcacgaacggcccgcgttcgcggtcgagcaaggtgcgcaccgattgcgcccagcgcgcgagatcgggcgcgtcccagtcgtcctgctcgacgcgcagcgagcgcgggaactgccgttcgagccaggtctgccagtgagcgccttcgctgccgtgcaggcccggaacggtaacgaggcgcggcggccacgccgatttgctgcatgcgcgcatgattgccctcgcttgcttgaagacgggattcgattgtggcgcggcgcgcccggcggccgaaccaatattttgtgctttgcttttgcgcggggcggccatccgcggggcggccacgccggtcgcccgcgcagatcgcccgccccgcgcaccggcgcgcgatgcgccgcgaaaccgtagaatgtgggcttcccgtcagcttcacacggaaccggggccgggcgccgatgcgcgccgggcgcccggtcgtcaggagacgcccgatgtccgctacgcccgccggcgcaccgcgcccggctccgctcgccgttcccgtgacgcgcctcgccggcgcgcgcgcagtcgtccaatgaagatcctgttccattccccgcaccaggaagcaggcgcgtggcgcgacgagatcgcgcatgcgctgccggaagccgaactgcgcgcgtggcagccgggcgacacggccgccgccgattacgcgctcgtctggcgcgcgccgcgcgaattcttcaccccgcgcgacggcctgcgcgcgatcttcaacctcggcgccggcgtcgacgcgctgctcgcgctcgaccgtgcgcaaccgggcacgctgccgccgcacgtgccgctcgtgcgcctggaagattcgggcatggcgcagcagatggtcgaatacgtgacgcactcggtgctgcgctacctgcgccgcttcgacgaatacgacgcgcagcagcgcgagcgccgctggcagccgctcgagccgcatgcgcgcgccagcttcaccgtcgccgtgctcggcctcggtgtgctcggcgcgcaggtcgcgctcgcgctcgccgcactcggcctgcccgtgcgcggctacagccgcagcgcgaagcagctcgacggcgtcacgaccttcgccggcgacggtgcgttcgatgcgtgcatcgacggcgcgaaggtgctcgtcaacctgctgccgagcacgcccgacaccgacggcatcctgtcgtcccgcacattcgcgcggctcgcgcccggtgcgtatgtcgtcaacgttgcgcgcggcgcgcatctcgtcgaggccgacctgctcgacgcgctcgcgagcggccggatcgccgccgcgacgctcgacgtgttccaccaggagccgctgcccgacgatcacccgttctggcgcgcgccgcgcatcacgatcacgccgcacagctcggccgagacgctgcgcgcggaggccgtcgagcagatcgccggcaagatccgcgcgctcgagcgcggtgagcgcatcggcggcatcgtcgactacacgcgcggctactgaacctgcaagcaaacctggagacaaccatgacgttccccaccgccgtcaagatcgtcgaagtcggcccgcgcgacgggctgcagaacgagaagaccttcgtgccgaccgacgtgaagatcgcgctcgtcgaccggctgtcgcgcgccggcttccgcaacgtcgaggccgcgtcgttcgtgtcgccgaaatgggtgccgcagatggccgacggcgccgacgtgatggccggcatcgagcgccgcgcgggcaccgtgtactcggtgctcaccccgaacctgaagggcttcgagaatgcgctcgccgcgcgcgccgacgaagtcgtgatcttcggcgcggccagcgaggcgttctcgcagcggaacatcaactgcagcatcgccgagagcatcgcgcgcttcgagcccgtcgcgaaggcggcgaaggatgcgggcgtacggctgcgcggcagcgtgtcgtgcacgctcggctgcccgtaccagggcgaagtgccggtcgcatcggtcgtcgacgtcgtcgagcgcttcgcggcgctcggctgcgacgagatcgacatcgccgatacgatcggcgtcggcacgccgaagcgcacgcgcgaagtgctgtcggccgtcacgcgcgtgttcccgcgcgaacgcctgtcgggccacttccacgacacctacggccaggcactcgcgaacatctacgcggcgctgttcgaagggatcgagatcttccacgcgtcggtcgcgggcctcggcggctgcccgtacgcgaagggcgcgaccggcaacgtcgcgaccgaggacgtgctgtacctgatgcagggcctcggcatcgacaccggcgtcgatctcgcgcaggtcgtcgctgccggcgacttcatctcgaacgcgatcggccgcgcgaacgtgtcgcgcgccggtcgcgcattgctcgccaaggcgcagagcgcggccgacgccgcgaactgcgtataaccccggtattcgatggattcctcaacatgacgacacccgcttcattcgattccctccccgattccgcgcgacgcgtcgcgctgctgcgcgagcgcggccatgcgaaaggcatcgtgatgctcgccgaaaccggcaagacgtcggccgaggccgcggccgggctcggctgctcggtcgcgcagatcgcgaagtcgatcctgtttcgccgccagtcggacggcgcgccggtgctcgtggtcgcgagcggcgtcaatcgcgtcgacgagaagaaggtcgccgcgcaggtcggcgcggtcggccgcgcggacgcgaagttcgtgcgcgacaacaccggctatgcgatcggcggcgtctgcccgatcggccatctcgtcgaacccgtcacgctgatcgacgccgacctgctcgagctcgacagcctgtgggcggccgccggccatccgcacgcggtgttcaacctgtcgccgaacgaactggtgtcgctgacgggcgcgccggtcgcggacgtcgcattgcgggaatccgcatgagcgacgccgtggcaccggtcggcacggtggcctcgccgtgcaccgacgtatgccggatcgatccgcgcaccgactggtgcgcgggttgcctccgtacgcgcgacgaaatcaagggatggcgcacgtcggatgacgacgcgaggcgcgtgctgctcgcgcggctcgatgcgcggcggcgcgtgattgcgaggagcggcgcataaaaaagccgttcagcctgacgggcgaacggcatcgagatcggaatcctgtgaacgtgatcaacgtcacagcccgcatcatacgagcgacgcgcaccgctcgcatcgggtgtttcctacaacttcttacagcatcttccacgcgtgcgcgggctccgcttttgctcgccatgtgcacgccatccgcgcgcaatatccgctcccgaaactcgcattcgacgcgccgccgtgacacccgccgcgacgccgaatcgtacgaccgtttcagttgccgaccgccgcgcgacgcgcgggcacgatacgccggccgccgcgagcaggatcagcagcgcgccgagcacctgcgtccacgcgagcgtctgcccgaacgcgaagtgatcgacgacgatcgcgacgaccggatagacgaacgacagcgcgccggtcatcgcggtcggcagcttctggatcgcgccgtacagcagcacgtacatcaggcccgtgttgacgacgccgagcacgatcaggtcgagccactgcccggccgtcgcgggcagcgtgccgaagtgggcgaacggcgcgagcagcacgatgccgataccggcctgcagcagcgcgagcaggtgcggcggcgtccccttcaggtgcttcgtgacgatcgacgagatcgcatacaggaacgccgcgccgagcgacagcgcgacgccctccagatattcgcccggcaccgcgagcacggccggctcgacgcgcaccacggcgacgagcccgacgaacgcgagcgcgagccacgcgagcgtcgacgcggtgatccgctcgcggaacacgatcgcgccgagcgcgacgagcatgaacggctgcgtgttgtagacagcggtcgccatcgagatcgatgcacgcgaataggcggcgaacagcagcagccagttcgcgacgatcgcgatgctgccgagcgtcgcgagcgcgagcatccgcggcgagaacagcgcgcggcgcaggaagccgaatgccgcgcagacgatcgcgagcgtcgcggcaccgaacaggcagcggaagaacacgacgttcgtcagcggctgctgcgacgacatcacgagccagccgatcgtgccggacatcagcatcgcgacgaccatctcagcggcaccgcggcgaatttcattcgaggccatcatgaactccattgaaagagagtggatgacctcgattctagaaacttgctttcgccgcaaccacggctaaactgaagcgaatcagccgattgaccttcgaaagcaaagcgatcatgccgaaacgcctttccccgcccgccgtcgcgtcgctcgacgcgaccgaccgcgcgatcctcgcggcgctggccgacgacgcgcgtatcgcaaccagtgaactcgcccggcagatcgggctgtcggccccgcgaccgccgatcgtgtgcggcggctcgaggcgcaaggcgtgatcgccgcgttcaccgtcgagctcgacccgcgcgcgctcggctacacgctgcaggcgatcgtccgcgtgaagccgctgcccggccagttgcatctcgtcgaagagatgctgcgccggattcccgaattcgtggagtgcgacaaggtcaccggcgacgactgcttcatctgccggctctacctgcgcacgatcgcgcacctcgacgacatcctgtcgaaagtgacggagcgcgccgagacgagcaccgcgatcgtgaaatcgacgccggtgccgcgccggctgccgccgctcgtcgaggacgacggcgcgcaccgctgagcaccggcacgcgccgcccgtgtgccgtcaggcggccgcgtcgcgcgcctcgaagaacgcgagcagttcgtcgatcagcgcgacgggcgcctcttccggaatgtagtgcccgcagtcgagcgcgcggccgctgacgtcgcgcgcgacgcggcgccattcgtcgagcggatcgaagcagcggccgacgatcccgtgctcgccccacagcacgcgcagcgggcacgcgaccttgttgccgcgctcgagatccgcacggtcgtgctcgaggtcgatcgtcgcggatgcgcggtagtcctcgcacatcgcatgcacggcgcccggctgcgcgagcgcggcccggtacgcggcgagcgcctcgggtgcgaacggcgcgagcccggcggaccggttgcccatcacgcgttcgatgtacgcatcggtatgcgcgccgaccagcgtctcgggcagcggctccggctgaatcaggaagaaccagtggaaatacgcggtcgcgaacgcgcgatcggttttctcgtacatcgcgagcgtcggcgcgatgtcgagcagcatcatccgctcgacggcatccgcatgatcgagcgcgagccggtgcgcgacccgcgcgccgcgatcgtgcgcgcatacatggaattgctcgaagccgaaatgccgcatcacggcgacctggtcggccgccatcgcacgtttcgaatacggtgcgtgctgcgcgtcgctcggcggcttgcccgacgcgccgtaaccgcgcaggtcggtggcgatcaccgtgaaatgattcgcgagcgtcgcggcaacgcgatgccagatcatgtgggtttgcggatgtccgtgcagcaacaggagcggcggacccgctcctcctttgacaccgaaaatgtcggtgtcctgcaccgtcacgcgaaacggtgcaaacgcctcaaacgacatggtttgtttctcgttggtttgttatggcggttattttaggagcgccggcgcgtcttcacagcgcggtaaacaccagaatccctagaaagagaacactcactcgattgccgccacaccgcgcgatttgctaagctcgcgtagaatcgcacgatcgttcgtattaataaggacgacctcgttttgcagcttcgctttaccgcttcgttccgcagctacactcgaatgaccgttcgaccgcaaagcatggcggcggcgcgaccgcggccgcccctggagactggagacattacatggcattgcccaccgtcctgcagaacctgacgctgcccgtcatcgcgtcgccgatgttcatcgtcagctaccccgaactcgtgctcgcgcaatgcaaggcgggcatcgtcggttcgttccccgcgctcaacgcccgtccggccgaactgctcgacgagtggctcacgcagatccagtccgagctggccaaccacaaggcgaagcaccccgacgccgtgatcggcccgatcgcggtcaaccagatcgtccatcagtcgaacacgcggctcgagcacgacgtgcgcgtgtgcgtcgagcacaaggtgccgatcttcatcacgagcctgcgcgcgccggcgcgcgagatcgtcgacgcggtgcacagctacggcggcatcgtgctgcacgacgtgatcaacctgcgtcacgcgcagaaggcgctcgaagccggtgtcgacgggttgatcctcgtcgcggccggcgcaggcggccacgcgggcacgacgtcgccgttcgcgctcgtcggcgaagtccgcaagatcttcgacggcccgatcgtgctgtccggctcgatcgcgaacggcggctcgatcctcgccgcgcaggcaatgggcgccgatttcgcgtacatgggcacgcgcttcatcgcgacgcaggaagcgcacgcgatcgacgactacaagcacgcgatcctgaacgcgaaatcgtcggacatcatctacacgaacctcttcacgggcgtgcacggcaactacatccgcgagagcatcgagaaggcgggcctcgatccggacgcgctgccggaatccgacaagaccaagatgaatttcggcggcgacaagacgaaggcgtggaaggacatctggggcgccggccagggcgtcggcctgatggacgacctgccgagcgtgggcgcgctcgtcgagcgcctgaagcgcgagtacgacgacgcgaaagcgcggctcggcattccgcgctgacggccgccgccggcgcgcatcccgtcggaccaaacaaaaagcgcgagctgcaacggctcgcgctttttgttttcatcgccccgccgcggcgggatgcgcgggtcacaccgcgcgcttcatccgcgtgatcggcagcacgcgcaggcgcgattcgatcgacgggcacagcgactgcccttcgaaacgcgccgccaggaaatcgacgaacgaacgcaccttcgcggacacgtgacgacggctcgcgtagaccgcatagatcggcgcctcgtgcggcggcaccgcatcgatcagcaccggcacgagccggccggactcgatgtcgtcgccgaccacctcggtgccgagcagcgcgatgcccgcgcccgcgagcacggccgcacgcagcccttcgagatggttcacgatcaggttgccgttcaggttcacgcgcgacgcggcggccgcgtcgatcaccagcgcgtcgagcatcgtcgaattcgagtcgcgccgcaggtagttgtggtgcgcgagatcggcgatcgtctggggcgtgccgtgcttctcgagatactcgggcgacgcgaccagcaggatgtgcgcggtcgcgatctgccgcgcgaccagcgacgacgatttcaacccgttcggcgccgcgcgcaccgcgacgtcgtagccttcctcgatcaggtcgaccacgcgatcggacagcgtcatgtcgacggtcacgtccgggaaccggcccgcataatcggtgacggcctgcatcacgtgccgcagcccgaacgcggacagcgacgtgacgcgcagcctgccttgcggcaccacgctcgcggcgccgacggcctgcccggcttcgtcgagttccgacagcgcctgcacgaggcgctcgtagtattcgcgtccggcctcggtaggcgcgacgcgtcgtgtcgtgcgatgcagcagccgcgcaccgagctgctgctcgagatgcatcacgtgcttgctcgccatcgcagccgacatctgcatgcgctcggccgcgccgacgaagctgcccacttcgacgacgtagcgaaacacattcatgctgacgagggtatccatcgaactcgctcgtaatgacggggaatggtccaattacgagatagggtaacaaaggcgaggaaacagaaaggtcaagaaaggcaaaacggcgccgcgggtggcggcgccgttctggcgggaaaacatgcagcccggacgcgcttttcgcacgcgtccggcgcggcggtcgcgcgtgcgcgtcagaacttcgcgcggatgccggcaccgaacgtgttgccgttcgacaggccgctgatgtggtcgttcatgtaagcagcgtagacgtccgtgcgcttggacagcggatagtcgtagccgacggcccaggtctggcgcgtctggtcgaggccgcccgcgtcgcgcgagtacgcgtacgacgccatcgcgttgcccacgccgagcggcaccgacacgccgccctgcgcggtattcacgtgccagctgcccgcgacctggtcgttcttcgtatacatgtactggccgaacagcttcacgtacttcaggtcgtaggtcgcgccgacttgcgcgatgccctggctcttcatgccggccaccagcgcgctcaggtcgcgcgggccgttgttgaagttcacgtactggtagaccgcagtcgccgcgaacgggccgttcgcgtagttgaactgcgcgctccacttcttcgagccgttgtccccggcctggttgccgaacgcgtacatcgcgccgaaattcaggccaccgaacgaaggcgacgtgtacgacagcgcgttgttccagcccgaatcgccgacggcaccctggtcgctcgggtaggtcgggaacgtgccgaggccgaggaacacgtggtacaccatcggcgagaaggtgtacgagtcgtagaacgggttgaacaggatcgtcgacaggaacaggtgcgttgtcaggcggccggccgtcaccgtgccgtacggcgaatcgatgccgacgtacgcgttgcgtgcgaagaacgtgtcgccctggaagcggccgaactggccgttctgcgcgcggaagaagctttccagcgtgaagatcgccttgtagccgttgccgagatcctcggcgccgtgcatgccccagtacgacgtcgacatcccgccgccgctcacgttccacgcgcggtcgccgcccgggaacttggtggcgccgacccattcgtcgacctgaccgtagagcgacacgctcgactgtgcatggacgggagcggtagccgccacgcaggcagccgcggcgatcagcttgacggacgtgcgcgacgcacggcgagcgaatgctttcattggatctccagattttgtcgaattgtcgataagtggcgcgagcgttgtttttggagccgagtgcttgcgtcgtatggggcgcagccatctttacggatcattcgtccggtcaaaattgcgcacacttattgcgggtatagcggcagcattaacttcgcggaattgatacatggccgggtacccgccggcggcccggcgtggacgcggtcgcacggccggacggccgcgtggcacatgcgagccgggcgcgaaagatagcgcaatgcgacgggaaaatcagcggaaatctgtgcgcgactgtggcgaattcgcatcagccgccggagggacgagcgcgcgggcgctcagtttcggtagaacggggagaaatacggcgagtgcgcaggctcttcctgcgagcggggcggcggcatcggacggccgccgcgctcctcgttgtagcgcgcgacgtcggcgcggatcgaaccggcgcgcagcggcacgttgccgccgcccggcggccgcggcatctggcgcacgtcggcgctgatcgggcgatacgggctttgcgcggcgtaatgaccgtacgacggcgtcggccgcagccccagcgggaaccgtagccgctcacgccgccggcgcgtgcaccgacgggggcgtgacgtggcgccagacgggaaccccgccggccggctgaccgtatgcgcgcatgtcgccaccaccgaaaccgtggccgccgaatgcatgaccgccgtgcggcggctgcgcgagcgcgaacggcatcagcaacgcgccgagtgcgcctgcgacccatcgtccgatcttccgtttcacccgttccgtcatcgtgcaatgcctgtccatgcccgccgccggctcctttcggccgacccaaggctttcagcagtaatttatgagcgcgccgaaagcgtgtcgagccaaaaagtgttatgtcgccggcatcggtgtaacaccatgttactgctaggtttttcacttcggcacgcgaccgggacagaacattcttctgccgttttgcgcatggccgggccggttccgcgaacgcggttgcatgagactgattcatcaatcgattcccacaatgaatttgtgtagtgaatcatcaaccgggacaatggcgccatccgcgcgcgcgacgcgcgccccgtcgtttccgaatcgagttcccgatggcccgtccccgttttcttcccgacaacttcacgctcgcgctcgtcggcaccgtcgtgctcgcgagcctgctgccctgccgcggcccggccgcccacgcgttcaactgggcgaccaacatcgccgtcggcctgctgttcttcctgcacggcgcgaagctgtcgcgcgaagccgtcgtcgcgggcgcgacccactggcggctgcacgcggtcgtgctactcagcacgttcgcgctgttcccgctgctcggcctcgcgctgaagccggtgctgcagccgctcgtcacgccgacgctgtacgcgggcgtgctgttcctgtgcacgctgccgtcgacggtccagtcgtcgatcgcgttcacgtcgatcgcgaagggcaacgtgccggccgccgtgtgcgcggcatccgcgtcgagcctgctcgggatcttcgtcacgccggcgctcgtcgggctgatgatcacgtcgcaatcggccgccgccgcgtcgccgtggagcaccgtcggcagcatcgtgatgcagctgctcgtgccgttcatcgccggccagttgctgcggcccgtgatcggcggctggatcgaccgcaaccgcggcgtgctgcgcttcgtcgaccagggctcgatcctgctcgtcgtctatgtcgcgttcagcgaggccgtcaacgaaggcctctggcaccagatcccgccgcgcgcgctcggcggcctgctcgtcgtcaacctcgtgctgctcgcgatcgcgctcctgctgaccgcgttcgtcagcaagcggctcggcttcaaccgcgccgaccagatcacgatcatcttctgcggatcgaagaagagcctcgcggccggcgtgccgatggcgaaggtgatcttctcggcgaacgcggtcggggcgatcgtgctgccgctgatgctgttccaccagatccagctgatggcgtgcgcggcgctcgcgcagcgctggggcgcgcgcgacatgagcggcgagcacgacgagggcgacgcggcatcggcgcccggcgcgctgagcgcgggcaagcgctgacgatcggggcggcgggacggccgccgggtggtgccgtcccgggctctgcctttctgcctttctgcctttctgcctttctgcctttctgcctttctgcctttctgcctttctgccttcccgcctcccgcctcccgcctcccgccttccgccttccccgcaacgcccttccacccacgcaccgacacgcccccgacgcgacgcaccagcaacgcccatcgcgtcacgaaatcttcattcaactctccgcgagcggtgccgttaagtcgggcgtcccgtcgattcggctgccctcgcccatgcccgcgccccaccccgactccgccgccacccgcaccacgcgcctgatcgcggatcgtgcgctggccgccgtcttccagccgatcgtcgatctcgggtcggggacggtcgtcggctacgagggcctgatacgcggcccgcgcggcaccgacctcgaaacgcccgccgcgctgttcgcgcaggccgcgcgcgacggcgagaccatcgcgctcgaacaggccgccgcgcgcacctgcctcgacgcgttcgcagcgctcggctgcgacggaaagctgttcctcaatttcagcgcgggcacgatcctgcagctcgcgcgcgaacgcgagcgcgcccgccaactgctcgaccgtgcgcgggtcggcgccgagcgcatcgtgatcgaactgaccgagcagaacgcgacgacggacatcgcccacatcgagccggccgtcgcgtcgctgcgcgacgccggcatccagttcgcgctcgacgactacggcaccgcgaacgcgagcatgaacctgtggctgcgcctgcatccggacgtcgtgaagatcgaccgcttcttcatccacgacatcgcgcgcgacccgctgaagttcgaggccgtgaaggcgatgcagcacttcgcgcaggcgagcggcgcgcaactgatcgcggaaggcatcgagaacgaaagcgacctgatcgtcgtgcgcgacatgggcatctgctgcgtgcagggcttcctgctcggccggccgaacgcgcggccgtcgcgagtcgtcgcaccggccgcgcgcgacgcgatccgcgcgccgcacatcgcggtgtttcccggcgcgacgcgcccggtgcggccggccggcacgatcgccgggaagatgctggttccggcgccggcgctgccgcgcgacgcgaccagcaacgacgtgctcgacctgttcaaccggatgcccgacctgcacgcggtcgcactcgtcgaacgcgggcggcccgtcgcgctcgtggatcgccgcggcttcatcgaccgcttcgcgctgccgtaccaccgcgaggtgttcgggaagaagccgtgcctgccgttcgcgaacgacgcgccgctgatgatcgacaacgcgacgacgttcgagcagctcgcgatgctgctcgcgagccacgaccagcgctacctcgcggacggcttcgtcatcaccgaacacggccgctacgtcgggctcggcaccggcgagagcctcgtgcgcgcggtgaccgagatgcgcatcgaggccgcgcgctatgcgaacccgctgacgttcctgcccggcaacatcccgatcagcgcgcacatcgaccgcctgctccagcgcgacgccggctttcatgcgtgctacgtcgacctgaaccagttcaagccgttcaacgaccagtacggctactggcagggcgacgaggtgctgaagttcgccgcgacggtgctggccggcgtgtgcgatccgcagcgcgactttctcgggcacgtcggcggcgacgatttcctcgtgctgttccagcgcgacgactggcgccaacgcgccgccgacgcgatcgcgcgcttcaacgacggcgcgcagcgcttctacacgcaggccgaccggcaggcgggcgggctgcgcggcgaggaccgccacggcaacccggcgttcttcggtttcgtgacgatggcgatcggcgcggtcggcgtgccggccggcgcgcacggcgcgaagcgctacggcagcgacgagatcgcatcggtcgccgcgctcgcgaagcggcgcgcgaaacagcagccggacgggctcgcggtcgtcgacctcgacgcgggccgcgccgcgctgcgcgatcgcggcgaaccgccggccatggcaatacgctgaccggcgggcagccggccccctcgttcgcgcacgcgaggtgcccgatgcggcggcgatgcgccgtcgtccgtcacgcccggacgcccgccgcgctgccgggccggtcgttgcgcccggccttcccgccggcctgagcaagccgccgggcacgcgtgcgcgcatgcgcgaagccggcacgctggccgccgcttcccgctcgccggacacccgcacgtccaccttgcctttttcgcgttttgtttagtatttttagtaacgtcgttttcgcagattagcgcttaaaaaccggtaattttcgggtattcccggttatccggcccgaattccgcgatacgttttactatacaatcgctttcaccctaaacaaaccggaccccgaacgatgggcaccaccattcgcgatgtggcgcgggcggcagaggtctcgatcggcaccgtctcccgcgcgctgaaaaaccagccgggcctgtccgaagccacgcgtgcgcgcatcgtcgagatcgcgcagcggctcggctacgatcccgcgcagctgcggccgcgcatccgccggctcaccttcctgctgcatcgccagcacaaccgctttccggccagcccgttcttctcgcacgtgcttcacggcgtcgaggacgcctgccgcgagcgcggcatcgtgccgacgctgctcacggtcgggccgaacgacgacgtgctgcgccagatgcgcccgcacgcgcccgacgcgatcgcggtggccggcttcatcgagccggagacgatcgaggcgctcgccgcgaccggccggccgctcgtgctgatcgacctgtgggcgcccggcctgcgctcggtgaacatcgacaacgcaacgggtgcggcgctcgcgatgcgtcacctgctcgccaccggccgcacgcggattgcgttcatcggcggctcgcccgcgcactacagcatcgcgcagcgcgcgatcggctaccggcgcgcgttcttcgaagccgggcggctgttcgatcccgcctacgaagtgacgatcgacgcggggctcgatcccgacacgggcgccgcgcgcgcaatggagcgctgctcgacgcgccgggcccgcgccccgaagccgtgttcgcgtacaacgacgcggccgcgctcgccgcgcagcgcgtgtgcaccgcacgcggcctgcggattccggacgacatcgcgatcgtcggcttcgacaacatcccggccgccgcgcacgcgagcccgccgctcacgacgctcgcggtcgacaaggaagcgctcggccgccgcggcgtcgagctgctgctcgccgactcgcccgaacgcaccgagatttccctgcccgtcgagctgatcgtgcgggccagcagtcagcccgccggctcccggcactcgataccgccacggtcaccgaatcatgaacatgcccccggtccaaccctgcacggccgcgccggccgcccacacgcaagccgcgccgttcgtcgcgagtttccgcgatccgtcgttcctgctgtcgcacatcgaggacacgctgcgcttctacgcaaccaacgcgttcgacccgacgggcggcttctaccactacttccgcgacgacggcagcatctacaaccgcacgtcgcgccacctcgtcagcagttgccggttcgtcttcaactacgcgatggcgtaccggcatttcggcgatccgcgccacctggaatacgcacgccacgggctgcgcttcctgcgcgacgcgcactgggacgacgaactgcagggctacgactgggaactcgactggcgcgacggtgcgaagcgcgcgacgctcgacggcacgcgccactgctacgggctcgcgttcgtgctgctcgcggccgcgcacgcgacgatggccggcatcgacgaggcacgcccgctgatcgcggccacctacgagctcgccgagcaccgcttctgggacgcggccgcgggcctctacgcggacgacgcgacgccgaactggatcgtgtcgtcgtaccgcggccagaacgcgaacatgcacatgaccgaggcactgctcgcggcccacgaggcgaccgggcacctcacgtacctcgatcgcgcggaaaagctcgcgtcgcacatcacacagcgccaggccgcgctgtcgggcgggctcgtgtgggagcactaccacgcggactggtcggtcgactgggactacaacaaggaagacagctcgaacatcttccgcccgtggggcttccagcccgggcaccagaccgaatgggcgaagctgctgctgatcctcgaacggcaccgcccgctcgactggctcgtgccgcgcgcggccgagctgttcgacgccgcgctcacgcacgcatgggacgccgaccacggcggcctgtactacggcttcggccccgacttcacgatctgcgaccacaacaagtatttctgggtgcaggcggagaccttcgcggcggccgcgatgcttggcgcgcgcaccggcagcgagcgcttctgggactggtacgacgagatctggcgctatagctgggcgcacttcgtcgatcaccgctacggcgcgtggtaccgcatcctcacctgcgacaaccgcaagtacagcgacgagaaaagcccggccggcaagaccgactatcacacgatgggcgcgtgctacgacgtgctggcaaccctcgcgcgcgcgcaacgcagcgagccgacgcaatgagcggcggcacgtttccggctttcgtgtcggcaggcgacatcctgaccgacatggtgcgcgcgggcgatgcgcaatggacgtcggtaccgggcggcgccggctggaacgtcgcgcgcgcggttgcgcggctcggcgtgccgagcgcgctcgcgggatcgatcggcgaagactgcttctcagacgtgctgtggcgcacgagcgaagcggccgggctcgacctgcgcttcctgcagcgcgtcgcacggccgccgctgctcgcgatcgtgcacgagacacgcccgcccgcgtatttcttcatcggcgaagcgagcgccgatctcgcgttcgatccggcgcggctgccggccggctggaccgaccacgtgaaatgggcgcatttcggctgcatcagcctcgtgcgcgagccgctcgccggcacgctggccgcgctcgcggccgacctgcacgcgcgcggcgtgaagatcagcttcgacccgaacgtccggaacctgatgacggccgcgtaccggccgacgctggaaaagatggccgcgctcgccgacctgatcaaggtgtccgacgaggacctgcggcacctgttcggcggcgacggccccgacgcgattgccgcggtgcgcacgctgaacccgcgcgcggccgtgctcgtcacgcgcggcgcacaggcggcgacgctctacgcggacggcgacgtgcatgaagccagcccgccgcgcgtcgaggtggccgacaccgtcggtgcgggcgacgcgtcgatcggcggcatgctgttcagcctgatggccgcgccgcagcgcacgtggcgcgagcatctcgtgttcgcgctggccgcgggtgccgcggcgtgccggcatacgggtgcgcacgcgccgacgctcgacgaggtcgtcgcattgatcgaacgctgacggcacgccgatggcacgaacggtgaccgaacgctgttcggtcaccgataagccgcgctgtacatgctgcgccgcagtgctacgatgaagtgtccttttgcgggagagcaccatggacacgaacacgttcacgaaaggcatctacacggccaaggcgcatacccagcacgcgggcaacgggcagttccagggttacgtgatcctctcgcgcgacgacggcgacgacaccgagaacacgcgttacgacgtccactcgacgagccccagcgaggaagaggcgttcgacgaggcgaaagcgctcgcgcaccggattctcggcgagatcgagctgtaacgcgcaccgaccttcaggcgcggctcagagcagccgcgccgccatcgataccagcatcgtcagcaccagcgtcgacatgaacgggaacgggtagcgccgcccgccgagcgtcagcgtgacgtcgcccggcatccgcccgatgccgagcttgccgagccacggccagcagcgcgtcaggatcatcaccgcgacgaacgtcgtcaacagccagcgcagcatgctagggcctgtttccatatggaacgcgcatgcgttgccacgagaacggccgctcgcgaggcgcgcgacgccgcgaatactggacgtattcgcaaggagcgcaacgcggcgagcggccgttctcgtggcaaccccaaattaaaagaatcatgtcacgggaatgcccgaaatcgcccgtatggcggcgtcgctcgtcgcttgtttggcacggccaaacggcgctcctcactccttgccctacgagcgatttcgggcattcgcatgtgcgttccatatggaaacaggccctagccccgtcagagtgcgtgcgagcgatcgccgcgcgcgaacgcgtcgagcgtgccgtcgatgccgcgcgagaacgcgatcaccttgaacagctcgcccatctcggcctcggaaatcagcttctgcaccgcgttcgcggccggcaggaattcacggatgtccgacggatcgatcgcggccagcgcgtcggtgatgcccgcgttcagcaggaagcgcgcctgcgacgtgtaaccgagcaggtcggcgccggtcgcgatggccgcgtcgtagatgccggtgaattcgacgtgcgcggtgatgtcctgcagccccgggtacaggaacggatcgtcgtgcgcatggtgccggtagtggcacatcagcgtgccgcggtcgcgctgcgggtggtagtactcgtgcgcgggaaaaccgtagtcgaccagcagcaccgcgccgcgcccgagcatcgtgcagacggtgcgcgtgaacgccagcgcggcctcgtgcgtctcggtcacgtaaccgtcgcccgcctcgtagagtcccgcgagcaccgccggcaggccggccggcgcggcaggacggtcctcgaacacgaacgcctgccgcgcatcgagcgcgacaccgcgctcctgccatgcgccgcccgccttcgcgaacaggcgcacgggcatcgcatcgagcacctcgttgccgaccacgacgccgtcgaaccgctcgggcagcgcgtcgagccagcgcaccttcgcggcgagcgccggcgcggaggccgtgatcgtgtcgcgctgccgttcgcgcagctcgccggacaggtcgacgatcaggtattcgtcgagtccggcgcccagcgcgtcgagcgccgcgagcagaccggccgcgagcttgcccgtaccggcgccgaattccatcacgcaacgcgtgccgctcgccgcgagcgcttccgcgaccggttgcgcgagcgtctgtgcgaacagcggcgacagctcgggtgcggtgacgaagtcgctgccgtcgtcggcgcggcgcccgaacttgcgcgcgccgccgctgtaatagccgaggccgggcgcgtacagcgcacgctccatgaagcggtcgaacggcagccagccgccggccgccgcgatctcgtcgcgcagttgcgcggcaagggtttcggactgcgcgagcgcgtcagggccgggagcaggtaaactagcgggttcgtgagctttcgggttcatcccggcattgtaaatgaccgtttcagccgatacgtcgaccctgcgcgtggcgctcgtcaccggtgccctgggcagcgcggccgacgccgcgtcgatcggtcgtgcgctcgcgacgggattcgcccggcacggctgggacgtcgcgttgcagcgcagccccggcacgccgcatgcggccgccgacgcgctcgtcgccgaagtcgcggcgctcggccgccgcgcagtcgtgctcgacgccgatctggccctggaagccgatgccgccgcactcgtcgccgcgtgcggcgcggcgctcggccggcccgcgtgcgcggtgttcgtgagcgcccgcgcgggcgccgacgacgcgcacacggtagacggcgcgtcgctcgccggcgcactcgcgcgcaacgtgacggcgccgctcgcgctggcgcgcgcgctcgccgatgcgacgcccgacgccgcgcgcgagcacgaagcgctgcgcgcatgcgcgatccacgtgctggaccaggcgctgtttcaccctgcgcctgcgcagttgtcgcacgcgctgatgcaggccgcgctgaaccgcgcgacgtcggcgctggcgttggcgctcgcgccgaaggtgcgggtcgcggcgctcgtgcgcgggcacgcggcgcacgcggacgacatcgccgcggccgcctgctatctcgcgagcgcgcccggcgtcacgggcgcgacgctgaccgtcgacggcggcgagcacctcgtgccgcccgccgccggcccgaatgaatgaactgcgcggatcgcgcggcctgactgccgccgcccgcgccgctttgcgtgtgcgcacgccaatttgactgggacgaccatgttttccgctctcctgcacccccgcctcgcggactgccgcaggctctacctgcgcgactacgaagtgcacatcaacatcggtgccttcgaacacgagaagcgcggcgagcagcgcgtcgtcatcaacgtcgacctgttcgtgccgctcgcgatgtccactcccgtggacgaccggctgcatgaagtcgtcgactacgacctgatgaagcagagcgtcgcgcaatgcgtggcgcgcggccacatccacctgcaggaaacgctgtgcgacgcgatcgccgcgcacctgctggcgcacgacgccgtgcgcgcggtacgcgtctgtaccgagaaaccggacgcttatcggactgcgacgccgtcggcgtcgaagtctttcgcatcaaggacgaggagcgcgcatgaacgcccccacatgaatgacgcggcggccgatgccgccacccacgacgcagccgccgccccggccggccgccaggcgccgacgcgccgcgagcagaaggaagcgtacgagaacaacaagctgttcaagcggatcgtgcgccaggtcggccaggcaatcggcgacttcaacatgatcgagcaaggcgacaaggtgatggtgtgcctgtcgggcggcaaggacagctacgcgatgctcgacgtgctgctgcgcctgcgcgagcgcgcgccgatcgatttcgacatcgtcgcggtgaacctcgaccagaagcagccgggcttcccgagcacgtgctgcccgagtacctgaagcaggtcggcgtgccgttccacatcgagaaccaggacacctacagcatcgtcaagcggctcgtgcccgaaggcaagacgacctgctcgctgtgctcgcggctgcgccgcgggatcctgtaccgcgtggccggcgagctcggcgcgaccaagatcgcgctcggccatcaccgcgacgacatcgtgcagacgctgctgctcaacatgttctacggcggcaagctgaaggggatgccgccgaagctgcagtcggacgacggcaagaacatcgtgatccgcccgctcgcgtacgtgaaggaaaccgatctcgagaaatacgcggaactgcgcgaattcccgatcatcccgtgcaacctgtgcggcagccagccgaacctgaagcgcgcggaaatgaaggcgctgatccgcgaatgggacaagcgcttcccgggccgcgtcgacaacatgttcaacgcgctcgcgaaggtcgtgccgtcgcacctgatggacacgacgctgtacccgttccagtcgctgcgcgcgaccggcgaggccgatccgcaaggcgacatcgcgttcgacgaggaaccgtgcgcgtcgggcgacgacgcggcggcgccgggtggcgcccggccaatctcgatcgtccagttcgacgacctgtaagcagggcccgaacacccgccggaacggggccgcgcggcccttttccggcgccgtcgccccgccgcgacaggcccggaacggcaggggccgcatgctaaaatggtcggcttcgaactcctctgacaagctggcgccatgaatatcgtgattttggcggcaggcaccggcaagcgcatgcgttccgcgctgccgaaagtgcttcacccctggccggcaggccgctcctctccacgtcatcgacaccgcgcgcacgctgcagccgtcccggctcgtcgtcgtcgtcggtcacggtgccgagcaggtccaggccgccgtcgccgcgcccgacgtccagttcgcggtgcaggcagagcagctcggcaccggccacgcggtgcgtcaggcgctgccgctcctcgatcctgcgcaaccgacgctcgtgctgtacggcgacgtgccgctcacgcgcgcgtcgacgctgcagcgcctcgtcgatgccgcgcgcgaaggccgctacgggattctgaccgtcacgctcgacgatccgaccggctacggccgcatcgtgcgcgacgcggccggcttcgtcacacgcatcgtcgagcagaaggacgcgtcgcccgaacagctgaagatcgccgagatcaacacgggcatcatcgtcacgcccacggcccagctgtcgatgtggctcggcgcactgaagaacgagaacgcgcagggcgagtactacctgaccgacgtcgtcgaactcgcgatcgaggccggtttcgaggtcgtcaccgcgcagcccgacgaggaatgggaaacgctcggcgtgaacagcaaggcgcagcttgccgagctcgaacgcattcatcagcgcaatatcgcggaaacgctgctcgtcgacggcgtcacgctcgccgatccggcccgcgtcgacgtgcgcggcacgctgcgctgcggccgcgacgtgtcgatcgacgtgaactgcgtgttcgagggcaacgtgacgctcgcggacaacgtgacgatcggcgcgaactgcgtgatccgcaacgcgtcggtcggcgcgggcacgcgcatcgacgcgttcacgcacatcgacggcgccgagctcggcgcgcacaccgtgatcggcccgtacgcgcggctgcgccccggcgcgcagctcgcggacgaagcgcacgtcggcaacttcgtcgaggtgaagaacgcggtgatcggccacggctcgaaggcgaaccacctcacgtacatcggcgacgccgacatcggcgcgcgcgtgaacatcggcgcgggcacgatcacttgcaactacgacggcgcgaacaagttccgcaccgtgatcgaggacgacgtgttcgtcggctccgacacgcagctggtcgcgcccgtgcgcgtcggccgcggcgtgacgatcgccgccggcacgacgatctggaaggacgtggccgaaggcctgctcgcgttgaacgagaagacccagaccgcgaagagcggctacgtccgcccggtcaagaagaaaagctgaacctttgcgggcgccccgacggcgcccgcgtcgacttacaggactgactcattcatgtgcggcattgtcggcgcagttgcgcaacgtaatatcgttccggtgctgatcgaaggtttgcggcgcctcgaataccgtggctacgactcgtgcggcgtcgccgtgctcgagccgggcgcgccgaagcgcgcgcgcagcgtcgaacgcgtcgccgatctcgacgcgcaggtgcgcgaatcgcatctcgaaggcacgacgggcgtcgcgcacacgcgctgggccacgcacggcgcgcccgtcacgcacaacgcgcacccgatcttctcgtcgaacgcgctcgcgctcgtccacaacggcatcatcgagaacttcgagccgctgcgcgaagcgctgcgcgcgaagggctacgaattcgtgtcgcaaaccgacaccgaagtgatcgcccacctcgtgcacagcctgtatcgcggcaacctgttcgacgcggtgcgcgaagccgtgcagcagctgcacggcgcgtatgcgatcgccgtgatccacaaggaccagccgcacaccgtcgtcggcgcgcgccagggctcgccgctcgtggtcggccacggcgacggcgagaacttcctcgcgtccgacgcgctcgcgctcgcgggcagcaccgaccgcttcacgttcctcgaggaaggcgacgtgtgcgagctgtcgctcgacggcgtgaagatcgtcgaccgggacggcgcgctcgcgcagcgcgagatccgtgtggtcagcgcatacggcggcgcggtcgagctgggcccgtatcgccacttcatgcagaaggaaatcttcgagcagccgcgggcgatcagcgataccgtgccgcagacggaagccttcgacgcgacgctgttcggcgacgccgcgcccgccgcgttcgcggagatcgacagcctgctgatcctcgcatgcggcacgagctactactcgggcctcaccgccaaatactggctcgaatcgatcgcgaagatcccgacccaggtcgagatcgcgagcgaataccgctaccgcgaatcggtgccgaacccgcgccagctcgtgctcgtgatctcgcagtcgggcgagaccgccgacacgctcgcggcgctcaagcacgcgcagtcgctcggccacacgcacacgctcgcagtgtgcaacgtcgcgacgagcgcgatggtgcgcctcaccgaaatgcagttcctgacgcacgcgggcaccgagatcggcgttgcgtcgacgaaggcgttcacgacgcagctcgtcgcgctgttcgtgctggccgcgacgctcggcaagctgcgcgggcacgtcaacgccgcgcaggaagcgcaattcctgaaggagctgcgccacctgccggccgcgctgaacagcgtgctcgcgctcgagccgcagatcatcgcgtggtcggaggaattcgcgcgcaaggaaaacgcgctgttcctcggccgcgggctgcactacccgatcgcactcgaaggcgcgctgaagctgaaggaaatctcgtacattcacgccgaggcctatccggccggcgaactgaagcacgggccgctcgcgctcgtcacggaagcgatgccggtcgtcacggtcgcgccgaacgacacgctgctcgagaagctgaagtcgaacatgcaggaagtgcgtgcgcgcggcggcgagctgtacgtgttcgccgatgccgacacgcagatcgtcaacgacgacggcctgcacgtgatccggatgccggagcattacgggcaactgtcgccgatcctgcacgtcgtgccgctgcagctgctcgcgtatcacaccgcatgcgcgcgcggaaccgacgtcgacaagccgcggaacctcgcgaaatcggtgacggtggagtaaggcgggacgaccgggacggccccgcgaagccgtcccgaccccgtatcggcccgtatcggcacgaaacaggccgatacgggcaggccattcggccaggtcgaaatatgtaccacgtagtggcatataatcctgtgctgacctgatcggcccgacgtgccggtaatcggcagcgcgggatcgtgccgagcaaggtcgggcaggcgcgggttttcgtattcctgttcgccaagcccgaccgggacgacatcgacgaacgcgaacggcgtgccttcagaaagctcgccgcgaatgtcgggcgccgcgccggcgccgatatcgcgacgctggtcacactgaaagagcgggtggagatttgcaatggccaggagtcgattcaagagcgacgcaacggaggcgacccacagcgccgcgtcgggcctctatcgtgccgcgttgatcgacaagaagacgatgcgcgaatacgacgatctctgcatcgaagccgccccgcggttcgatccggaagccatcgcccgcatccgcaaatccgtcaatgtcagccagagcgtgttcgcgctctacctgaacacgacgacgtcgacgatccgccaatgggaacagggcgacaagcggccgagcggcatcgccgcacggatgctccagatcgtcgagaaacacgggctcgaggtgttctcctgaaccggcccccgaatccccctgcacggccgcccccgcaccggataccgcgacgcgccccgcaacgaatatgacggagacacaatggtagtaagactctttggatgcggattgctggcgctgacgttcgcgtcgacgggctgggccgccgagcactacgtcgaagtctggaacccgcccgaggcgcggcagccggccgcccgcacgccggccgcgcataccggcgccgatgctcgcgccggcaagagcgtggagaagcacgcgaatgccacgccgaaagccgcggtgaaaccgcacaaacgccgtgtcgcgcaggcggtgaaagccggctcgcatcgtccgcccgccaccgcggccgaaacgccggccgctccgcgccccgtcgcgcagcccgcaccgggacgcctgacggtcatgcagccggctgcgcccgatgcgcagcacgcactgaattactccgacatcccgcggcaatacacaccggacggcaacgtgctgcgcgtcggcacgcacaaccgctccgcggaggtgactcgataatggaagcgcaaacctaccacggctaccagatctggggccacgcgatcctgcagcaggacgagatcttgcagcccgagcgcttcgcggcgagcggcacgatcacgcagaacaacaagctggtggaggcgtccggcgtgctcggcgtgttcgacaccgaggacgacgcgcgcgaagcggggctcgaatgggcccgcgcctggatcgacagccaccgttgagcgtgcgcaacctgcgcgccgtgatcgacgccggacacgagccggccgcgagccggcaatgaaaaaggggcgtcattgacgcccctttgtcattcgaaccaggacaactcaagccgcggcccgtggcggccgcaccgccgcctgcggccggccgacaaaccgtgccagcccgacaatcgcggccagcgtcgcgagatacgcgacgatctggatgcccgccggacgcgcggtatagccgatcagcgtatgcagcgccttgccgacgatgctcgattccttgagcagccacgacgtatcccagaccgcatcgccccacgacggcacgaggcctgccgcgagcaggaagccgacgcactggctggccatccccgccgcgagcagcacgatcagccagttggtgacggagaacaggcgcttcagcggaatttgcagcaggcccgcatacatcccgtagccgagcccggcgccgccgagcacgccgagcagcccgccgacgatcatctgcggtgtctgccccggatcgcccgccgcgatgccgtacaggaacagcacggcctcggagccttcgcgcagcaccgcgacgccgaccacgatcgcgagccctgtcagcggcttgctgccggccgcgacggcacgcccgaccgcggtcatctgcatcgccatctcgcgaccgtgccggctcatccagatgctgtgccatgcgagcatcagcgtcgcgacgaacatcacgcccgcgttgaagacctcctgccccatgccggacgcccattgcgagatcacgtcggcgaacgccgcgatcaggccggcgccgatcacgccgcccgccagcccgccgccgacccaccagccgcgccgcggcacgcctttcgtcgcggccatcacgatcgacaccaccagcgcggcctcgagcacttcacgaaagacgatcagggcagtcgacagcatgtccgtatccgcttacttgacggtcagctgcgtcttcgactgcgcttcgtgatactcgtcgtggaactcgtaggtcccggccttcagcggcccgaccaggatctccaccgacttgccggcaggcacgaccttctccgccttgaaatcgtcgctctcgaattcggcgggcgtcgcgtcgagattcttcacgacgaacttcaccttcttgccggccgggatcgtcacgccgtccggcgaaaacttgtgatccttcagggtcagattgacgacatcgtcggccgcgaatgcggacgttgccgatgcgcccagcagcgccagcgaaaagccgaaagcaaaacggttcatggggtaacgaattgaaatatcgaagggagctgatactaagatcgattcgcatttccaactcgcgtacccttactggcgacatggtgatcgtgctccatggagcgccgccacgccttgcccggcaaggcatccgccccgcttcgcccggaacgcttcaccgtcaatcgggacaagtgccgaatgacgtcaaaagcccgcccgccattcgtcagacgtcacctttacaacacgctgtcgccgcactactgtcgtcacaccggagccgcgacacggaacttcgtcgacacgcgtacgcttgaccttcccaccgtggcaagcttcatgctgtcgatgcttgtcaatcgtcaactcaggagaacacgatggaattcgaagtccaggacatgacctgcggcggctgcgccaatgcaatcacgcgcgcggtgacggccgccgatcccgccgcgaagctcgacatcgacgtcgcggcgaaaatcgtcaaggtcgagtcggcgcaaggcgccgagcgcgtgcagtcgatcatcgaagccgccggcttccaccccgcgctgcgcaccgcataacttacgcacaacgcgagcgcgggcacacgccgtacggcgctgcgcccgcgccccgcagtgcatcagcgcagccggatcagcgtcgacttcagttcggtgtacttctcgagcgcgtgcagcgacttgtcgcggccgttgcccgactgcttgtagccgccgaacgggaagttcatgtcgccgccctcgtcgtagcagttcacccagacggtgcccgcgcgcagccggcgcgacacgtcgtgcgcggtcgtcaggttcgacgtccacacggccgcggccagcccgtactcggtatcgttcgcgatccgcacggcctcgtcgacgtcgtcgaacacgatcaccgacagcacgggcccgaagatctcctcgcgcgcgatcctcgcatccggcttcacctcgaataccgtcggctccacgtagaagccgcccgtttccgccttcacgcgcgcaccgccggtgacgagccggccctcgctgcgcccggcctcgatataaccgagcacacgctcgagctggatgccgtcgacgatcgcgcccatcgacaccgacggatcgagcggattgccgggcacgtacgcacgcgcagccgcgacgagcttctcgatgaacacgtccttgatgtcgcgatgcacgagcagccgcgagccggccgtgcacatctcgcccatgttgtagaagatcgcaccggcggccgcctgcgccgcgcggtccagatcgggacaatcgggcagcacgatgttcggcgacttgccgccgagttcgagccacgcgcgcttcaggttcgactgcgcggcgtactgcatgatcagcttgcccactgccgtcgagccggtgaatgcgatgcagtcgacgtcgcgatgcagcgcgagcagcttgccgggctcgccggcccccggtacgacgttgaacacgcccgccggaatgccggcctcgtacgcgagctgtgcgacgcggatcgcggtcagcggcgatttctccgacggcttcagcacgacgctgttgccggccgcgagcgcggggccgaatttccatgcggccatcaggatcgggaagttccacggcacgacggcggccaccacgccgaccggctcgcgcgtgacgagaccgacgagatgatgatccgccggcgcgacctcgccgcccaccttgtcgatcgcttccgcgaaccattcgacgcaatacgcggcgcccggcacgtcgaccatcgtcgtgtcgccgatcggcttgcccgcgtcgagcgtttcgagcagcgacagctcgtcgaggtgctcgcgcatcagcgcagcccagcgcagcagcacggccttgcgcgcacgcgggttcagcccggcccacacgcccgtgtcgaacgcgcgacgcgccgccgcgacggccgcgttcacgtcggcttcgccgcaatcggcgaccttcgcgagcacgcggccgtcgatcgggctcacgcagtcgaacgtcttgccgccgtgcgcgtcgcgcgacgcgccgtcgatgaatgcgcgcccttcgatctcgagcgacgccgccttgtcctgccagtcagccaaagtcaacttgttcatcaggatgcctcagtttttggcattcgcgatgcgacgcgccgctgcgcgtgacgcgcagccggccggcagcgaatgcggtgatgcgcggtcgggaggtcagaaggtcgccggcgaattggccgagacgacctcgcagatcaggtccgcgctgggattgcgaaaacggtgcggcaaacggctttcgaagtaatagccgtctccggggtcgagcagccacgtcgcgccgtcgacggtcaactcgagccggcccgacacgacgacaccgccctcgtgccccgcgtgcacgagcatctcgggccccgtatcggcgtgcggctggtagacctcgcgcaggatgcacatgttgcggtccttcacgctcgcgccgaccagatgaaacgcgagcgtgtcgttgccgaggttcggcatctcgtcgcggcgcgacacgaccgaacgcgattcgacgagctcgaacgtgaagaactccgcgagactcatcgggatacattccagcagcttcttcagcgagccgaccgacgggctcacgcggccctgttcgatcagcgagatcgtgccgttggtcacgccggcccgcttcgcgagttcgcgctgcgacaggccatgcttgttgcgcacgaaacgcaggcgctcggcgacttcggtggacatcgattcggtttcggacacgataggtgcgatgacaaagtgaaacgacgcagtggacagccgttgaatattctaatcactttatgccgcacatcagcggggaaaaccctgaaaggcgttcgaaataatgaacaccccgtcgattattccgtttgcgaatcttttgtttgcactgctcgggaaagccctgatgcaacaccgttaaaaacatttgacgccgtttttggctcgtatatgctggctctcaggttcgcgtcatcaagcgttcatcggcagcaaaagcgttattgcaacgcaaaaattgatgcccttcgatgtaaatgacgcgtaaccggcgccttgattattttaaacgcccagtgcgtcgaaacggtcgggtgttcaatactttcaacaacccagtcgagtgtaatcgtgagagtccgtggccctctggtgaggtgggatcgaagcgtggcgcgaagttcgcgcagcgcggcatccccttccgatggcagttgcggctggcatagtcctcgcctgcagcatctgtcgatctacaccatcctttcccgtcgttccgttcggcgccacaacgccgtttccgcacgcgcattcgtcgccgtcgataccgacgaagtggcgtcgctgctgccgtagcgcctctcctttctttacgtcgttcgtttcgtttgctgattcgccaaccgcatggtccatgcggtgacggaacgcgttcgcgcattcgttgccgcgtcgcgtatcgcaatgaaacgaacgacggcctgatcgtcgcgcgcagcgcggatcgccacgccatcccgttgcgcccattcaccagcggccttgcgctttgcgccaggctgcggggctgttgcacgccggcgtttcgccacatccggcaagacatacgcgacaaccctccggataactgattgacgtcatggaaagaaggaaaccactcgtcggcatcaccgccgacctcacgcagatcggcccacacgcgtcgcatacggtcggcgacaaatacgtcgccgcgatcgtcgacggcgcgcaagcgttcgcgatggtgctgcccgcgctcggcgagcgccagtcgaccgacgacatcctcgacacggtcgacggcctgctgttcaccggcagctactcgaacgtcgagccgcacctgtacggcggcgaaccgagcgcacccggcacgaagcacgacccggcccgcgatgcgacgacgctgccgctgctgcgcgcggcgatcgccgcgggcgtgccggtgctcgcagtctgccgcggcttccaggagctgaacgtcgtctgcggcggcacgctgcatcagcgcgtgcatgaagtgccgggcttcgccgatcaccgcgaggacgacgacgcgccgatggacacgcaatacggccccgcgcacgtcgtgcgactgacgcccggcggcaagctgcacgcgctcgccggcggccgcgacgaagtgcgcgtgaactcgctgcacaagcagggcatcgcgcagctcggctccggcctcgccgtcgaagccgtcgcgccggacggcctggtcgaagccgtgagcgtcgtcgatgcaccggctttcgccctcgccgtgcagtggcacccggaatggcggcatgcgcaggacccgctgtcgagcgcgatcttccgcgccttcggcgatgcctgccgcgcgcgccgcgccgcccgcacgtgcgccacggccgccgccgcgctcgcctgagcgcgccgacccaaccaacgagaacagacatgcaagacatcgaagatttcctgaagcagtaccggatcaccgagatcgaagcgatcattcccgacatggccggcatcgcgcgcggcaagatcacgccccgcaacaagttcacgtccggcgaatcgatgcgcctgccgcaagccgtgatggtgcagaccgtcaccggcgaatatccggaagacggttcgctgaccggcgtgaccgaccccgacatggtgtgcgtgcccgacacgtcgacgattcgcctgatcccgtgggccgtcgacccgaccgcgcaggtgatccacgactgcgtgcacttcgacggctcgccggtcgagatctcgccgcgctacgtgctgcgccgcgtgctcgacctgtacaaggcgaagggctggaagcccgtcgtcgcgcccgagctcgagttctacctggtcgacatgaacaaggaccccgacctgccgctgcgtccgccggtcggccgcacgggccgcccggaaacgggccgccagtcgtattcgatcgaggccgtcaacgagttcgacccgctgttcgaggacatctacgagtactgcgaatcgcagaacctcgacatcgacacgctgatccacgaagtcggcgccgcgcagatggagatcaacttcatgcacggcgacgcgctgtcgctggccgaccaggtgttcctgttcaagcgcacggtgcgcgaggccgcgctgcgtcacaacatgtacgcgacgttcatggccaagccgatggaagacgaaccgggttcggcgatgcacgtgcaccagagcatcgtcgacgaggaaacgggccagaacctgttcacgtcgcccgaaaccggcggcgcgacgtcgatgttctacaactacctcgcggggctgcagaaatacacgcccgcgctgatgccgatcttcgcgccgtacatcaactcgtatcgccgcctgtcgcgcttcatggccgcgccgatcaacgtgcagtggggctacgacaaccgcacggtcggcttccgcatcccgcactcgggcccgtcggcacgccgcatcgagaaccggattccgggcgtcgactgcaacccgtacctcgcgctcgccgcgacgctcgcggccggctatctcggcatgacgcagcgcctggaaccgaccgagccgctcgtcagcgacggctacgacctgccgtaccagctgccgcgcaatctcgaggaagggctgacgctgatggccgcgtgcgagccgctcggcgagatcctcggccacaagttcctgaaggcgtatttcgcgctgaaggaaaccgaatacgaagcgttcttccgcgtgatcagctcgtgggaacgccgccatctgctgctgcacgtctgagcgtgcacacaaccgaatacggaaacacggaggaaacatgacgtaccgcaacgaatctgcctggatccagcccgccgcgccggccgccgcaccgcgcacgacgcaggcgcgctcgaccgccgaataccgcgcactcgacgccgcgcaccacatccacccgttctcggacatgggcgcgctgaaccgcgcgggcagccgcgtgatcgtgaaggccgacggcgtctacctgtgggactcggacggcaacaaggtcatcgacgggatggccggcctctggtgcgtgaacgtcggctacggccgcaaggaactcgccgacgccgcgtatcgccagatccaggaactgccgttctacaacaccttcttcaagaccacgcacccgccggtgatcgaactctccgcgatgctcgcggaagtcacgccgaagggcttcaaccacttcttctattgcaacagcggctcggaaggcaacgacaccgtgctgcgcctcgtgcaccagtactggcgcgtgcagggccagccgcagaagaagtacgtgatctcgcgcaagaacggctaccacggctcgacgatcgcgggcggcacgctcggcgggatgggctacatgcacgagcagatgccgtcgaaggtcgagcacatcgtgcacatcgaccagccgtatttcttcggcgaggcggcggccggcgaaacgccggaagcattcggcctggcccgcgcgcagcagctcgaggcgaagatcctcgaactcggcgcggaaaacgtcgcggcgttcatcggcgagccgttccagggcgcgggcggcgtgatcttcccgccgtcgacgtactggccggaaattcagcggatctgccgcaagtacgacatcctgctggtggccgacgaagtgatcggcgggttcgggcgcaccggcgaatggttcgcgcaccagcacttcggcttcgagccggacctgatcacgatggccaagggcctcacgtcgggctacgtgccgatgggggccgtcggcattcacgagcgcgtggcgcggccgatcatcgacaacggcgaattcaaccacggcctcacgtactcgggccacccggtggcggcagccgtcgcggtcgcgaacctgaagctgctgcgcgacgaagggatcgtcgagcgcgtgaagaacgacacgggcccgtacttccaggcgctgatgcgcgagaccttcgcgcgtcacccgatcgtcggcgaagtgcacggccacggcctcgtcgcgagccttcagctcgccgaggcgccggccgaacgccgtcgcttcgcgaacggcggcgacgtcggcacgatctgccgcgacttctgcttcaacggcaacctgatcatgcgtgcgaccggcgaccggatgctgctgtcgccgccgctcgtgatctcgcgtcaggaaatcgatgaactcgtatcgaaggcgaaaaagcagtcgatgcaaccgcccagcaactgggtatttcgtaacggttttgcctacaggcgtgcggcgggcgccgcacgccgccataaccagggaattccaccatgcgtgcctgctttcttcgccaagcctgttccgttgccgcccttgccgccgcggccgcgtttacgtcggtcgccagcccgtcggcgcatgccgaggacctgaacgtctacaactggtccgactacatcgcaccggacacgatcccgaacttccagaagcagacgggtatccacgtcaagtacgacaactatgacagcgacgacacgcttcaggcgaagctgcttgccggcagttcgggttacgacatcgtcgtgccgacgtcgaactacatggccaagcagatccaggccggcgtgtaccagaagctcgacaagtcgaagctgccgaacctcgcgaacctcgacccgctgctgatgaagatgatctcggacgccgatccgggcaaccagtacggcgtgccctgggcctacggcacggacggcatcggctacaacgcgcaggcggtgaagaaggcactcggcgacaaggcgccggtcgacagctgggcgctggtgttcgatccggccaacatggaaaagctgaagagctgcggcgtgtcgttcctcgaccaggccgtcgacgtgttcgccgcgacgctgcaatacatgggcaagaacccgaacagcaccaaccccggcgactaccaggccgcgttcgaagtcctgaagaaagtccgcccgtacatcacccagttcaactcgtccggctacatcaacgacctcgcgaacaacgacgtgtgcgtcgtgctcggctggtcgggcgacgtcggcatcgcgcatcgccgctcggccgaagcgaagcgctcgtacgacatcaagttctcgaatccgaaggaaggcggcctgctgtggttcgacgtgatggtgatcccgaaggatgcaccgcaccccgaggccgccctgaagtggatcaactacgtgtccgatccgaaggtcaacgcggcgatcaccaacacggtgttctacccgaccgcgaacaaggccgcgcaccagttcgtcacgccggccgtcgcgcaggacccgaccgtctacccgcccgaagacgtgctgaagaagatggtgctgatgaagccgatgccggccgacatcctgcgcctcgagaaccgtctgtgggcccagctgaagacgggccactgatcgcgaagcattccggcggcgcaggcatcgcttcacgcctgcccgcctgagatccgcggacttccatccgcccgcgcgccgcgcgcactgttccatccggcacgagccgttgtccgtgagtcgcattgtgcgcctcgcgcggggacgctcacgcctgcaatccgtgaagaacgaatggtgaatcccatgcaatcgataccctcttccgctgctgcacgacagacccaaccggcccccgcggcccgtacgcaaaacgacgccttcgtccgcatcgaaaacgtcgtgaagaaattcggcgacagcacggccgtcgacaacgtgaacctgacgatcgcgaagaacgagctgttcgcgctgctcggcagctcgggctgcggcaagtcgacgctgctgcgcatgctcgccgggctcgagacggccacctccggcaagatcttcgtcgacggcgaggacctcgcgtcgctgccgccgtaccgccgcccggtcaacatgatgttccagtcgtacgcgctgttcccgcacatgacggtcgaatcgaacgtcgcgttcggcctgaagcaggaaggcacgccgaagaacgagatccgggaacgcgtggccgacgcgctcgcgctcgtgcagatgagcaagtacgcgaagcgcaagccgcatcagctctccggcggccagcagcagcgcgtcgcgctcgcccgctcgctggtcaagcgcccgaagctgctgctgctcgacgagccgatgtccgcgctcgacaagaagatccgccagaagacccagctcgaactcgtgaacatcatcgagaaggtcgacgtgacctgcgtgatggtcacgcacgaccaggaagaagcgatgacgatggcgagccgcctcgcggtgatgagcgaaggcaagatcgtgcagatcggctcgcccggcgaggtctacgaatacccgaacagccgtttctcggccgaattcatcggctcgaccaatctgttcgaaggacgcgtggtcgaggacgagcccgaccacatcttcgtcgaaagcgacgacctcgaagcgcgcatgtacgtgagccacggcgtgaccggcccgctcggcatgccggtcggcatctcggtgcgcccggagcgcgtgcacgtgtcgcgcgagaagccgggctcgaaacacaactgggcgcgcggcgtcgtgaccgacatcgcgtacatgggcagctactcgctgtaccacgtgcgcctgccgagcggcaagacggtggtgtcgaacctgtcgagctcgcacctgatgaacgataacgcaccggcgtggaacgacgacgtgttcgtgtcgtggtcgccggccagcggcgtcgtgctgacgcagtgaggacgccacgatgagaacctccgcttccactccgtccgcgccggtgtctgccggcgccgcgagcaccggcgccggccgcgcgcgcccgggccgcttctccatgctgtcgcgcttcctgccgtcgggccgcagcgtcgcgatcggcgtgccgttcgtgtggctcgcgatcttcttcgcgctgccgttcgtgctggtgctgaagatcagcttcgccgaccaggtgatgggcatcccgccgtacacgtcgctcgtcgagatcaaggacggcgtcgtgcacttcgcgctgcagctgtcgcactacgcgttcctgctgcaggacgacctgtacatcgcgacctacctcagctcgctgaagatggccgccgtgtcgaccgtgctgtgcctgctgatcggctatccgatggcgtactacatcgcgcgctcggaaccgaaccgccgcaacgtgctgatgatggccgtgatgctgccgttctggacgtcgttcctgattcgcgtgtacgcatggatcggcatcctgaaggacgacggcctcctgaaccacacgctgatcgcgctgggcatcatccacacgccgctgcgcctctatcacagcgacgcgggcgtctacatcgggatggtctattcgtacctgccgttcatggtgatgccgctgtacgcgcacctcgtgaagatggacctcacgctgctcgaggccgcatacgacctcggtgcgaagccgtgggtcgcgttcacgcgcatcacgctgccgctgtcgaagaacgggatcatcgccggcagcctgctggtgttcatcccggcggtgggcgagtacgtgattccggaactgttgggcggcgccgacacgctgatgatcgggcgcgtgatgtgggatgaattcttcaacaacatggactggccgatggcgtccgcggtgacggtcgcgatggtgatgctgctgctggtgccgatggcgctgttccagtactaccaggtcaaggaactggaggacgcgaaatgatcaagccgagcaaaccgctgtcgacgggcgtcctcgccttcggcttcctgttcctgtacatcccgatcatcagcctggtggtgtactcgttcaacgagtcgaagctggtgacggtgtggtcgggcttctcgctgaagtggtacagcgcgctgctggacgacgacgagctgctgaccgccgcgtggctgtcgctgaagatcggcctcttgacggccaccgcgtcggtggtgatcggcacgtgggcgggtttcgtgctcgcgcgcttcggccgtttcaagggcttcacgctgtacacggggatgatcaacgcgccgctggtgattccggaagtgatccagggcatctcgctgttgttgctgttcgttgcgctggagcagatgttcggctggccgaaggggcgcgggatggtgacgatctggatcgggcacgtgatgctgtgcgtgtcgtacgtggcgatcatcgtgcagtcgcgcgtgaaggagatgaacaagtcgctggaggaggcggcgctcgatctgggcgcgacgccgctgaaggtgttcttcgtggtgacgctgccgctgatctcgcaggcgctgctgtcggggtggctgctgtcgttcacgctgtcgatcgacgacctggtgctgtcggcgttcctgtcggggccggggtcgacgacgctgccgctggtggtgttctcgcgcgtgcggctggggctgaacccggagatgaacgcgctggcgacgctgttcatcacggcggtgacgatcggcgtgatcgtcgtgaaccggatgatgatcgcgcgcgaacggcgccgcgtggccgacatgaaggcggcgttcgcggtggcgtgacgacgcacctccggcttcgaagataactagcagtgcagacaagcaaggcgcgctgccccagggggcgcgcgattcgatcccgatttgacaggcgcacgacaaggagaatccgcaatgaagaagaaactgatctgcctgctggtggccggcgcgttgccgggcatcgcgctggccgactcgacatccgccgagatcaaggcgctgcaggcgcaggtcgcggcgctgcagaagcagatgaaggcgatgcaggcgcagctttcggcgaagggcggcaccgcgaccgcccaggccggcacgaaggccgcgccggtcgccgtggccgtcgatccgggctcgccggactacggcaaggcgcaggcgacgctgaccaacgacgaagtcggcgaaatgaagcagcagatcgcgaaccagcagctgaaggtcgattcgctgacggacgcggccaacacgggcccgctggccggcctgtcggtcacgggctacatcgacccgacctacatctacaaccgcgcagccggtacgtcgtcgttcctgttcgcgaaccacgagaacgcgtacaactacttcaacagcacgttcggcgatctctacctcgacatcaagaagaccttcggcgtcggcccgatggcaccgtcggcggaaatcacgctgatgccgaaccgcggcaacggcatcacgctgttgcagaactcgcgcggctcgatcaccgacaacctgctgaacacggcggtcatcaacgtgccgatcaccgccgagacgacactcgtcgccggcttgatcccgagcttcggcggctacgaggtgcagcagtcgaaccagatgctcacgctcacgcacaacctgctgtacgatttctcggatccgggcagctacgtcggtatcggcgcgaactacacgaagggcaactgggcgtggaagttcttccttggcaacgagcagtaccgcacgtacggttcggtcacgcagaagggcaccaacgcactcggcgacccgatcacgaccagcaacaaggtgccgaccttcaccgcgcgcgcggactacacgtggtcgagcgcgctcgatatcggcgggtcgttcaacatcgggcggcagacgctcgcaagcgcgctcgatgcgaacggcaacgccaactacggcccgggcggtgcggcaccgagcgcgtacggttcgttcttcttcggtgaactcgacgcgacctacacgctcgccgacattcagtacaacgcggaagtcgactacggccgtcagcagcatgcggcgttcaacggcgggctcgctcagtggtacggcctgtcgctgctcgcgcaccgcaagttcaacgcgccggtggtcggccgcatgggcgtgacgctgcgctacgacctgctcgccaactcgaagaacggcggcggcggcggcggcatcgcgctgaacggcaacgggatggatccgagcaacggcttcggcgtcgacgcggactgcctcgcgcagtcgaaggccggcggcggcctgggcttcgagtgcaagggcgcggtacgccaggacgtcgcgctcgacctgctgttctatccgacccagcagatcaccgtgaaggtcgaataccggcacgactgggcgaacaacaaggtgttcctgcgcaacgacgggtcgtacggcaagtccaacgacctgctcgcgacgcagttcatctattcgttctgacgcagcacacgcgggacgccgtgccgcgcgcacggcgtcccgcgccgtttaccggccgccgcacgatgcatcgcgcatcgcgtgccggccgcaacgagggagtcggtctgatgacgcagtctttcacccgccgcgccgatgcgctcgcgcgcgactcgtactacgaggcgacggccgtgcggccggccgccgacgacccggtgctcgaggacgcgatcgacgtcgacgtctgcgtgatcggcgccggcttcgccggcctgtcgacggcgctcgactgccgcgcgcgcgggctgtcggtcgcggtcatcgatgcgcaccggcccggctggggcgcgtcgggccgcaacggcgggcaggcgatcaccggcttcgcgaaggacgaggaaatcgagcggcagctcggcgccgacggcgcacgcgccgcgtggtcgctgtcgctcgacggcgtcgcgctgatcgccgagcggatcgcgcgttacgggatcgactgcgacttcacgcgcggctacctgacggtcgcgacgaagccgcgccgcatcgacgacctgcgcgcgtggatggacgccgcgaccgcgcgctggggccatccgtcgctgtcgtggctcgacaccggcgcgatccgcacgcgcatcgcgtcgacgcgttatctcgcgggtgtctacgatccgctgtcggtccacctgcatccactcaagtactgcctcggcctcgccgaagccgcgcggcgcgaaggcgtcgcgctgtacgcgcacacgcccgcactcgacgtcgtgcgcggggcacggcccgtcgtgcgcacgccgtcgggcgaggtgcgctgccgcttcgtcgtgtcgtgctgcaacgcgggtccgggcggcgtgctgccggccgcgacggctgcccgcatcgcgccggtcgcgtcgtacatcatcgcgaccgagccgctcggccaggcacgcgccgatgcactgatcgcgcagcgcgaggccgtgtgcgacaacaacttcttcctcgactatttccggctgtcggccgaccaccgcatgctgttcggcggccgcgcgaattcggccggcgcgtcacccgccacgctcgccgaaacgatccggcggcgcatggtcggcgtgttcccgcagctcggcgacgtgcgcgtcgaccacgcgtggggcggcttcgtcgacgtcacgcgcaaccgcgcgccggatttcggcgcgctcgatccgaacttcttctacgtccagggcttcagcgggcatggcgtcgcgctcaccggcgttgccggacgcgcggttgccggtgcgatcgcgggcgacacgcgcgcgttcgacctgttcgcacgcatgcgccaccggcgcttcccggcggcgacgcgtggcggcaacccgcgctcgagctcgggatgctgtaccaccgcgtacgcgagctgttctaagcccatttatccgtcctcctgaccatgcagacattcgccaaccagccgcacgtcgcgtcctactacgcggcgaccgccaacgatacgacccgccacgcgccgctcgccggcacgatcgatgccgacgtgtgcgtgatcggcgcgggcctcacgggcctgtccgccgcgctcaaccttgccgagcgcggccattcggtgaccgtgctcgaagcgtcgcgggtcggatgggcggcgagcggccgcaacggcggccagctgatcggcgggttcgcgtgcgatatcgatacgtttgcgcagttcatgccggaaggcgacgtgaagcgcatctgggacatggggctcgaaacgctgtcgctcgtgaagtcgcgcatcgcgcaacacgacatcgactgcgcgctggtgcccggctacctgaccgccgcgaacaccgaacgcgatgccgattcgctcaagcgctggcgcgacgaggccgcgaagcgcttcggctacgaccgcttccacttcgtcgaagccgacgaactcggcgactacgtgcagtccgaccgctattgcggcggcctgtacgacccggacagcggccacctccatccgctgaactacacgctcggcctcgcgcgcgcggccatcggtgcgggcgtgcgcatccacgaggacagctgcgtgacgcgcgtgcgcgacgtcgcgggcggccatgtcgtcgagacgagcggcggcaacgtgcgcgcacgcttcgtcgtgctcgcgtgcaacaccttcgtcggcacgctcgcgcccgcgctgtcgaagaagatcatgccggtcggcacctacgtgatcgcgaccgagccgctcggcgaagcgcgcgccgccgcgctgatgccggcgcgcgcggcgatctgcgacagccgcttcgtgctcgactatttccggccggcgcccgacacgcggctcgtatggggcggcaaggtcagctattcgacgcgggagccgcgcgatctcgccgcggcgatgcgcgcggacatgctgaagacgttcccgcagctcgcggacgtgaaggtcgactacgcgtggggcggcttcgtcgacatcacgatgaaccgcgcgccccacttcggccgcatcgcgccgacgatgtatttcgcgcagggcttctcggggcacggcgtgaacacgaccgcgctcgcgggcaagctgatcgccgaggcgatcgacgggcaggcgagccgcttcgacctgttcgacaagatccgccatcgcgacttcccgggcggcgaggcattgcgcacgccggcgctcgtgctcgcgatgagctggtaccggctgctcgacgcgttcggcgtgcattgagcggcgcgcgggcgacgagcgtcgccgcccgccatgcaaaacggccgcgcgaacgcggccgcctggtgccggatgtcgcggcgccggcgcggcaggcaggcgacctggcctgcccgaccggccgaagccgctgcatccgcgcgggtcagtcagtcccgtacttcggcgagtgcggcccgtacagcaacccgttcggcggccccgccgacaacaacctgctgctggtcagcccggccacatcgtgcgcttcgtcggtcagcgaatgcgcgacctgcttgacggccgcctgcaccagcatcccgacgacaccgaacgcattgacgctcatggagttgccgacctccttgccggtcgcacggccctcgccctgccacagcacgtcgccgctcttcaggtcgacgagcttcgccgacgccgcgaccaccgtcgtgctgtccaccacctggtagacggagccgtattgcgtgatcttcgaatagagcgcggcatccgcaccgaagatctcgcgcagcttcgccggcgacgtgttctggatctcggccgcgttggcgaggccgttctgcttgaaggtctcgtccatcaccgcgaccggcaccacgtagtagcccgactcggcgagcggctgcgtcatctgcgacagcaccccgtaggtcgcgccgacatcggtggtctcgttgaccggcggcagcacgaggatcgagcgcggctggctcttcttgaaggccgtgtagtcgggacgcttgacgggttgcgcgcatgcgctcagcagcgcgacgagcgacagcacggacagcagcttgaatgaaagtgtcttgatcatggcacgcacgttactgttgggcgggagtcggatcggcttgcttccggccggcgatcgtctggtcggcggccttcgggttcgcggcctgcggattcacggccttcgggttcgcggccctggcatcgccggccttcttcttcatcaggaaatccatgtacggcgcggattccggaaagagcgccttctcggcctcgaacgactgcgtggcctgttgcccgttgccgacgctcgcgtagagcatcccgagatgcgcatggaagccgggcggcggcttgttacccttcgcgcggatctcctgcagcgccttctcgagcgcgtcgatctgctgttgcggcgagctttgccccttgaagtattcgtacacctgcggctgatagccgttccactgatagagcggcggcgtggtcggcgccgcgcagcccgcgagcagcatggcggccgccgtcgccggcagccagattcccgtttcatggtcttgtctctttcgatgagtgagtgattcgtcgagcgcgtgtcgcgcacggcgcttactgcggcaccttcagcgtgccggcgtcgacctggtcgacgagatggttcacggcctcctggatcgcgagatccagcaccttgccgttgagcgtcgagtcatagccggcggtgccgccgaagccgatcacctcgcggttcgacaggctgaactcgcccgcgccctggctcgatgcgacgacttccgacgtcgtcgtgtcgacgatgttcaggttgaccttcgcgtatgcgacctgcgtcttgccgcggccgaggatgccgaacagctggtgatcgccgacgtccttgcggccgaattcggtcacgtcgcccgtcacgacgtaattcgcgcccttcaccgcctgcgccttcttcatgaagccggcttcctgcttgatctcgtcgagattctcgcgatcgagcacgttgaagcggcggctctgctgcaggcgcgtgacgaggatcgtcttcgcctgcccgccgaggcggtcgatgccgtccgagaagatgccgcgcatgtagctcgagcggttgtcgaacttgccgaccgcgatcgcgacgggcttgcccgcgtacggtttctgcgcgctgctcacggccggcacgtcgagcgtgcgcgacgattcggtcgcgcagccggacagcgccgcaacgagcgccgccgccacgaggacggtgcgtcgtgtctgaatgttcactgttggtctccttgtgtggaaagatggcccgggaacgggcacgccggcttgcaaacgacccggcggtcgaaacggttgcggtgcgaacggggatgcgtgcatcggcgcgatggacgcacgcgcgttcatcgccgcaccggcggtggcagtagatgagtgaaaggggcgcgcaacccgtgcgttgcgacgacatgcggatgcgcggcgcggtacgcgacaggctcgcgcgcgacggctacaccgttattctggttactgcgctgttgatcgcgcatgatcggccccgtatatgatttttcgcgatcatatcaagcctgcttatcaagatgaggaatcttgataatagttgacgattttcttacttatccgacgcgcgcggtcgaatcggcgcaattcctcgccgacaggggctttgcaggcatgtggacgcagcgtgccgattttcctttgttgtctccggcgatcgatctcgaatccggcaatatcaagatatattgtccgtaccgcccatccgcattacccatatcccgagaataatcaccgaaatccggctgcctttaccgcacccgacgggttcgccggtcacgatgcattccggcaatcctgccgcgcgcacgtacgaacgcgcgcgcatccgcgcccgctagtcggccaccttctgccgcatcgtcacgaactcctcggccgcggtcgggtgaatgccgatcgtgtcgtcgaactgcgccttcgtcgcgcccgcgcgaatcgcgatcgcaatccctggatgatctcgcccgcatcgcggccgaccatgtgcgcgccgaccacgcgctggctgtcgcgcgcgacgacgagcttcatcagcgtgcgctcatcgcggcccgacagcgtgtggcgcagtgccttgaacgacgtgcggtagatgtcgacgtcgccgtcgtaaagatcgcgcgcggtcgcctcggtgagaccgaccgtcgcgacctcgggctggctgaacaccgccgacggcacccattcgtgatccgtcgcgacacgcgacccgccgaacagcgtgcgggcaagcaacgcgccgtcgcgcgtcgccaccggcgtgagctgcggccgcgacgtgacgtcgccgatcgcatggatcgacggcaccgacgtcgccgaatacgcatcgacggcaatcgcgccacgtgcgtcgagcatcacgcccgcctgttcgagcccgagcccgtcgacgttcggcacgcggccggtcgcatacagcacttgatcgtacggcccgtgccgcgcatcgccgacgcgcacgctcagcgtgccgtcgtccgcgcgttcgatcgactcgaccaccgcacgcgcatggatcgtgacgccctgcttcgtcatctcgtcggtgagaaactggcgcacgtcgtcgtcgaagccgcgcaggatcttctcgccgcgatagaacaggtcgacgtggctgccgaagccgttgaagatgcccgcgaactcgaccgcgatataaccgccgccgaccaccgcgatgcgtgcgggccgcgcggcgagcgacaacgcctcgcgcgacgtgatcgcatgttcgatgccgggccgcgccggcatcgacgggcgcgagccggtcgcgatcgcgatgtggcgcgcgcggatcgtgcgttcgccgatcgcgaccgtgtgcgcatcgacgagcgtcgcgcgtccggcgtgcatctcgacgcccgattgccgcagcaggttgatgtagatgtcgctgagccggttgatctcgcgatccttcgcggcgatcagcgcgggccagtcgagcgtgccggcgccgaaggtccagccgaagcccttcgcgtcctcgacttcgtgcggatagtgcgatgcgtagacgagcagcttcttcgggatgcagccgcgcagcacgcaggtgccgccgatctgctcttcttccgctatgccgacgcgggcaccgtacgacgcggacatgcgcgcaagccgcacgccgcccgagccggccccgatgacgaacaggtcgtagtcgaaatccatcgcattgcctcatcgcagttcggatgcaggcacgatagcaagattccggatttcttgcggcacatggtgccgccgcgcgcacgcccaataaaaacggcgagagacgttgcctctcgccggtcaaaccgactgccgggtgtgccatgcgtcaccgatcgaccgcatgcccgacctgccggctgcgcggcaccggcccggccgggcgcgcgaagggcgcgcccacggccggaccagccgccatgctcatgcctgcgacgtgtcgctgccgtccgtcgcctgcgtgtcgtctgcctgctgcggctgctcttccttcttctcgagcatgccttcgatcgcttccgcgcccttgaagccggcgacggcggctgccgccttggtcagcaggcccgcatccggatccagcttttccgcgccttcgacggctgcgattgcgccggcgatttcacccacggtgttcaggatacccatcgtcatcccctttcaagaaaatcgtgagcgcatcgtcccacgaaaaaccggcgaaccgcgattgtcatcaccggatacacaagttacgcaccaggccggccgcgctcgccgagcgtgaccggaacgacgcacgcgcgagcctggcggcacgcaacgggcgatgcacgcagcgtagcggaaaggcttcgcgcgcactgtaaaagtatgttctggattgccgacggttcccttacggcgcgggggtctcgtgatggagcattcgccgaatagtcgtgcgcgcgtatgaaggtcgcatgacgaaaaagaggcgcctcgcggcgccccttcgatgcatgccggacgactgccggcgcatgcgttccgacgttcgtcagaagatattgcgcaggccgatcgcgatgccggtctggttgctgcggccgggcagctcgacgttcgccgcgccgttcgtcttgttgaagtcgacggtgccgtagatttccgtgcgcttgctgagcgcgtactcggcgatgccgacgatcgcgtagcggttgccgctcgcgagcgtgccgttcgtggtcatcgcattgcgcatgtggtcgtagtagaacgcgcccgtcagcgtcagcggtgcgctgacctgccagctcacgcccgcgaacggaccgtcgtcgatccggccggtgcccttcgcgaccggaatcgactgctgggcgagcaggctgtcgacgaagcccgtgtcgtccttcgagcgcaggtagcccgcgtagatcttcgccttgctgaacgcatacacgacgttcgcgtggtagatcgtctgcttgcgcgccgagttgtcgctgttctgctgcgcaccggccgcgatgctgagcgggcccatcacgtacgacagcgacacgccccacgcattgcccttgccgagcgaacccgggatctggcccgagaagccgccggcgccggtcgattcgtagttggtgccggtcgagtacatcgccttcgcggtcaggccttcgaacttgcccgtgtacttgatctggttgtccgcatacaggccgccgccgagtgcgaccggcaaccatgcgttttcgaggtagttgccgaccgtcagcggatcgtaggtgtccgacagcaggtcgaacagcggcgtcttctggcggccgagggtcaccgtgccgtacgggctctgcaggccgacgtacgccgcgcggttgaacaggcggccgctgtcggcgaatgcgccgttctgcaggttcacgccgctttcgaggttgaacacggccttcaggccgccgccgagatcttccgtgccgtagatgccgaagcggctgttcgtgatcgcgccgttggtcatcgacagcaggccgtcgttcttggcgttggcgttggtgagatagcgaatgctggcgtcggcgacgccccagagcgtgaccgagctttgtgcggccgcgtactggctggcaaatgcgagcgcggcgccctgcgatggctgcgagtcgtgtggtctgcttcatgagctttcctgtttgtaggtgtctccgttcatggccggccgcgtgcgcagccgggtggcgatcgcgcgcgttcttggcgcgcgcgatgtgggctgaatcatatgacgactgcaatcgctgaaagaaattgaaatgcgcggtaacggcggaactgtcgcccgcgcacaacgccgcgcgcgcgaggcgcgccgggcgggcgtcggatgccgcacggcatcctccggccacgcggctgacgggatgtcgggtctgtaagcatcgccccgcaggcgcggggaacgggcaggcggccggaagtgccggcgggcggcgccgtcacgccaccgacgacggctcgccgggcgtctcgcgccggcgccaggcacgccggaggatctccgcgaacgcaccggcgagcagcagcacggcgccccacagcgcgagctccggcacgagccgcgtgacgaggccgccgatcaccgcaccggccaggaagcagaagctgatcgtcgcgagcagcgccgagtcgtgcagcgcgcccgcgtcgtagcgcgggatcagcccgacgaacagcttctgcgcggcgcggcgcaggttgccggtcgtcatcaccgacgtgtacgacagttcctcgagatgggtgaacgacagcgtctgcagcgtcgcgacgaacgaaatgcccggaatcagccatgcgctcgacgcgccgacgagcccgctcgcggcgacgccgagaaaggcgatctcgacgagcaggctcgcgaatgcggtatgccgcatccagccgcgctgcgcggcgaggccgagcaggtgcgcgacgaacaccgcgaccacgaagccgccgagcggcggcacgtggtgcagcgcggccgcccattcgccggccgacacgttgatgccgagcagcgcgacgttgcccgtcatcgtgttcgcgaacacgtggccgtggcccacgtacgtgtatgcgtcgaggtagccgcctgacagcgtcagcaacgcggcgacagtgagattgcggctggcgccgtcgagatccatcgagcctcccgtgaagattcgcgccagtatggcgcacgggacgttaccgtgcgccggtcattgcccgatgcccgtgagcccgatcagcgcgccgcccgcgagcagccacagcggatggatgcgcgtgcgccacgcgagcaccgcgcacgcggcggtgatgccccactggatcgccgtgcggttcgacgcctcggagatcagcaccgcgctcgccgcgacgagcccggccgtgacgggcatcatcccctgctgcacgtagcggcgccacggccggtcgcgaaagcgctcccacgcatgcagcgcgagcacggtgacgatcgacgacggcccgaacttcgcgagcgacgcgaccagcagcccgctccagccggccacgtgccagccgaccagcgacacgatcatcatgttcggcccgggcgccgcctgggccagcgcgaacagcgcggtgaactcgtgcgcgctcatccagtgatggacgtcgacgacctgccgctgcatctccggcaggatcgtgttgccgccgccgaatgcgagcagcgacaactggctgaagatcgtcgcgatggcgatcagcgtgtcgttcatggccggcctcccggctgcgtgtcgcgcgccgcggccggcgccggctgcggcgtgcccgcgtcgcggcgccgcgacgcgagccagatgctgacgggcgtcagcacgagcatcgcggtcagcagcgggatgcgcagcaccgcgatcgcgacgaacgcgagcgccgcgatgccggccgccgcgcgcgcgtgccgcagcggcttcgcgaccttcacggccatcgcgacgagcagcccggccgcggcggcggcgagccccgcgaacaggtgctgcacgcgcggatcgttctgcgtcttcgcatacagcacgccgagcgcgacgacgacgagcgtcgggcccgcgatcagcccgagaatggcggcgaacgcgccggccacgccgcgaaagcgcatgccgacggccaccgacaggttgatcacgttgccgcccggcaggaactggcacagcccgagcaggtcggtgaattcgtcggcggaaagccacttgcgctcgtcgacgatggtgcgccgcgcgaacggcagcgcgccgccgaacgacatgaggccaagcgacaggaagccggtgaacaactcggcgaggccgatgcggcgggaggacgcggccggcggcggggcggcgggcggaaaggcggattgcatggggctcctcatcaaacggtgaaccgaggttaccgccgttcggcaggcctgcaaaacgattttatcggcgcgcccttgtgatctagaatcacaagcatggcacgcgatctcccgcccttttccgcgcttcgggcctttgaagccgcggcacgacatgaaagcttcagcgccgccggcgacgagctgcatgtgactcacggtgccatcagtcgccagatcgccgggttcgaggcatggctcggcaagccggtgttccaccgctacggcaagcgcgtgaagctcaccgacgaaggccgccgctacctggacaccgtgcgcgcggcgttcgacagcatcgcgcacgcgaccgagcagctgcgcaacaccggcgcgacgcgcgtgctgcgcatcaacgcgctgccgaccttcgcgatgaaatggctattgccgcgcctgtcgcggttccagcgcgacgtgccgaacgtcgagctgaagctgtcgacgtcgaacgcgccgctcgacgcgctcgacggtttcgacgtcgcgatccgccgcggccccggccactggtcgaactgcacgagcggccacttcctcgacgaaagcgtgattccggtctgcagccccgcgctgcttaaacgcgcgccgatcgcgcgcgcggacgatctcgcgcgccacgtgctgctgcattcggatacgcggccggaaggctggcgcgactggttcgcggcggccggcgtgacgatgaaggggcgcaagcggcagtcgttcgaccacttctacctggcgctgcaggcggccgtcgacgggctcggcgtcgcgctcggcccgttgccgctgatcgacgacgagctcgcgagcggccggctcgtgatgccgctggcggggccgcgcatcgcgacgcgcagctactggtggatcgcgccgcgcgcaccggccgacgatccgctcgtcgcgcagttctgcgcgtggctgcaggcgcagtcgaataccggcgcgtgaggccgcgccggcgggcggcatcgcgccgcccgctcccggtcagaccaccgggcccggttcctttccttgcgcaggatcgcgtacaggatgatcgcgccgaacgtcgcggtgccgatcccgccgagcccgaagccgccgatcttcagcgagaagtcgcccgcgccgagcacgagcgtgacggccgcgacgatcaggttgcggttgtcggagaagtcgaccttgttgacgacccagatccgcgcgcccgtcaccgcgatcagcccgaacacgacgatcgacacgccgccgagcacggggcccggaatcgtctggatcaccgcgccgaacttcggcgagaagccgagcacgatcgcgatcagcgcggcgaccgcgaacacgagcgtcgagtagatccgcgtgacggccatcacgccgatgttctccgcgtaggtcgtcacgcccgtgccgccgacgctgcccgacacgatcgtcgcgagcccgtcgccgatgaacgcgcggcccacgtagcgatcgaggctggtgcccgtcatcgcgctgacggccttgatgtggccgaggttctccgcgaccaggatcaccgcgatcggcgcgagcatcagcatcgcgtgcggatcgaacaccggcgcgcggaagctcggcaccccgaaccaggccgcgtgcccgacgatcgagaaatcgatcggcttgccgagccccatcccgttggtcgcgaccgcatagatcgcgtaggcgatcacgagcccgacgaggatcagcaggcgctgcaccatgccgcgcgagaacaccgcgacgccgccgacgcacagcaccgtgacgagcgccatcaccgattcgaaggtcgatgcggacacgcccttgaccgcgatcggcgcgaggttgagcccgatcaccgcgaccaccgcgccggtcacgaccggcggcatcagcgtctcgatccagcgcgtgccgatcgcctgcaccagcgcgccgagcgcgacgtacacgacgccgcacgcgacgatcccgccgagcgcgaccgggatgttcgggttcgggccgctgccgccgtaaccggtcaccgcgatcacgaggccgatgaacgcgaagctcgagccgaggtagctcggcacgcggccgccgaccagcacgaagaacagcagcgtgccgatgcccgacatgaagatgcacaggttcgggtcgaagcccatcagcagcggcgcgagcacggtcgagccgaacatcgcgacgacgtgctgcacgcccatcgcgaccatctgcggccacggcaggcgctcgtcggggccgaccacgcgcgatgccgcgccggtcgattgcacccgccagcgcgggaagtaggaatcggacatggggaaaagggctcctgtcggtcggtcgccggctgcggaggatgcgccggtctggaatctggcgcgagtttacggagcggaaatggggctggcaagcagaccgacacgcgggccgaggcgcggggcgcggccgggggcaggcgaaacggggcgcgatcgcgcggcccggctgccgggcggccgcgcatcgggggcgaacgggcgaacgaccggcggtcgacaccggccgcgacgcaagcgtgcgctcacatcgcggccggcgcggcgtgcatcaggggttgatgtactggaacagcgacaggttctgcagctgcgcgtaagccttctgcgagcccgtcagcgcgttctgcatctgcaggaactggctgatcgtcgacaccatgttggtgctcgtcaggtcggacaggttgctggtgacctgcagcgtgttggtctggttcacggtctgcatcgccttgatttcctgctcgcggccgccgaccgacgcctgcacggtgaggacgttcgtcatcatgttgttcagcttcgtcgtgccggtggtcatcgcgttcgcgagcgaggctgcggcggacgtgttgctgctgatcggcaccttcagcgcggcgatcatcgagtcgagcgccgcgaacacgtcggtgccggccttcggcgcgggcgtgacggtgaacgtgtcgccggacgccggcgttcccgacaccggcaccgacaggccgttgccgagcgcgatcccggcgccggccgaatacggctgcgcggcggtcgtggtcggcggcaccacggtgttgtcggtgaccgtataggtcggcgcggcggccgtgccgccgaacgtgatcgtgaactggtgcgtgttggtcgcggccgacgggctcgtgatcgacaccgcgccgatcgtgcccgtgcccgtgttgcccgcgccggcgagcggcaccggctggctgccgagcatcggcaccgacaggaacacgttcgcgccgttgtcgccctgcgagatcgcgcgcgtatcggcgatctgcacctgccgcgtgcccgtgtcgccgctgtaggtcacgccgccgcccggcgcgttcgagaacggcgccgtggtcgactggaagcccgaaaacaggtagttgcccgagccgtcggtcgagttcgcgagcgtcagcaactggtcgcgatagccctgcagctgcgtcgcttgcgccgcgcggtcgctgtcggacagcgagccgtcgccggcctggatcacgaccgtatggatgttgttcagcaggttgttgacgctgatgagcgtctggtcttccttctgcagcgacgacagcgcggcgttctggttcgacgcatactgcgacagcgtcgccgacgtcatcgacagctgcaccgcctgcgcggcgccgaggggttgtcggcaggcgtcgagaggctcacgccgctcgagatctgctggtacagctgcgagagctgcgcctgctgatcgttcatctgcgcgacgttcatctggtagaactgcgtggtggaaatccgcatcgctttgatccccgaaatcagttgaacaggccgagcacggtctggaacagcgtcgacgcggtctggatcaccttcgcgttcgcctggtagagctgctggtactgcatcaggttggccgcctcttcgttctggttcacgcccgacaccgactgctgcgcctgcgtgatctggccgatcagcgaagtctgcgcggcgctcgacgacttcagctggctcgtcgtgttgccgatgccgttcacgtagctcgcgtacgcgcccgtcagcgtggtcgagccgttgccgaacgatttcgcgctgacgagcttcgacagcgcaagtgcgttgctgccgtcgttcgtgccgcccgtgttcggcgcgaccgtgaacgtgtcgccggccgtgggcgcgcccgacaccgtgaccgtgacgccggccgtcagcgtgatcggcgtgccggactggtacggctgcgccgcgctggtcgtcggcggcacggccgtgttgtcggtgaccgtgtaggtcgggctggcggtcgtgccgcccatcgtgatcgtgtagttgtgcggattggccgcggccgtcgcgctggtgaccgtcagcccgccgatcgtgccggtgcccgtgttcgtcttggtggccgacggcacgtacggcgacgccgccgcgatcgcggagccgttcgacgtcgcgaggccgaagccgttcagcgcgccgcgcgtcggctgcacggtgaacttgtcgccggcgttcatcgcgccggacgagaacgagaagttcagcccgccgatcgaggccggcatgctggccgactggccgaccaccgcgccgctcgcgcggtcggtcagcgtgtagttcgtgccgtcgtacgacagcgtgtagtcgctcgtggtcggctgcgacgcgttcgcgaacgacacggacagcgccgcgttgccggtattgccctggttcgcgtacgtgatcggcgtgccggtcgtgaacaggttgccgccgacgttgcccgacaggtcgatgccgagcgcgttctgcgcgttgacctgcgcggcgaagctggtcgcgatcgcgccgagctgcgcttcggccgggtcgagcgtctggctgcggaacgcgagcaggccgccgagcgtgccgcccgacagcgacgcgtcggacagcgcctggttcggcccctgcgggttcgcgccggcgatgccctgcgacacgacggtcagctcgctcggatcggacggcgacgtgacggccgcgagctggtagctcttgttcgcgacgacgagcggcgtgccgcccgcgagaaacacgctgtagccgtcgctgttgcgcacgacctgcacgcccgcgaggttcgacaggttcgacaccgcgaggtcgcgctggtccatcagctggttcggcggctggccctggctgctcgcggacgcgatctgctggttcagctgcgcgatctgcgcggtgtacgcgttgatctgcgtcacggtgctcgtgagctgcgtgttcacgctctggcgcagcgcgtcgtactgctggccggccgccgtgatctggttcgcgagcgtctgcgcattgctcatcgcggtctgccgcaccgacgcgtcggacgcgctgttcgcgacgttctgcatcccggtgaagtagttcgtgatcgcggtcgagatgccggacgtcgggctgccgatgtagttgttcagctgcgtgacgagcgaataccacgtcgacagcgcgccgctctgcgtctgcgcaccgttcagctggtcgctcaggtactggctgtactgccgctgcacggtgacggtgttcacgccctgcggcatgtaaccgctgctcgtgtactggccgcttgcctcggcatagacggggcgttcgaccgaataacccggcgtcgccgcgttgctgatgttctggccggtcgtcgtgaggccccagagcgcggcattcaggccgctgacgccgaggttcatgagtgtgttggacatgcgcgatcctgatgagccggccgcgctgcggccgccgggttgcgtgactcccggtataacggccgcggatcgaaaaattgaggaaaaatgcacgcgcgacgcgcgctcgcgcgtggcgggtcgaaacgcccggcggcccgggccggcggcggtgcgtgggcggcgcgcgggcggcctcgaacggcctcgaacggcctcgagcggccccgggcggggccggccgccggggcgcgtcaggcccgcgcgagcgagcggcgcttcatctcgagctgcgtgatcagccgctgcagcgtgttctccgcgctgcccggcagcgacatgtagcggaagccgagctggtagcgccgcgacccgttcggcatctgcgtcgaacgctgcgacacgagctgcaggtcgagcgacagcttgccgtggccggtcagctcgagctcgacgtcgggcagcagcgtgccgacctcgagcgcctcgacgcgttcgtcggccgtgcgcagccccacgccgccgagcgacaggttgtgcacctcgaacaggaagctctcgccgtccggcagcttgccgcggcacacgtacggatcgacgaccggcgcatcgacgcggaaatactcgcggcgctggatgcacatcaggacgtcggggaaatcggcgacgaacgcgggcagcccctcgtagcgcgtctcgcgcggcgtgcccgtggagaattcgacgcgcacgccctccggcgcggccgcgaacgtgcagtgcgacgcgcccaggatgccggcgttctgctcggacagcgcgccccagtcgaacgtgaacgtccgcgcgccgacatccacctcgagcaggcgcgtgacgagctggccgcccggatactggacggtcaggaaatcgccgcgattgacgaggttgcgcagctgcacgccgatttccagcggattgcggcgggcatagtcgggcccggtggcctgcatccaggctggggtccgtcgacgtttcgatattcatggctagccggtctttcttgtcatgggcgcccgggcaaccggtgcgcgataaaaccgggccagaacggggcccggtcgcaggtctctcacacttagcggcagtgctgaccgaaagtttagatcgaaacggggatttttcgcgcaaacgttgaaaccgcgcgcggcgggctgccgggcgcggtccgaaaggggcaacggcgcgggccgacgggccgtcagccgatctgctgcatgatcgagatcagcttcttcgcgtagttcgggtcggtcgcgtagccggccttctgcatcccgtgcgcgaagccttcgacgctgcggctcgcgctcagcacgcccgagtagcgcggattgttcttcagcagggtcgcgtaatcggtcatcgcgtgctcgtacgagtcgtacgcgcggaacttcgcgaccacgcggcgcggcgtgccgttcacgtattccgtcgtcagcgccgacaccgtgcggccggtccagcccttggtcgccttgatgccgaacacgttgtagctggtcgagccgtcgctcgcgcggatctcgcgcttgccccagcccgactcgagcgcggcctggccgacgatgaagcgcgccgggatgccggtcgacgcgctggccgcctgcgcggggcccgcgagccggtcgacgaacgcgtcggcgtcctgcacgccgctcgcgcccttcagcggcggcgtcagcgcgctgccggccgagtagccgcgcgtgccggcgagcccgccgttgttcgccgcgttcgcgtaggccttcgccatcgcgttcatcgcggcgaggccgccttcgttacccgacgtgccgaggccgcccgcgcccaggccggccgcgccgacgtcggccgccgtgtcgctgcccgcgccctgccccgcattgcgcagcagctgcttcatcagcgcgtcggcgacgccgatcccgcgcgtcgacatctgctgcgcgagctgctggtcgagcatcgacgtgtacagcttggacgtatgcgaatcgaacagcccgccgtccggcgacgcgtcgcgcatgctcttgagcatcatctgcgtgaacatcgcgtcgaactggccggcgaccgccttcgcgccggcctgcggcgactgtttggcctgcgcgcgcagcgcgtcgaaaccctgcacgtcgagcgcgaagcgctgcgtgaggtcgttcgcgttcggaagagaggctgccatttagatgatctccaggtcggcgcgcagcgcgccggcggccttcatcgcctgcaggatcgacatcaggtccgcgggcgtcgcgccgagcgtgttcagcgccttcacgacgtcggcgagattcgcgccggccgtcaccatcttcagcgcgccgttgtcctgcttgagctggatctgcgactgctgcgccaccaccgtctgcccgttcgagaacggccccggctgcgacaccaccggctgcgtgttgaccacgaccgacaggttgccgtgcgcgaccgcgcagctctgcagcgtgaccatctggttcatcacgatcgagccggtgcgcgcgttcaggatcaccttcgccgcggccttgtccgggctcacgtcgaggttctgcaggcgcgccatgaacgcgacctgctgcgccgaatcggccggcgcggcgagctggatcgtgcggccgtcgagcgccgtcgcggtgcccgggccgaagctcgaattgaccgcggacacgatccgctgcgcggtgccgtagtccatgtcgttcagctgcagctgcagcacgccgttcatctgcgcgatcgcgttcggcaccgcacgctcgacgatcgcgccgccgacgatccggccggccgcgagctggttcacctgcacgcggctgccgttcgcgctggcgcccgcgccgccgaccgccatgttgccctgcgcgagcgcatagacctggccgtccgcgcccttcagcggcgtcagcagcagcgtgccgccgcgcaggcttttcgcgttgccgagcgacgacacggtgacgtcgagcgcctcgcccggccgcgcgaacggcggcagcgtggcggtcaccatcacggccgcgacgttcttcagctgcatgttgctcagcgacgacgggccgccgttggccgaaccgttgttgatcgagatgccgaggttcgcgagcatgttcgcgagcgtctgcgtcgtgaacggcgtctgcatcgtctggtcgcccgtgccgtcgagaccgacgacgaggccatagccgatcagcgggttgtcgcgcacgccctggatctgcgcgagatccttcaggcgttccgcgtgcgcgggcgccgcgccgagcacgcacgccgcggccatcgccgcgaacacgagggcgagccgcgcggcgccatgcgcgcgggccgacaggcggtcgaacagggtcttctgcatcgtcatcaccacggcgcgatgttgaggaagaagcgctgcaaccagcccatcgtctcggcttcgttgatgtagcccttcgacgagtattcgatcttcgcgtcggcgacctgcgtcgagtagaccgagttcgcgcccgagatcgtgttcgggttcacgacgcccgagaagcgcacgaattcgttgccctggttgatcagcatctgcttctcgccgctgaccaccaggttgccgttcggcagcacgttggtgacggtcaccgtgatcgtgccgttgaacgtgttcgccgcgctcgcgccgccggtcgccgcgaacttgttgttgccggcggccgacaggttcgccttcgcgaacagcccgccgaggaagccggccgtcggcacgttgaagtcggtgttgccctgccggttcgtgttcgcgcccgacgacttggtcgcgttgatgttctccgcgatcatgatcgtcaggatgtcgccgacgttgcgcggccgctgatcctcgaacagcggccgccccgcgtagccggggttgtagatcgagccgggcgcctgcatcgacatcggcatcggcggctgcgccgtcatcggctgctggatgatcggatcgcgcggaatctgcgcgcaaccggcggcgagcgccgccaccgcgaccgcgcatgcggcgcggacggtggctgacgggaggaggcgaacctgcttcatggcgacgacgggactttccggttagctcttcatctgcgtgacggtctgcagcatctggtcggacgtcgtcacggccttgctgttgatctcgtaggcacgctgcgtctggatcatgttgacgagctcctgcacgacgttcacgttcgacgcttcgacgtagttctggttgagcacgcccgcgccgttcaggcccggctgcgacacgttcggcgcgcccgacgacgtggtttcggagaacaggttctcgccgcgcgcctcgaggccggccgggttgatgaaggtcgcgatctgcagcgagccgatctgcaccgagttggtcgagcccgcctgcgtgaccgacacgacgccgtccttgccgatcgtcagcgacgtcgcgttctgcgggatcgtgatcgccggcaggatctggtagccgctcgacgtgacgagctggccctgcgcgttggtctggaacgagccgtcgcgcgtgtacgcgttcgtgccgtccggcatcagcacctggaagaagcccgcgccgttgatcgcgacgtccttcgagttgccggtctgcgtgaggccgccctgcgtgtacaggcgctcggtcgcgacctgctgcacgccggtgccgagctgcaggcccgacggcagctcggtctgctgcgtcgagttcgcgcccggctggcggatggtctggtacagcagatcctcgaacaccgcgcgcgacgccttgaagccgttcgtgctggtgttcgcgaggttgttcgaaatcacgtccatctgcgcctgctgcgcattcatgccggtggcggcgatgtagagcgaacggttcacttgtcgattctcctgcgtaagctggcgcgggcgctcagctgaagttgagcagctggttcgccgactgctcgttctggtcggccgtctggatcagcttcgactgaagctggaacgcgcgcgcgttgtcgatcatcgcgaccatcgcggtcaccgggttgacgttgctgccctcgagcgaattcggcgtgacgaccacgttcgggtcggcgtcggccggattgccgtcggcggtgcggaacaacccgtcgttgccgcgcgtgagcgtggccggatcgggattgacgagcttcatctggtcgacgatcgcgaccgccgtcggcgggtcgcccggcatcagcgcggacaccgtgccgtccttgccgatcgtcacttccgcgttcggcggcaccgagatcgggccgccgttgccgaccaccggcaggttgctcgcggtgacgagctggccgttctcgtcgacgtgcaggttgccggcgcgcgtgtacgcctcgctgccgtcggccgcctgcaccgccagccagccggcgccctgcacggcgacgtcgagcgggttgccggtgcgcgtgatcggacccggcgcgtaatcggcgccgggcgtcgacgcgagcacgtaggtgcgcgtcgtcgtcgggtcgatgttgctgccgtcgccgaaattcatcggcaccgcgcgatacgtcgcgagctgcgcgcgaaagcccgtcgtcgacgcgttcgcgaggttgttcgcgacgatcgcctgctggtcgagcgactgcgacgcgcccgtcatcgccgtgtagatcagtcggtccatggctgcccgttatccgcgcttacaggttgatgagcgtctggtcgacggtctgctgcgtcttgatcgtctgcgcgttcgcctggtagttgcgctgcgcggtgatcaggttgacgagctgcgacgtgaggtcgacgttcgagctctcgagcgcgctgccctgcagcgtgccgtggttcgtgctgcccggcgccgagatctgcggcacgcccgacgcggagctttccacgtactggttgccgccgaggttcaccagcccgttcgggttgttgaagttcgcgagcgcgatctggccgagcacggcggtctggccgttcgagtaattgccggtcagcttgccgtcggtgccgatcgtgtaggtcgtcagcgtgccgctcgcgaagccgtcctgcgcgaggttgttcacgccgtccttgccgccgtactgcgtcgtgccggtcaggtcgagcgtgaggttctgcggcgtcgccgagccgtcggtgttcggcaccgtgaactggaactggccgagcgacgtggtcggcgtggccggcgtgcccgtcgtcgtgctctggatcgcgcccgacgagtcgaacgtgaccgtgccgaggtcgttcgtcgcgccgccctgcacgcccgcgtacgcttcccacgtgccggccgccgacttcacgaaatacatgttgaccgcttgcgagccgccgagcgagtcgtaaacctggatcgacgtcgagtagttgtacgtcgtgttgtcggtcgcgctgaacggcttcttggtcggcaccgtgtcctgcgagttcaggttgaactgcgcggagatcttggtcgtcgcggtcggcgcgaggttggtcgtcggcgcctgcagcggcacggtctgcgcggtgttgatcacgccgcccgtgttggctgcgtagcccatcaggttgcggccctgcgagtcgatgatgaagccgttcttgtcgcgctggaacgtgccgtcgcgcgagtacgtcgtcacgccgttgttcgacatctggaagaagccgttgccgttgatcgcgacgttgagcgacgagttcgtcgtggtgatcccgccctggccgaagttctgctcgaccgagttcagccgcgtcccgatgccgatctgcgtgttggtcgacgtcgcgaccgagttcgcgtacatgtcggcgaactgcgcggtgctcgacttgaagccgaccgtgttcgcgttggcgatgttgttgccgatcacgtcgagcgcgttcgatgcacccgagaggccgctcagaccctgttgataacccatttcggtctccgtttcgagaatgctcgatcagtatcagttggaggtggtgccgccggacgagggcgacgacgacgcggtattcgggaagatcgacgcgacctgggtcagccccaccgtcgtgccgttcgacagcacgagccccgccgtgccgtccgcctgcttgatcacgctctgcaccgtcgaggccgcgagcgtcgtggccggctgcggcgtgccgttgctgtcggtgtacgacgcgctgacggtgtacttgccgtccggcagtgcgttgcccgccgagtcggtcggcgtccagttgaacggcacggtgccggccgactgcgcgcccgccttgatcgtgttcaccacggtgcccgccgcgttcttcacggtgatcgtcaggttcgacaccgagctcgacagcgacacgccgaacggcgacgccgcgccgcccttcaccgcgaccgcgttgcccggcgcgagcacgttcgtgccgatcagcagcgcggcctgcgtctgctggccggccgtgagctgcgacgacagcgacgtgagcgacgtattcagctgcgcgatgccgctcaccgtgttgatctgcgcgagctgcgacgtcatctgcgaactgtcgaccgggctggtcgggtcctggttctgcaactgcgtgacgagcagcttcaggaacgtcgcctgcaggtcgctcgccgacgtgccgttggtcgacgacacgttgttggtgttcatcgtgtcggtcggcagggtcgacacgttcgtgccgttgctgccgatcgtcgtgctggaggaagtcatcctgggtggccttctgtctggactttcggaactgtcgggtctgtaaggtcggtcggcgcgcggcttacgagccgatcgtcagcgtcttgagcatcagcgtcttcgcggtgttcagcgtctcgacgttggcctggtacgagcgcgacgccgagatcatgttcaccatctcctgcaccgggtcgacgttcggcatctgcacgtagccgttcgcgtcggcggccgggttcgacgggtcgtaggtcgacttcatcggcgacgggtcgtccatcaccttcgtcacgcgcacgccgcccacgccctggccggacgcggtgcgcgcgccgccgatcgggtcggtcgcgaacacgacctgcttggccttgtacggcttgccgtcggggccggtcgcgctgtcggcgttcgcgaggttcgacgcggtgacgttcaggcgctgcgactgcgcggacagcgccgagccggcgacgccgaagatgttcatcaacgaaggcatggaagctcctttgctcggattcggaggcggtgcgcgccgtcactggttcgtcgtgatcgcggcgatcatcgccttgatctgctgggtcatcacggtcatcccggtctggtagtgcagcgcgttgttcgcgaactgcacgcgctcgacgtcgagatcgaccgtgttgccgtcgagcgacggctgcagcggcatccggtactgcgcgcggccgtagtcgtccgccgggccgcccgtcgggatcagcttcgcggtgccggccatgtggcccgccgccgtcgacaccatcgacatgccgctcgtcacgccggccggctgcgtcatcggcagttgcgcggcgttgctcggcgcgaggccgccattggcctgcttcagcgagcgcgcgagcgtcgacgcgaaatcgacgtcgcgggcctggtagccgggcgtgtcggagttcgcgatgttcgacgacagcagttcctgccggtaggcgcgcacgtcgagcgcctgtcggccgaacgcgaattccgcatcgagtttgtccagcatgtgtgcgtctctccgtatgaagcgctgcacgcccctcgcgccggatggcgacccgagaggctttttccatgacagcgatggtaggcgccggacgcaaccggcaatcgggcgaataacgcggcaaaggcccctctattcatcgtttgcgcgacggccccgctccctagaatgcgaagcggagcaacggatcggggatcgggcgatgactggcagcgcacttcgcggaaggaacgggcggctcatgcacgtccggcgtgcgtttgcgctcgccgcggcgctgtggatcgccgccccggccgcgcacgcggacgacgggatgatcgtgattcccgggcgcggcgagacggccgaaaccgcgctcgcgcacgccaatgcggcaagcggcgggcagttcggcgggaatgcggcgatcgcgccgggtgcgggcctcgcgccggacgcgggtcgtgcggcgagcggcacgggtgccgccggcaccggctacgcgccgcaaccggccggcacgatggtcgtgacgaccgtcccgccgccggctgccgcggtggcaccggcgcccacgccccgccccacctacgcagccgcccgcgcgaacgccggatacggcacgccgcgcgccgccgatccgactgcgatcgcgacggtcgtcgccggcacggccgaacccgcatcgaatcccgtacggccggccccgcagccggccttcgcctcgcgcatggcggccgcccgcgccgcgtcggcattgccggcgccgcgcgcgacgccgggttccgccaacgcggctccggcggccaatgcagccaatgccgcccagcccgcgacgccgcccggccagcaggatcccgagtcgatccgccgcgcggctctcgcgttcctgcagcagcagatcgcgggcctgcccggcaagaccaccgcgacggtcacgaccgcgtttccacgcgggctcgccgcatgcacgacgctcgagccgttcatgccgaccggcgcgcgcctgtggggccgcacgacagtcggcgtgcgctgcgcgggcgagcggccgtggaccgtctacctgcaggcgaaagtgaccgtgcaggccacctattacgtcgccgcgcgccagatcgcgcccggcgagccgctctccgcggccgacctggtcgcccgcgacggcgacctgacggtgctgccgctcgcggtgatcaccgatccggcgcaggcgatcggctcgaccgcgctcgcgcgcatctcggccgggctgccgctgcggcaggacctgctgaagagcgcggcgtcggtgtcggccggccagacggtgcgggtcgtcgcggccgggcccggtttcacgatttcggccgagggcagcgcgctggcgaatgccgcgcccggccagtcggtcagggtgcggatggcggcgggccagatcgtcacggcgatcgtcaaggacgccggcaccgtggagattccgctgtagggacggatccagcggcaagaatgtaaagaattgtttattcggagcatttcgggctcgcgatgctaaagttcgggccgacccggccgttatctgggtcaaaccgaacaggaaacacatcgtgaagatcgattccactccgaacccgagcccctggcgccgaccggcaacggcgcgacccgtgcgccatccggcacggcctcgtcttcgtccgcgcaggcggccgacgcagggtcgaccggcggcgacacgaccgtgaacctgtcgggtctgtccggccagttgcgttcggtatccgcgtccggcaacgccgatatcgacacgggcctcgtccagtcgatcaaggacgcgctgaacaacggcacgttgacgatcgacgcgaacaagatcgccgacggcgtattgaataccgcccgcgagctgctgcagcagcagcgcccgggcaactgaagccggcctcgcggccggtccccggtctcccggtttgccggcgcgcccaacccgcgccggcgcgacgagcatgacgcgatgagagaagagctgctggccacggtcaacgacgaacacgcgacggtcgaggcgttcgcgtccctgctcgcctacgaggaaaaggcgctgacgatggcccagccgctcgagatgctgcccgggatcgtcgagaagaagagcgagctgatcgaccggctcgcgcagctcgaacgcacgcgcgacacccagctttccgcgctcggctttccggccggcaagaaggggatggaccaggccgccgagcgcgatgcgcgcctcgccggccgctggcagctgctgcaacaggccgccgaacgcgcgcgccaggccaatgcgaacaacgggatgctgatccggatccggatggactacaacgagcgcgcgctcgcggtactgcgctcggcacccgcgccggccggcgtctatggccccgacgggcgcgtgtcggcgctcatgcgctgaatcaccgactgaccggcagcggcgccgctgccttccctgccgcacctcgtagcatcgcgtagtacctcgcagcacctcgccgccattcgcggcctcccgcatttcgacagaccgggctcgaacccggcactcacggtcccttccgatacacggctgcgcaaccgcgccgccgtcccgtcacaacaatcagaagagggccgcatgccatatttccgcattccgttttcataccgcaccgccgccgtttccgccgtcgcggcgctgggcgccgcattgacgctttccgccgcgcaggccgccggcgccgcaccgctgcccgtgccgacgggcgacatgtcgctgtcgccggccggccccgacatcgtgccgccggccgcgccgggtacgccgggcgcgacgccgcgcgcgtcgcgccgcgggtccgacacctacacgtacctgcgctgctggtaccggatcgacgcggatccgctgaagccggccgcgacctacgaatgggcgcgcgacccgccggcggcgactggtatcgcgtgtccggctactggtgggcggacggcatcacgcagtggaagaacatgttctacagcacgacgacgcaggacacgctcgccgacgtgtgccgcaagacgctggccgcgaaaggcatcaggtccgacctcgtgcaggcggtcgcggcaaacaacgcgctgtcgttcaactacacggtgtggaccctcgacgccgcgcaacaggacgcacgcgtcaacaagctgatcgtgttcggcgacagcctgtccgacacgcagaacatgttcaacgcgagccagtggaagctgccgaacggcacgagctggcaggcgggacgcttcagcaacggcccggtgtgggccgaatatctcgcgaacgcgctgcggctgccgttctacaactgggcgatcggcggcgcggcgaccgaccagtacctcgtcgtgccgggcctcgtgcagcagatcgactcgtggcgcgaatacatggatcgcgcgccggactaccggcccgccaacacgctgttcgcggtgttcgcgggcggcaacgacctggtgaactacgggcgctcgcccgagcaggcggcgaatgcggtgcgcgacagcctcgagcggctcgccgcggccggcgcgacgcggatcatgctcgtcacgctgccggacgtgtcgcgcgcaccggtgttcgcgacgcgcaccgacacggcgagcgtcgccgcgcaggtgaaggactacaaccggcgcctcgccgacgcggccgccgcgctgcgcgcccgttacggcgcgacgctgcggctcgaggtgttcgacgcgtacgcgctgttcgacgacctgctgagccatccggcccaatacggcttcgacgacgcgaagcgcgcgtgcctcgacatcccgaaaccgtcgtcgctcacctacctgagcgcgcagacgccgcgtgcggactgccgcgacccggcgcgcttcgtgttctgggacacgctgcacccgacgacacgcacgcacgcgtggctcgccgagcggatcgcgccgttcgcgcgggcgcgcctgctgaactgaccggcgcgggcggcggtgcctacagcagcggacacgcggtgacctgcgtgccgcgctcgacgcacagccgctcgtagtcgcgcaggtatgcgcgctcgtcgtcgtccagcaggtcgagatcgatcaggtcccagtcgtagccgaccgtcacgatgttctcgaacgtcacggtatccggctgcgcgtcgtcctggcggatgatcacgatgttctcgatccgcacgccgcccttgcccggcaggtagatgcccggctcgacggaaatcaccgcattcggcacgagcccgtactgcgcgcccggcgcgaaccgcacgccgccctcgtgcacgtgaatcccgacgccgtgcccggtgccgtggccgaaatcgtggccgtgatcgcggcacacctgccgcacgagcgcatcgacgtcgccgccctttgccgtgctcgggaagcgcgtgacgagccccttgatgcaggccttcagcgcgaccgtgtagatctcgcgctgccacggctgcgcgaccgtatccgggtgcgtccggcgcagcaccacgcgcgtgcagtccgtcgcgaagccggcttcgtaatacgcgccgctgtcgagcagcacgagttcgccttccgtcagctcgacgtcggcgctcgccgccgtgtaatgcgcgaacgcgctgttcgcgccgttcgcggcgatcgacggaaacgtcagcgcaaccgccgaacgcgcggcgtatgcatcgttgatcttgcgcgccaggtcgtattcggtatggcgcacgcccggctcgcccgtcttcgcccagcgcatcgtctcggcgatcgccgcggaactgcgcgcaaacgcgtcgcggaaccggtcgagcaccgccggcgtcttgccggcccgcatcgcctcgaccgggttgaagtcggcatgccgcgcctgcggccacacccgcttcaccgcgtcgacgagcgcgcagttcaccgattcgaagccgtagcacacgtgatcgactgcgaacggcgcgagaaagcgctcgagcgccgcgacatcgcgccggatcacgtgcagcaccggatacgactcgagcgtgacctcgcagcggtcgcagccttccggcaggaacaacgccacctgcccgcccaccgcgaacaggaagccgaggtgcgacgacgcattcggaatgtgataaccgcggctgttcagcagatacgcgaggtcgtccgatgcgcaggtgaagaaggcggtcctgtcgtccggcgcgccggtatgcgcggcgagcttgcggttcagcgcgtcgaggttctgcgcgacgctcaggccggtcatcgcttccggcacctcgaagatcggccgctcgacgacccagcccggcaacgcgatcgcgagatcgatctcgcgatcggcgagactcgtccagtcgagcgacgcggcctgcgtctgctcgaacaggcgatcgcgctgcgcgacgctgatccgccgcgcgtcgtagccgacccgtgcgagccggctcccgtgcgcgaccagccagtcggccatcgcctgccagatcgtcacgttcatcccgagcttctcgatgcgcacgcgcgccggatcacactgctgctcggcctgcaggtgataacgaccgtcgacgaacagcacgaacggcggcacgccgagcgcctgcgcggtcgccgcgctcaggaagatcccgcagccggccgaaccgtcgaagcccgacagcgcataacgcgggttgttgctgcgcggcaggtactcggtcacgtattcgtcctgcgacgtgaccagtaccgcgtcgagccgcgcggcgtcgagcaggcgcgacaggcccgcctgcgtgtcgacgacggacgtgtcgtacggggaaggccggagaagctgtatttcagtcgatcgatcatcggaagcccgttatgcattgttgtcggcggccggcggtgacgcggcggggtacaggcccaaagcaggcccaaagcaggcctgacgcggcccggcgccgctgcacggtcgacgctcgacccggcgcggcacgacgccgggccgccgtaccgtcccggcggcaggcccttaaaaaattttcgtctcacttaacttttttgcgcgcgacagaatctagagcacgctgaaatcgaggtcaagctgaaattttcgtagggctaaaatcggcatgacgcttgcggatccctgcacagcgggcgttcgtccggcggcaccgcgcggtacaatgcgccggcatcgccgccccggcggccgtgcttcgtgcggtgcgcggaattccctgtccggcgactgcaccgcccgtccgcccgcctcccgattcgttgccgcgaaagagattcatggattcagacatcatgcgtatcggccagcgcattcgccgcctgcgccgggaagcgaagaagacgctgctggaagtcgcgaccgaagcgaaactgtcggtcgggttcctgtcccaggtcgagcgccatctcacgggcatctcgctgtcgtcgctcgtcaacgtcgcgaaggcgctcgacgtgccgctcggcgcgctgatcgaccagccgcgccaggtgcagcccgattcgcacgagggcagccgcaaggcgtatgcgctcgacgccacgtcgcaatggtacgaacgcctgtccaccacgttcgacggcagccagatcaacgcgctcaaggtgcggatgatggaaggctaccgctcggaatgggtggcgcacggcggcgacgaattcgtgtacgtgctggccggccggatctgcttcacgatcggcaggaagaactacccgctgtcgcccggcgactcgctgcacttcgacgcgcgcaagcggcatcgggtcgccaacgtgggcgacgggccggccgaggtgatcgcggtcggcacgctgccgctgttcgacgaccgtcgcgccgggttcgtgtccgcgacgatggacaccgcgaaaccggcccccgtcgtgcgcgccgcggcgggcgaaccgcgcacgagccgccgcgggccggcgcccgaacgggcggatcgcgatcgtgccgccggcaccgtgaaaaaggacaagaaggcggcagccggaccgagcgcggccgccggcaaacgcgtggcggccgccaagccggcacgcaagaagaagccgtaacgggctttgcaggcgcgcgacgcgcgcccgtcccgccgccgctattcgccgatctcgagcgcctgcgcgacggcctcgatccgcgcgcgatgcacggcctcccggatcttctccgtgtcgttgccgatgccgcgcgcgatcgcgccggcatcgacgctgcgcgcggccgcgagcgcgacgcgcagccgctcggcctgcggatacggctgcgtatcgagcccgagccgcccgcgcgcatccgattcacacgcctgcagcatctcggcgaaacgcgccggcttgcgcagcgcgtcgctgcgctcgaacagccgcaccagcgcggccgcgcccatctccatcacgcgatgcaggttgccgtgctcgcgcgcgaccacgagcgcgagatcgcggcattcgttcggcacgcgcagccgttcgcacaacggcgagcaggtcgacgctgcgcccctcgtggccgatatggcgcggcagcacgtcggcaggcgtcgtcgccttgccgagatcgtgcgtgagtgccgcgaagcgcaccggcagcgaataaccctgcttcgccgcatggtcgacgaccatcatcacgtgcacgccggtgtcgacctccgggtggtagtcggcgcgctgcggcacgccccacaacgcatcgacttcgggcaggatgcgcgcgagcgcgccgcactcgcgcagcaccgcgaacatccgagacggtttcacctccatgagcccgcgcgcgatttcctgccagacgcgttcgggcacgagcgcatcaacctcgcccgcgtcgaccatccgccgcatcagcgcgagcgtttcgtccgcgaccgtgaagtccgcgaaccgcgcggcaaagcgcgcgatgcgcaggatccgcaccggatcctcgacgaacgcatcgctcacatggcggaacacgcgcgcgcgcaggtcggcctgcccgtcgaacgggtcgatcacgggcccgaccagctcgccctccgggctcacctcgcgcgccatcgcgttgatcgtcaggtcgcgccgcgcgagatcctcgtcgagcgtcacatccggcgcgtagtggaactggaagccgtgataaccggccgccgtcttgcgctcggtgcgcgcgagcgcgtactcctcctgcgtccgcggatgcaggaagaccggaaatccttgcccaccggccggaaaccctgcgcggccatctgctcggggtcgcgcccaccaccacgtagtcgcggtcctgcacgggcacgccgagcaattcgtcgcggatcgcaccgcctacagcgtagatgttcatggctgcggttcgaattcggcgatcacgttcgtttcacggcgcgcggcgtcgatccagcgctggacggccggcagcgccgtcacgcgggccgcataaccggccgcgtccggcgacaggcccggcgcgtacgtgttgaagcgcatcacgacgggcgcgtacatcgcatcggcaatcccgaattcgccgaacaggaacggcccgcccgacgcctcgaggcacgcgctccacaacgcgtcgatgcgcgcgacgtcggcgagcgcatcaggcgtcgcgccgcgccccggcatcgacgcgcgcacgttcatgcccatctgcgtgcgcagcgccgcgaagcccgcatgcatctcggccgcgacgcagcgcgcatgcgcgcgctcgagcggatcggccggccacatcggaaactgcggatagcgttcggcgagcgtctcggcgatcgcgagcgaatcccagatcgcgacgccgtggtcgtcgatcaggcacggcacctttccggacggcgaatactcgaggatgcgtgcggccgtatcgtcgtggcgcagctcgatcgcgatctcgtcgaacgggatgccgaaatgcgcgagcagcagccacggacgcatcgaccacgacgagtagttcttgtctccaatgacgagtttcatgacggtgttccggaaaacgagaaggtgaaaaggacgaagctgaacgaaggcacccgggccggcctagcggcgcgagcggaaccagtcgaaccgggaccgctgcgcggcctggccgagacgcgggcgcgatgctttcgagactcgcgggcgagatcctgagctccggcgcgagcggccccgacagcacgttcggcaccgacatcgtcgcgagattgtcgcgcgtgagcacgggctcgccgggcaggcattcgaacacgctcgcctgcaaccgcgcgagcgcgtcgggcagccgcacgatgcgtgcctgccggccgaccagcgtgccgcaatagcgcaccagctgctcgagcgtgtagacggtcgggccgccgagttcgtaggtcttgccgtgcgcggccgcgagatccagcgtgttgacgaacgcgcgcacgacatcgccgacgaacacgggctggaagcgcgcgtcgggcatcgcgagcggcagcacgggcatcgtgcgctgcaggttcgcgaacgtgttgaggaacgcatcgccggggccgaacacgaccgacgggcggaagatcgtcagcgcgagcgaatcggtcgccgcgatcgcatgcagcgcggcctcgccgtcgcccttcgagcgctggtacatgctcgcgccatgcgaatcggcgccgagcgcgctcatgtgcagcacgcgctgcacgcccacctcggtgcaggcggtcgcgagcgcggccggcagcgtgacgtgcgcgcgctcgaagccgggcccgtacggcgtaccgcggccgccgtgcagcacgccgacgaggttgatcgccgcgtgcgcgccggcgacgaagcgcgcgagcgtgcgcgtgtcgagcgcttcgagctcgacgatttcgaccggcagcatctgcaggtggcgcgcgtggtcgcgccggcgcgtgccgatccgtacctgcttgccggcgtcgatcagcgcattgacgagccggctgccgatgaagccggtgccgcccagcagcgcgacggtctggcgatccatggtcgggacctctaaggggctgttcacgctaataacgggcttgcgctggccccggaagggccgagcgcaaggattgcgacgaaacgaaacgattactcgacgtattcgcgaggagcatgacgcggcgatcggcccttccggggccagccccgcatgatttttccaaacagggaacgtgccttgccggccgcattgcggccggcaaggcattcgcgtgttagcgtgaacagccccttgaacactgccgcgtctcgcgcggcagtgtgaagagtgcggatcagggcgagatcatgcccaggcgcttcttcaacgactgtggtttgccctcgaagagtgccgcgtaataaacggtgttcgacagcacgttcttcacgtagtcgcgcgtctcgttgaacggaatcgtttctgcgaagatcgcgccttcgaccggctgcgtcaacacctggcgccactggcgcggccggcccgggcccgcgttgtagccggccgtggcgagcaccggcgagctgtcgaagttgttgtagatgtccgccagataccaggtgccgagctggatgttggtatcgatgtcgtgcatctgcgtgcgcgagatcgtgccgaggccgagcttcttcgcaaccatctgcgcggtggccggcatcagctgcatcaggccgcccgcgcccaccgacgaacgcgcgctcgtgatgaagcgcgactcctggcggatcaggccgtacgcccattcggtgtcgaggcccgtcgactgcgcgtagcgctcgacgatgttgcggtacggcgacgggtagcgcagcgtgaaatcgtgctcggctttcgtgcggtcggccgtgttgaccgtgcggtcgagcaggtcgacgcgcttgccgtactcggcggccgcgagcagctggcgatcggtcatcccgcgcagccagttccattcgcggttgccctcgaggcgcaggttcagcgcgtagaaacgctgcgcgagcgcgaagcccggaatcttgcccatcgcgtcgatctcggcgtcgctcaccttcttgcgcggcgggatcgtcgtgcgctggccgagctcttcgccggcgagctgcccgtagaagttgtactgcccggcgacctgctcgaattcctggttcgcctgcagcgtgtcgccgctctgcttgagcgcgcgcgcatgccagtagatccaggccggatcgtcgcgcagcgacggcggcatctgctcgatcgaccagcgcaccatcggccagttgccggcgagcagcgcggcgcgcgtgcgccattcgtagcccgggttcgacagcggcgcattcgcggatttcgcgtaccagaccgacgcgagcggcgagcgcttgatcgcaccctggtagccgatcgcgccccacgcgatcgcctgctcctgtttggtcagcgaaggcgcgaccgtcgtgagcatgccggcggccgcgtccggatcgttgcgcgccatgcggccgagcgcgatcagcgcgagctggtgcgacgtcgcgtcggggccgacgccgcgcgcgaggtacagcggcggcgcgctcgtcgcctggtcgaagccgaccgggcgcgcgccgagcgcgtcgacgatcttgccgccgagcgtcgtgtagttctgctcgtacgcgaggcgcgcctgctgccatacgtcgtcgctcgtgaactgctggttgaccgtcagcgcggtgatcaggtcgacgcatgcgtcgccgtaattcttcggctcgacgagcagcgcgcgtgccgcatcggcgacgttctcgccgcgcgccgcgcgcgattcgagcgcataacacttgacctgcgtgtcgtcgtcgagcacgaagcgcttgtattgatcgtcgaagttgcgccagtcgtggcgcgcgccgagcacgagcaggtagtcgttgcgcaggcgatcggcgatcgcctggccgtcgtagcgctgcaggaacgactgcacgggcgcgtccggcgcatccacgcgcgcgcgtcgaatcgaacagctgcggcttgatctggaaatactcgacgtaggacggtaccggatagttcggaatcatcgacgcgagctgcgcggctttcgcggcgtcgttgcggcgcgcggcttcacgaagctgcacgaaggtctggtcgtccccggagaccgtatcgtcgttcggtgcggcgcacgcggccgtgcccgcgacgagcgcagtggccgaaagcgtcagcgcgaccgcgcgatatactcggaaaaggctgttcgacatcgttttgaatggagcacgaagtgagcgaaagcatagcacgcaaccctgtgccgaacccgaaggttgcgctacgcaaaacgctgtccggcgcgcgtcgcgacgccgcgtcgcaacccgccgcgaacgccgcgctcgacgcgcggctgcgcacgctgctcgaacggctcgcgccgcgcacggtcgggttctactggccgctgccgggcgcgacgcgcgcgatgcgcctggtgcgcggccggtgccggccggcgcgccgcgctgcccgtgatcggcgagcggcacacgccgctcgagttccatgcatgggacacgcatacgccgatgcgcgaaggccatcaccggattccggaaccggcgtcgggaatcgtcgtcgtgcccgacctgttgctgattcctgtgtgggattcgatccgcagcgctaccggctcggctacggcggcggctattacgaccgcacgctcgccgcgtggccgggcagccagccgcccgtgacggtcggcatcgcctatgaagcgtgccgcgtcgatgcactgccggccgaagcgcacgatctcgcgctgcgctggatcgtgaccgacggcgcgctctacccggccgccggatgatgcggcgggcggcacggcgtccgtcgtcgcacgcccgtcagcgcattgccgcgcgccaccgccggcgcaaccccggcccgacgggccaaccgcttacagcgacgccgccgcgcgcgcggccgtgtcgtacagccccgatgcgttgcgcagcaactgcgccgcgtcgccgatctgctcgttggtgagcccgctgtccttcagcgtctcgatcaggcagtgctcgcgcacctcgcggtacttcaggcacaggtcgcggcccgcgtcggtcgcgaagaagaacacttccttgccgttcttctcgctcttcacatagccgcgggcgatcagtttttcagcgcataggtcgcgacgtgcgtatcctcgatattgagcacgaagcagatgtcggcgagcttcttcttgcgttcacggtggctgacgtgatgcagcagcgacacctcgaccgccgtcatgtccttcgcgccggccgccgacatgcagcgcaccatccaccggttgaacgcgttgcctgccatgatgagcccgtattcgagctccgacagctccgcgctcgaatcggaaacgaggtgttcggatgacacgatcttggtcgcaggacgcttcatgtaaagacggagcaagccggatgacagggtgtgccgagtgtacgccagaagcccggacatccgggctaggcaacgcttattgggaagttgtcgatattttattgacaatgtgcgctaacattgccgtccgaaccgtgccagtccgatgacgcaacccgcatttatccgctcggcgatgccgccctcgtctgcgaggtgccgccgcccgccacgctcgattgccagcgccgcgtctgtgccgaggagtcgcgcgcgtggcccgacgtggtcgacgtcgtgcccggcatgaacaacctgacgatcgtgttcgacgcgctcgccacgacggccgaatcgctcacgg

SEQ ID NO: 3 - DNA, 171379 bp, Burkholderia cepacia strain SSG
gaccaccgcgctcgacgtgacggtgcgccagcagatcgtcgacctgctgatcgagttgcaggagcgggaggccgccgagcgcgggatggccgtgctgctgatcacgcacgacctgaacctcgtgcggcgtttcgcgcagcgtgtggccgtgatggagaagggcgtgctggtggagaccggcacgaccgccgggctgttcgcggcgccgcagcatccgtacacgcgccggctgctcgacagcgcgccgcaacgggcggtcgagccggcgccgccggcgcgcagacgatcctcgacgtgcggcaactcgccgtcgactaccgcatcgcggcaaagggctggcgttcggtgctcggcaagacgacgttccgcgccgtgcacgacgtgcagttgagcctgaagcgcggcgaaacgctcggaatcgtcggcgaatcgggttcgggaaatcgacgctcgcgtcggcggtgctcatttgcagcggccggcgtcgggcgggatcgagatcgacggcatgccgctcgcgtcgctgcgcacgacgcagggccggcgcacgctgtacgggcgcatgcaggtggtgttccaggatccgttcggctcgctgtcgccgcgcatgacggtcgagcagatcgtcggcgaagggctgggcgtgcaccggccgcaggtgaccggcgacgcgcggcgggcgcggatcgccgcgctgctgcaggaggtcgggctgcctgccgaggcgatgctgcgctatccgcacgagttttccggcgggcagcggcagcggatcgcgatcgcgcgggcgctggcggtggagccggaactgctggtgctcgacgagccgacgagcgcgctcgacgtgtcgatccagaagcaggtgctgaatctgctgacgaatctgcaaaagaagtacaaactcagctacctgttcatcacgcacgatctggcggtgatgcgcgcaatggcccaccgggtcatcgtgatgaaggcggggcgcgtggtcgaggagggcgagacgctcgacgtgctgcacgcgccatcccatccagatcgcgggcgctgctcgcgtcgtccatgccggcgcgcgcccgcagcagaggcaagagagaaccgatgattgacgagaaccgggcgccgggcgcccgagccgtacaggcagcgcaggcgttgcgcagtgacgccgatttctggtcgctgcgcatcgtcgacgagacgatcgacgaacatgcggtgcgcaacgacgtcgcgcagccgttctcgcgcacgcgcgagcgcggcgcgatgctgatggcccgggccggcacgggcgcgggttatgcggcgacgcccgacctatccccggccgggctgcaggcggcgctcgacatcgcgaccgcgcgggcacgggcaagcgcgccgtgggcgctggtcgatcatcgccaggctgcgcgcccgcagacgagcggcacgtatgcgtcgcccgatgtcgacgcggcactgccgtcgcgcgcggaatggatcgagcgtctcgcgcacgaatgcgcggcggcgaacctcggcgcgcgcatcgtcgagcgcgcggcgagcgtgatgatcgtcgacaccgaacagtgttacctgacgagcgacggcgtccggatcgaccagcggttccggttcctgatgcccgaactgcacgccgtcgcccacggcgacggcgacacgcagacgcgctcgctcggtcaatcgggcacgctggcgcagggcggcctcgacgtgctggcgcgctacggcttcgacggcgccggcgcgcgcgtcgccgacgaggcgctgcagttgctggccgcaccgaactgcccgaccggccggcgcgacctgttgctgatgcccgaccagatgatgctgcagatccacgagtcgatcggccatccgctcgaactcgaccggatcctcggcgacgagcgcaacttcgccggatcgagcttcgtcaggccggagatggtcggccactatcagtacggctcgccgctgctgaacgtcacgttcgatcccgagccggccgccgaagccgcgtcctacgcgttcgacgacgacggcacgccggcgcgcaagcaatacctgatccgcaacggcgtgctcgaacggctgctcggcggggcgctgtcgcagcagcgtgcgggcctgccgggtgtggccaattcgcgcgcgtcgagctggaaccgcgcgccgatcgaccggatggcgaacctgaacgtcgaacccggcgaccagtcgctcgatgcgctggtcgcgggcaccgagcacgggatcctgatgcgcaccaacacgtcctggtcgatcgacgaccaccgcaacaaattccagttcggttgcgaattcgggcaactgatcgagaacggccggctcacgcaggtcgtcaagcgcccgaactaccgcggcatctccgcacagttctggcgcagcctgcgcgcggtaggcgacgcgggcacgttcggcatctacggcacgccttattgcgggaagggcgagcccgcgcagatcatccgggtcggccacgccgcgccggcctgcgtgttcgccgatgtcgacgtattcggaggcgcgtgatgacgggattcgaaccgatggcacgccgcgccggaatcgactggcacgcgcatttcacccggctcgccgacgaggcgcaacggctgaaggcgccggccgaaaccgtcctgctcggtttctcgagcgaaacgtccgacttcgtccgcttcaacggcggcaggattcgccagaccgggcgcgtcacgcagggcgattgtccgtgcggctcgtcgacggggcgcggcaggcgcactcggcgctgaccgtctgcggcgatccggcggccgacctgcccgaactggccgcggcgctggccgtgctgcgcgacggcctgcgcgatgcgccggacgatccgcacctgctgttcgatacctcgtcgtggctgcaggaaacgcaccgcaccgggcgcctgcctgatgcggacgggctcgcgcgcgtcgtcgccgaatgcgcgcgcggtctcgatttcgtcggcttttacgcgggcggcacgctagcgcgcggcttcgcgtcgtcgaccggcagccgcggctggtacgaggtcgagaacttcaacttcagctggtcgctgtacgacccgagcggacgggcgatcaagaccgcctacgcgggcgacgactggagcgatgcggcgttcgccgcccgcgtcgaggcggccgccgcgcggctgcccgtgctcggtcgcacgccgaaggcgcttgcgcccggacgctaccgcgcgtatttcgcgccggacgccgttcacgagatgacgagcctgctcggctggagcggctttcggcgcgtgcgctggcgagcgcccgcagcccgctgcatcgcctgtacgccggcgaggtcgcgctcgatccgcgcgtgtcgatcaccgaggatttctcgctgggcatcgcgccggcgttcaacgcggacggctaccggcgcgacagcgtgccgctcgtcgtcggcgggcgggggaagggcagctcgtgagcgcacgcaccgcgcgcgagcacgggcgtgtgccgaacgggcggacaacggcgaatcgccgcagtcgctgacgatcgcgggcggcacgctcgcggatgccgacgtgctggccgcgctcgacacggggctctacgtcggcaacctctggtacctgaacttctcggacccgatcgcctgccggatgacggggatgacgcgcttcgcgacgttctgggtcgaaggtgggcgtatcgtcgcgccggtcgacgcgatgcggttcgacgacagtttctaccggctgttcggatcggagctcgagcagctcggcgcggcgcccgcgctgctcgcgaacgacgacacgtacggcgagcgcgccaccggaggcgcgcagccggggctgctcgcgcgcgcgttcgaactcacgctgtagcgcggctgccgatactcgccgatgccgtcattcttcatcgaccgtcccgtctttgcgtggatcgtcgcgctcgcgatcgtcgtcgcgggcgtgctggccattccgcagttgccgatcgcgcagtatccgcgcctggcgccgccgcgggtcgtggtcaccgcgtcttatccgggcgcgtcgaccgagacggtcgatgccgacgtcggcagcgtcatcgaggaaagcctcgacggcgccgacgggctgctgtactacgagacgagcagcgacggtcacggcaacctcgagatcgacgtgacgttctcgcccggcaccgatccggacatcgcgctcgtcgacgtcaacaaccggttgaagcaggtcgagccgcggctgccgcagcaggtcgtccagcaggggatcggcgtgttcaaggcggcgaacacgttcctgatgctcgtcacgctgacgtcgaccgacggcacgcgcgattccgcgcagctcggcgattacctgaaccgctacgtgctgcgcgagctgaagcgcgcgccgggtgtcggcgcggccgagctgtgggatgccgacgaggcgctgcgggtctggctcgatcctgtgaagttgcgcgaatacgatctcggcgccgacgacgtgatcgcggcgatcggcgcgcagaacgcgacggtcacggccggcgcgatcggcgacgcgccgttcgtgcacggccagcagctgaccgcgacggtcgtggtcaaggggcagcttgcgtcgcccgaggagttcggccggatcgtgctgaagtcgaagcaggacggttcggcggtgcgcgtcgccgacgtcgcgcgtgtcgagatcggccgcgacgactattcgttttattcgcggctgaacggccggccggccgcgacggtcggcatccagctcggcccgcgcggcaacgcgctcgaaacgtcgaatgcgatccgcgcacggctcgccgagctgtcgcggacgctgccgccgggcgtcgcggtcgagattcccttcgacggcgcgcatttcgtcaagatcgcgatccacgaagtcgtgctgacgctcgtcgaggccgtcgtgctggtgttctgcgtgatgtggctgttcctgcgcgacctgcgctacacgctggtgccgaccgtcgtgattccggtcacgctgatgggcgcgttcgtcgcgatgtgggcgttcggtctgtcgatcaacgtgttcacgatgttcggcctcgtgctggcgatcggcatcctggtcgacgatgcgatcgtcgtcgtcgagagcgtgcatcgcgtgatggaggagggcgtgtcgccgcgcgacgccacacgccgggccatgaagcggatcggcggggcgatcgtcggcgtgaccgcggtgctgaccgccgtattcgtgccgatggcgtttttcccgggcagtgtcggcggcatctaccggcagttcgcggtggcgatgatcgcgtcgatgctggtgtcgtcgttcatggcgctgtcgctcacgcccgcgctgtgcgcgaacctgctgaagccggtcgcgcgacacggcggcggaaccggccgggcgaggcgactcggcatcggcgcgcgtctggccgaccggttcggcgtggccttcgcgcgcgccgaatccggctatcgccgcgtcgcggtgttcgccgtgcgccgcaccgggatggtcgtggccgtctatgcagcactcgtgctcgcatgcgggctgctgtactggatgatgccgggcggcttcctgcccaccgaggatcaggggcaactgcaggtgatgatccagttgccggcgggcgctacgcaggcgcgtacgctcgcggttgtcgagcgtgtcgaggcgatcctgcgcggggagccggcgatagcgaacgtgacgagcgtgatcggctggagtttcgcgggcagcgggcagaacgtcgggatggcgttcgtggaactgaaggactgggcgcaacgcgacgtcggcgcgatggcgttgcgcgaccggctcaacgcgcgtttcggcgcgatcctcgacggcgacgtcgaggcggcgctgccgccttcggtgcgcggtatcgggcattccgacggattcacgttccggctcgaggatcgcggcgggggcgggctcgacgcgctgaaggcggcccgcgcgcagcttgccgagcgtgcgaaggcggatccgctgctctcggccgtgcatttcgaagacctgccggacgcgccgcgtatcgagctcgatgtcgatcgcgcgaaggcgtatgcgctcggcgtgccgttcgagcggatcgcggggctcctgggcggcacgttcggctcgaactacatcaacgactttccggcgtcgggccggatgcggcgggtgatcatcgaggccgacccggtcgcgcgcgcgaccgatgcgcaactgatggcgctgaccgtcccgaaccgcaccggcgacatggtgccgctttcggcgattgccgcgccgcactggacgatcggcccggtgatgctgaaccggtacaacggctatccgtcgctcgacatcagcggccgggcggcgaccggcacgagttcgggcgcggcgatggccgagatggagcggctggccggtgcgctgccggccgggatcggtttcgactgggtcgatgcggcgcgcgaggagcaggttgccgcacggcagacgccgctgctcgtcgggttgtcggtgctcgcggtcttcatggcgctggccgcgctgtacgaaagctggacgattccgctgtcggtgctgacgatcgtgccgctcggcatgatcggcgcgatcgcggcggcactcgtgcgcggcatgccgaacgacgtgtacttcaaggtcgggatgattaccgtggtcgggctggcggcgaagaacgcgatcctgatcgtgcagtacgcgcgcgacctggccggtcatggcgtgccgctgcggcaggcggtggtcgatgcggccgctgcgcgattccggccgatcgtgatgacgtcgatggcgttcctgctcggtgtcgtgccgctcgtgctggcgacgggtgccggggcggaaagccggcgatcgatcggcacgggcgcgttcggggtgtgctggcggcgacggtgttcgggctcgtgttcgcgccggtggcgtttcgtgtcgtggcgtcggccgggcgacgcggccggcgtgcggcggtggcgacgcgcgacgatcggcaggctgaggtggtggggagtgacgcagtcacgcagtgccggcaggtgattttcgtgcgttgcgttgattgaatgcgatcgtcgtgcggacgtctcgcagacggcgcgatgctcaattcgaattcaaggagacggattcaaaccatgtcctacgttctgtattactcgccgggtgcggcaagcatggccgtgcattggatgctgatcgaactcggtgtgccgttcgaaacgcgtctcgtcgatatcgatgcgggtgcgcagcatacgcccgagtacctgcggctgaatccggccggccgagtgccgacgctggtcgtcgacggcgtaccgcggaccgaatcggccgccttgttgatgctgcttgccgaacgccatccggcgccgtccctggctccccgtccaggcgcgcccgaacgtcccgagtggttcgagatgatggtttatctggccaattcggtattgcctgcgatgcgaaactggttctatgcggagacggacggcgatccgcgatgcgccgagatggtgaaggcgttttcgcgggggcaaatcgaagagtcgatggcgcatctcgacaatctgctgtccgacggtcgttcgtacctgatcaacaatcggttgagtacggccgatttccttgcgttgatgctcatgcgctggacacgcaacatgccgcgcccggcaacgacatggctgcatcttgcgaggtacatacagcaccttcgcgggatgccgacgtttgtcgagttgaatgcgcgtgaagggttgactgagtggatgaatccggcttcttgagtgtttcgagggagcttgaaaagtgaggcagcagtcgattgggggctgcttgctgccggatttgagtggaagtatcgtattttacataatcatagttatcggtagtttgtgtgtaggtcccaagttcagatgtcgcgtttccgctaaataaaaatgtcgtgttttggcctgtaggttgatcgcctgcacccttgggagcgccggcgatgaacgcgactgggacgatcaccatgacgatgcgcgagccggatcgattcaaggtcattcaggacgtagccgacggcgagctcaaaccatgacgtgcagcggaacggctggaattgacgacccggcgggtccgccggctggtcgcccggttacgtgagcacggcccggtgggattggtatcaggacaccgagcgaagcccggcaataagtgagcaataccaacgggatcgagtcgagcgcttcccatggatccggcgcttcttcgcgagaagatgatgaccgaccgccagaacgagtcgctccgtgaacagctgctccgattcgatatcgtcccgcgacgcggatgaaatgcgatgccaggatcaaaccggcgcgccccgaccgagatgcgcgcacaccgcgacgcgtgcactcgaacgcaccctgcgaagctccacgcccgcccactcctgccgcgacaccccgcccggcaactaccactactgccagtacctccgctgtccgtgccccttactcttgtcggcatcgctggcgcgccgtccgaggccgcgccgcttcgaccggagacacgacagatgccatttgactggacgcaggaacagcatgcgacgctcgcgcgctttcgcgacatcggcacggagatcgccgcggcggaacgcgacgctcgcgcgcctgccggattcgatgcagccggctggacccggctcggccaggaaggactgtgggacatgatcgtgccggagacctacggcggcgacggtcacggctggtggcacttttccgcggcgctggaggggcttgcatcgacgatccgccgcccggcgctgctgctgtcggtgatcgcgcaggccggcatggtgcgcgcgctcgaacgctacggcacggcaacccagcaggaccgctatttcggtgcgatcctgcgcggcgaactgagcgcgacggcgatcgccgaaccgggcaccggcaccgacgtgcgcagcattgcgacgaagctggtcgagcacggcgacggctaccggctgaccggcagcaaattcaacatcgcgcacgcgccgctcgcgcgcttcatcctcgtcgtcacgcgtgtcgaaacgctcggccggcgcaatacggcgctcgtgatcgtcgaccgcgaccagccaggcatgaccgtcgcggcgcccgaccgcaagctcggcctcgacgacctgcccaccggcgcgctgcatttcgacgactgcccgatcgcgcgtggccagctgctgggtgaaccgggcgccgggctcggcaacctgatcgacatcatttcgctcggccgtctctactacggcctcgtcgccgcgcaggtgacggcgccgtacctgcgcgacgcaatcgcctattgccgcgaccggcgcagcttcgacagcacgatcgacgcgcaccagtacgtgcagcgtcgcctggtcgacctgcagatcggcatcgagcgcggcacgtggctcgcgcgcggcgcgctcgcgcagttgctgacggatcacccgcaagcgctgatgtcctgctcgatcgcgaagctggtcggcgcgcaggatctcgtcgacggtgcgctcggcctcgtgcggctgtacggcagcctcggctaccaggccgggccggtggccgcattcgcgtcggacgcgctgggtttcatgagcgtcggcggaaccgaggaaatgcatcgcaagaacatcttcaaccagatgatgcgcgccggctgaacgcccgccatcgacatgcgtacgacgcaccctacaggaatccaagcatgacaacgacccaccgacgcccttcccgcctgcgccgctcctggctgttcctcgccggcgccgatcacgatgcgctcgtcgacggcgccgcgagcggcgcggacgtattgatccaggaactcgagacctttacgccgccggaccggcgtccggccgcgcgcgaactcagcgagcgcgtgctcgcgggctggcgcgatgccggcatcctcgcgtccgtgcgcgtgaacccgctcgacgcaggcggcatcgacgacctgcgcgcggcgatgcgcggccggccggacatcgtgatgatgtcgtacgtcgcgacgcccgagcaggtcgtcgcgctcgacgaggccgtcacgcgcttcgagcgcgaatacgatatcgcgcccggctcgacggaactggtgccgaacatcgagtcgacgctcgggctcgtgaacacgatggcgatcgcgcgttcgagcccgcgcgtgtcggccgtgctcgtcgcgaccgaggacatggtggccgacatggggccgagcgcacccgcgcgggccgcgagctcgactatgtgcgctcgcgctttcgcgtcgaatgcgcggccgtcggcatcaccgcgatcgactgcccgtacagctatgccgacaacgaaggcgcggagctcgacatgcgcgtgtcgcgcggcctcggataccaggccaaggcgatcgtcaacgcgcagttcgtgccggtcgtcaatcgcgtgctgacgccgacggtcgacgaagtcgccctcgcccgccgcgtgatcgacgcgttcgacaccgcccggcgcgcgtccggcggccgccgcgtggccgctgccgtcgtcgacggtttcctcgcggaagtccccgactatctcgccgcgcaccggctgatcgcccgcgcgacgcaattcggcattgcctgagcccgccatggatacgatcgccacgcgcctgaaggcgctgaaaaccctcgcgcatgcggcgccgcacgttccggccgagaactggcccgacacgccgcaagcgcaattcgaacgctggctcgacgaggccgttgtcgcaggcgccgtcgaaccgcaggtgatgacgctgtcgacggtccgcccggacggacggcccgacgcacgctccgtcgtactgctgaacgtcgacgcgcgcggctggcatttcgcggcgagcacgcgcagccccaaggggcgccagatcgaaaaccggccgttcgccgcgctgacgttctattggccggtgatcgcgagccaggtccgcctgagcggcccggtcgagcggctgccggccgccgaaggccgcgccgatttcgcgggccgcccggagcggtcgcgcgcgagcatcctggccggccggcaaagcgaacggctcgacgatcccgccgacctgacgcgcgcgatcgacgcgcagctcgcgcggctggccgccgaccccgcacttgtgtcggaggactggcacctgtacacgctcgcaccggacgaagccgaattctggcgtgccgacagcgcacgccgttttgcgcggcaggcgtaccgtcgtgacggtcagtgctgggaacggtgtgcgctatggccttgaaatccgccgcactcccgtcgcgaccgggcggcaccctgcacgacggcatgaatgaccggatgcacgaagacacgcgcctcatgcacgcgggccgcgacagcgcggcctggcacggcttcgtcaatccgcctgtctaccatgcgtcgaccgtgctcagcccgacggtgtccgatctgctgaaccgcacgcagccgtatatctacggccgccgtggcacgccgacgaccgacgcgctcgagcgcgcggtgacgagcctcgaaggcggtgccggtgcggtgctgtgtccgtcgggcttgtcagcgtgcacgctggcgctgctgtcgtgcctgaagcccggcgatcacctgctgatgaccgcatcggtctacggcccggtacgccatgcgtgcgaaggcgtgcttgcacggctcggcgtcgagacgacctggtatgacggccgcacgcccgtcgctgccgcattccgtgcgaatacgcgcgcgctgtatgtcgaagtgccgggttcctatacgttcgacatgcacgatatcccggcgctcgtccggctcgcgcacgcacacggcgcgctggtcgtcgcggacaacagctgggccacgccgttcttctttcaaccgcatgcgttcggcatcgacctgtcgatccaggccggcaccaagtacctggtcgggcattccgatgcgatgctcggcaccgtgtcggccaccgagcgcgcgtggcccgcgttgaagcaactgcatggcgatctcggactgtgcgcgggccccgacgacgtctatctcgcgctgcgcgggttgcgcacgctcggcgtgcggctgcggcagcaccagcgcaacgcactggcggtcgcgagctggctcgcgacgcgccccgaagtgcagcgcgtgctgtatccggccctccccggcgacgacggacatgcgctgtggcgccgcgatttccgcggcgcatcggggctgttctcggtcgtgctgcaaccggcgccgccgcacgcggtcgaagcgtttctcgaccacctcgcgctgttcgggctcggttattcgtggggcggctacgagagtctcgcgctgccgttcgagctggacgcgcacggccttgccgcgcgctggccggccggcagccgcggcgtgcgcgtgcatgtcgggctcgaggacccggacgacctgatcgccgatctcgcggccggtctcgatcgttatgcggcgtgcgcgcggcaggccgccgcctgcgaggatgccgcgcgatgctgaccgtctggggccgccgcacgtcgttcaacgtgcagaaggtgttgtggctcatcggcgagctgggcgtgccgtaccggcacatcgcggcaggcggtgaacacggttcgctgcagacgcccgcgttcgcggcgctgaatccgacctgccggattccggtgatcgactgggatggcgacgtcgtgtgggagtcgcacacgatcctgcgctatctcgccgcgcgggtgccgaacaatccgttctggtgccgcgacgcgttcgcccgttcgcgcgcggagcgctggatggactggtcgcagactgcgctcgaacccgacgtgatgaccgggctgttctgggcgctcgtgcgaacgccgccggagcggcgcgacgatgcgctcgtgcgcgacaaggccgcgcgcagcgcgacgcatttccaactgctcgaccggctgctgtcgacccagcccttcctgggcggtgcgacgccgggcctggccgacataccggccggcgcgacgctgttccgctatttctcgctcgacgtcgagcggccgccgttgccgcacgtcgaggcctggtacgcccgcctgagccgacgccccgcctatcgcgaacaggtcatggtgtcgttcgacgcgttgcgcggccagccgggctgactctgcgcgtgacgactcacatagcctcgcggtctcacgaactcacgaccctctcgacacgacatgacgcactccgcccttcgtccgatcctgatcgtcctgcaccgcgaacagtcgagccccggccggatcggccggctgcttgccgcccgcggccatccgctcgacattcgtcgtccgccgctcggcgatccgctgccggcgacgctggccgaccatgcgggcgccgtggtgttcggcggcccgatgagcgccaacgacggcgatcgctggattcaggatgaaatcgactggatcggtgtgccgctgcgcgaggcggtaccctttctcggtgtctgtctgggggcgcagatgatgatccgccacctgggcggccgcgtgatcgcgcatcgcgacgggcgcgcggaaatcggctattggccgatcgccgcgacgcccgccggccggcgcctcgggtcgtggccgtcgcacgtctaccagtggcatcgcgagggcttcgaacgcgtcgccgggctcgagatcctcgcgaccggcgagcacttcgagaaccaggccgtgcgctacggaccgcgcgcatacggcgtgcagtttcatccggaagtgagctatccgatgatgcggcgctggagtacggccgccgcgcacaagctgtcggcgcccggtgcgcaggatctcgcgacgcaggcacgcgaaggccagcggcacgaccgcgcgacggccgcgtggctcagcgcgtttctcgaccgctggctcgacgatgcgcccgcatcaggtcggcacggtcacgtcggagatgctgatcagccccactcgaccgctcgcagcacggcttcgtgccgacgtgacacgttgaacttgcggcggatgttcatgaagtggaaattgatgcacgactcggtcacgttcaggatgtggccgatttcccacgacgtcttgccggccgcgtgccagcgcaggcattcgacttcccgccggctcagccgcggcacgctgtcgggcggtgcatggcagcgcgtgccggcgatcgcttcgcacgcgacgtcgcgcagcagcgtcagcgccgcgagatggcggtcgcagtgctcgcgcgtggcggcgagctcgtcggtgctcgcacacaacagcatgccgacctccccttcgcgccgcgcaccggcagcacgacgccgctgcgcatgccgtacgcggccgccgcttcgtaacacgggcgctgctccggcagcgcgaacaatgcgtcgtcccagacgagcggcagtgccgaacggaagcaatgccgcagcatcgggtcgacgcggtcgaactggcgctgccggtacagcgccgtccagccgggcacgccgctgctccatttgcgcgcgagatcgaacgacgcgccggtaaacggcaacacgatcagcacgaccttgtcgaaccccattccggcggccgcgtcggtcattctctgccatgacgcgtccgtgtcgccgggtaccaaccatttcagacaatccagtccattcatacaagccaccccgttcgtttagttggaatctgcagccaggcggacttgcgcaaccggttcgagacgttgcgcgtgaacgggccgcgctagaccgcctcggccagacgtcgccggcctgcctgcctcgcgtcgtcgagcgacgccgtcacgtcgaacggaatgccgaacgccttttcgatgccggatgcgttcgcgatggccgcttcacgctcggccgggtccggttcgatcgtgatgagcgcacggcagaccgcggcgagcgcggcgcggttctgcttgagccacatgccgcgttccttgcggtcgtcgtgcgcttcatccgggcgggccggcggaaagatcatgacaaacggctcgccgtgccgcatcagcgcgtgcatgtcgtcgagccagcgctgcgcgtagccggcggatgcgatcgcgtcgttgcgcacgacgacgaacggaaattccgcgacgtcgaacacggcgagcgtcgccaggtcgggggcatggcaccagcgtggtgggtgggcatcgggtcaacctccatcgaattgaacagcatgggtcggaacgggccgcgcggcgcccgcttcatcgtttcgcggcggcgccggggccgaacggcggacgggcgagccagaccaccgcgatcacggcgagatacacgcagccgagcgcgaacgaaacgtcgttgaacgagatctggtacgcctgcgcatcgaccaggttgcccagcagcgtcgccgcgcgctgcggatcgccgccgccgagccgtgcgacttcggcgcgtacggccgggtcgaacgcgctcacgtgctcgctgagctgcgcgtggtgcaggatcgcgcgccggtcccacaggaacgacgtgatcgacaccgcgaagctcgcgccgagcgtgcgcaggaacgtcgacaggccggagccggcggcgatctcgtccggcttcaggtcggacagcaggatgctgttgatcggcatgatgaacagtgcgaggccgaggccctgcagcagctggatcagcgcgatgtgcgtgaagtcgatgtcgggcacgaaacccgcgcgcaggaacgacgacgtgccgaggatcgcgaacgcgcagcacacgagcacgcgcatgttgaagcgcggcgcgtacttgcccatgaacggcgtcatcagcacggggatcacgcccatcggcgcgacggcgagcccggcccagaacgcggtgtagccgagcgtgcgctgcaaccactgcggcacgatcacgttgaccgcgaagaatgccgaatacgcgagcacgagcgtcagcgtgccggccgcgaagttgcgatgcgcgaagagccgcaggttcacgatcgggttcggctcgttgagctcccagatcaggaacagcgcgatgccgaacgcggcgaccaccgacatcacgacgatgaacgtcgagttgaaccagtcggcttcgttgcccttgtcgagcacgatctgcagcgcgccgacgccgacgatcagcgcggcgaggcccacatagtcgacgcgcgcggcaacggtcgtctcgacgcgagcgcgcatctgcgcgaacacgcacatcgcggcgaacacgccgatcggcaggttgatcaggaacgcccagcgccacgagtaatgctcggtgacccagccgccgaacacgggccccgcgatcggcgcgacgaccgtgaccattgcgatcatcgacagcgcgaaaccgcgccgctgcggcgggtagatcgacagcatcagcgcctgcgtggtcgggatcatcggcccggccaccaggccctgcagcgcgcggaacgcaacgagctgcggcaggttttgcgcgaggccgcacaggagcgacgcgaacgtgaacgcgagcgtcgcccacacgaacagccgcacctgcccgacgcgcttgacgagaaacccggtcagcggcagcgcgatcgcattgctgaccgagaacgtcgtgacgacccacgcgctctgcgtcgtgctcacgccgaagttgccggcgatcgtcggcagcgacacgttggcgacggtgccgtccagcacctgcatgaacaccgcgagcgcgaggccgaaggtcgtgagcccgacgctcgacggtcgaaaaccgctgtcggcggccgccatcgggccgctcatcgcaccgtctccgcgcgcgctgccgacggcaggttcgcatggatgacgtcggcgatcaggctgtcggcgcgagccagctcgtcgcggtacacgtcggtgcggaagaccggcgcgcgctgctcgcgtcgcgacagcatcgcgccgctgcggtcgtgctggtcgacgcgtgcgtgcatcgacaggccgatgcgcagcggatgcgcgtcgagctgggccggctccgtcagctcgatgcgcaccggcagccgctgcacgatcttgatccagttgccggtcgcgttctgcgccggcagcagcgaaaacgcgctgccggtgccgacgcccaggctttgcacgcggccggtatagcgcaccgcgtcgccgtacaagtcggcggtcagttcgaccggctgcccgatgcgcatgtgctcgagctgcttctcggtgaagttcgcatcgacccacagctcgcgcagcggcaccaccgccagcagcggcacgccgggcgacacgcgctgcccgacctgcaccgtgcgcttcgcgacataaccggtgacgggcgtgacgacgtcggtgcgtgcatgcgcgaggtacgcggcgcgcagccgttcggccgcggcctgcacgtcggggtgcgatgcgaccgcggtgtcgtcgatcagcgccttgctcgtctggtgctgctcgctcaacgtggcgagcgcgctttgcgcggccgcgtacgcgctttgcgcggaggtcagcgtgtcgcgtgcatgcgcgagttcctcgcgtgaaatcgcgccggagcggccgagatcctcgcgacggctgtagtcggccttcgccttgtcgagcgcggtgcgtcgcgagtcgagttcggcgcgtgcgccgtcgatgctgttcgccagcccgcgttcgttgctgtacaggccgcgcaccttgcgcaccgttgccgcgagatcggcctgcgcggtcgcgagcgcgatctgcgcgtcgctcgggtcgaggcgtacgagcggcgtgccggcgcggacgaggttgccgtcgtccgcgtcgatcgacacgacggtgcccgtcacctgcggcgtcagctcgacgacgttgccttgcgcgtatgcgttgtcggtggattcgtaccagcgtccgacgatcacgtaccagatgccccagccgaggatgccgagcgcgaacacggcgacgagcgcgcgcaccagatgcttgcgccgtgccggcggtgcgggcggcgtcgcgggtgcggcaccgctgggtgccggtggcgtgcgggtgtccggcccgcccggcgcgcggggtgcgccggtgtggtcggccgccggctgctggcgggcgctggcggaatcggcggcggccggccgcgcgggagtctgcaggagttgtcgctgctcatggttcgatatcaaggacgttgggaaggagtggcggcgagcgcgacgtcgtccggctcggcgcgaaagccgccgccgagcgcggcgacgagctgcagcgactggtccgcgcgctgcgcgcgcagcgcggcgacctcgcggctcgcgaccagcagttgctggcgcacgacgagcgcgtcgaggtagctgccgacgccggcccggtagcgcgcgtccgcgagccgccacgcatcggtggcggagtcgaacgcacgctgctgcgcatcggtctgcacggcgagcgaatccagccggtgcagatcgtcggccacctcgccgatcgcaccgatcagcgtcttgttgtaaccggcgaccgcgaggtcgtattgcgcgtcacgcctgcgcagcacgccgcgccgctcgccgccgtcgaagatcggcaggctcacggccgggctggcgttgtaggtgcgcgatgcggcctggaacagcgatgcgcccccgcgcgtcgcgagcccgatcagcgcggtgagactgacgttgggcaggaaatccgcacgggcggccgcgacgttgcggctggccgcctcgacccgccagcgcgcggcgacgaggtcggcgcgccggccgagcagcgcggccgggaggtcggccggcaccgcgagcgcggcggtcggcagcggcgcgggccgcacgagcgcaaggccgcgatcggggccggcgccgagcaggatcgcgagcgcgatgcgcgcactgtcgatcgcctgggccgtacgcgcctgctcgcgcgtcgcggccgcgacttcgctttccgcctggcgctgttgcgcgacgttgtcgatgcctttcgtgacgcgctggcgcgtgagcgtgagcgcttcgtcggcgcgcgtgtattcggcccgcgcgacgtcctgctgatcgaacgcatacgcgagattcacgtaggcgcgcgcaacgttgaccgacagcagcacgcgagcggcctgcgcatcgatttgcgcggcgcgcgcttcgccgagcgcggcttcccacgcggctcggcgcccgccccacagatcgagatcccagctcaggccgagattgacctcgcgcgtgtggctgaagaagccgccgccctcgcccgacgaaaactgggtaccggacagccgctcggcctttgcgctcgcgcggccgtcgagatgcggcagccgcgcggcccgcgcttcgatcaccagcgcctgcgcttcgcgtgcgcgcgcatcggcggtcgcgagatcggggttgccggcgagcgcctcgtcgatcagcgcgctcagttgcgcatcgttcagcgcgcgccaccagtcggcggccggccagtcggcggcgggcacatgcgcgaggctgcgcgatgcggcgagcgtatcggcgccgcgcagcgtgcctgcgggtgcgagcccgtcgcggctcgcgcacgcgccgagcacgacgagcgcggcggcggcggcgattcgcgacatgacgcgcagtgcgccggcatcgcgtgtccagggagcaagtgctgcatgcatcgcattcctctgcttcgtatcggtttgaacacgacacgcattgttggacgccccgggcaaagctgataatgtcgtttagacaaaaataatgaattccagccatgcccatccgagacacttctccaccgcgcaccctgcagcgcgccgattccgatccgagcgaacgcgaggacggcccgtcactgatcgccgtctgggggaggacgacggcagcaacacgtaccggctcggcacccgcgaggtcgactggcacaaccatctgcgcgggcaggtgttctgcgtggaaagcggtttcgcgcacgtgcgcaccccgcacggttcatggctgttgccgccgcatcgcgcgggctggattccgcccggcgagcagcacaaggtcagcatcagcggcgcgttgagcggctggagcgtcgtgatcgcaccggccgcaagccggcggatgccggggcagccatgcgtgatcgcgatcaccgagctgatgcgcgcgctcgtgcggcgcgcggtgtcgtgggcggaccaggacaggctcgacgtcgagcaggcacgcatcagcgtcgtgctgctcgacgagatgcgccgcgcgccgcacgagccgctgcacctgccgatgccgcgcgaccggcggctgctgcgcatcgccaacgcgatcctcgggcagccgcacgacagccgcacgctcgaagcgtgggccgaatgggccgggctgtccgcccgcacgctgagccggctgttcgtcgccgaaaccggcacgagcttcgcgcaatggcgccagcaggcgcgcctcacgcatgcgctcgaacgtctcgcgagcggcgacagcgtcgccaacatcgccgacgcgctgggctatgcgacgccgagcaacttcatcgcgatgttccgccgcgcgttcggcgattcgcccgcgcattacttcgcgaagcgcaggcagccgtagcgcgatacggccctgcccctatcacccctgccagtacagcacccgcatcgacgtcgctatagtcgccgtgcgaccggccggtcggtcgctcaatgtgacttgtggagggtgtcgatgtcgaatgccgttgggtcggaccacacgccgatcgtctccgagcagcagctcgccgatcatctggccgccggctgcaagccggccgtgcagttccggatcgggaccgagcacgagaagttcgtcgtcgcgcgtgcgacgcacgcagccgcgccttacgacgggccgtcgggcatcgccgcggtgctcgcggggctgcaaggcgacggcgcgccgatcgtcgatgccgggcggatcgtcggcgtgatccagcgcgacggcgccgcgatctcgctcgagccggccggccagctcgaactgtcgggggcgccgctcgaaacgctgcacgatacgcatgccgagctgcatgcgcatctcgccgcggtgcgcgacgcgtgcgaaccgctcggcctgcgctgcgcgccgctggggtttcaccctcaccttgcgcgcgcggcactgccgtggatgccgaagcagcgttacgggatcatgcagcgctacatgccgcgcgtcgggacgcgcgggctcgacatgatgcagcgcacctgcaccgtgcaggtcaacctcgatttcgcatcggaaagcgacatggcgcgcaagatgcgcgtgtcgctggcattgcagcccgttgcgaccgcgctgttcgcgaactcgccgttcgccgaaggcaggccgaccggcctgctgtcgacgcgcgcgcacacgtggctcgacaccgacgaggatcgctgcggggcgccggcgctgttcctgtcgcgcagcttcggtttcgagcgctacgtgagctggctgctcgacaacgtgccgatgtatttcgtgcggcgcggcgaccgctacgcggacgcgaccggatggacgttccgcgatttcatgcgacgccgcattccgcatctcgagggcgagacgccgaccctcggcgacttcgccgaccacctgacgacggtcttcaccgaagtgcggctcaagcgctacctcgagatgcgcggcgccgatgcgggttcgcccgccatgatggtcgcgctgtcggcattctggaccggcctgctgtacgatccgaccgcgctgtcggaggccgagacgctggccgccgcgatcgaccgcggcacgctgctgaccctgcggcgcgacgtgccgcgtttcgggctcggcgcgtcggtcgacggccgcccgttgcgcgcgttcgcggccgatgcactcgcgatcgcgcatcgcggcctgcgcgcgcgggcgcgcagggatgcggccggccgcgacgaatccgtgtatctcgcgccgctcgacgagatcgtcgcgggtgcgccgacccaggccgagcactggcttgcccgctatcgcgacgcgtgggccggcgacgcgacgcggatctacgacgaagccgaaatctgaccgcgtcgcgcggggccgctcatgcgcagcacgcgaggagcggctcgtgcgcgaactcgacgtccggcgccggcgcatggccgcgccggcgcgcacgaaccgcgtgcgcgagcgtctcgaggagctgcgtggtatcggcgaacgagaggcacgcatcggtgatgctctgcccgtagcgcagcggcacgccgggcacgagatcctggcgcccttcgatcaggttcgattcgaccaacacgccgacgatgcgcgtatcgccggccgcgacctgcgcggcgacggccgtgccgacgctcaactgattgcggaactggcggcggctgttgccgtggctgacgtcgatcatcacgcgcggtgcgcagcgcgcggccgccatgcgttcgcatgcggcgttcaccgcggctgcatcgaaattcggctcgcgcccgccgcgcagcacgacgtgcgtatgcggattgccgggcgaggccgccgcgcatagccggccgcccgtgtcgaccgacaggaagcgatgcgcgcgcgcggctgcgcacatcgcatcgacggccacctggacattgccgtcggtgccgttcttgaaaccgatcgggatcggcagcgacgacgccagctcgcgatgcacctgcgattccacggtgcgggcgccgatcgcccccatgcgaccaggtcggccaggtagcgcggcgacagcggatcgagaaactcggtcgccgccggcatctccgcgccgttgatgtcgcacagcagcgcgcgggccgtatgcagccccgtgtcgatccgttcgctgccgtccagcagcgggtcgttgatgagccccttccagccgaccgtcgtgcgcggcttctcgaagtacacgcgcatcacaatttccagctcgtccgcgaagcgcgcgttgcagcgcgagccgtgccgcatagtcgcgcgccgcggccgggtcgtgcaccgagcacgggccggcgatgaccacgagacggtcgtccgcgccgttcaacacgtcgacgatcgcgtggcgagccagatgaaccgtgcgcgacgcgcgcaacgcaggctgcagcgcgccggccagatccgcggggacggcaggtgcagctcggcgtcacggttcgtcgtccaggtattcgcatgcatggggactgccctcctgtcgataattcggggatttttactacagcgcgactgtattgaatggcgcttttggtgcgcaactaacatagttgccagtttctaattcataaccttatgaatgacagaaataagcaaggcaaccggaaattgaggcattggatttacctgatttcgagacgcgctccgggccgggaatgcgatttttattctggattctggagcattttatgacgcacggctgccgatttttcagcctttcgaagcgggttgctattcgttctgatagtggcgtcgcgataggtgttcaattaattttcagattcctgacaggccaatcaggatcatatatataaatcaacccagttattgcggagaatcaccatgtcgaaacgtcattacgaaacgccgattcacgtcaagtatcgcgataccgattcgatggggcatgtgagcagtcccgtctattacgactatctgcagcattcctacctctgctacatgttcgatctcctcggcctgccgcggagcgagaagctgccgcacatcatggtgaagacgcagtgcgagtacctcgcaccggcgcaattcggcgacaacctgacgatccggtcgagcatcgtgcgtttcggcagcaagagcttcgatctcgaacacctgatggaacgcgacgaccagaccatcgtcgcgcgcggcatgtcgacgcacgtgatgttcgattacgcgaacaacacgacgcaggccgtgcccgacgagttcaaggcgcgcgtgctcgaattccagggttcgctgtgatgcgcgcgcgccatttcgggagcgacacgtgagcgccgcggtggcgcgcgcccggcgccggatcggtgcgatcgtcgagcgccgcgacgaccgcgcgatcgtcatcgtccggcatgcggcgcaggcgttgctcgagccggccgcgctcgagcgacatcgttcgctcgtcagccgtcacgaggacgaactcgaggtgctgctgcagccgtgcggtggcgcgcacgacggcgtgcgcccgctgctcgggcggttgcgggatgccggcgtgaccgtcgcgctcgacgcggcgacgctcgctcacgacgcgtcgctgctcgagttcgcgagctgggtcacgcagtgcgcgacgcccggcgacacggtgccgccgcgcgacgatgctgccgtgccgggcggcgggctgttctgcggcctggtcgtgcgatggcgcgacttgcgcaacgggtggcggcggccggaacgcgacgacgcgcctgaacgcacgccgcaaacgatcgcggcggatgcggccgagcacatcgcggccggcgatccggacggccaggtgctcggcgcgctgctcgacgccgacgacgcggccaccgacgcggcgctcgacacgttgtcggacgcggtacgcgcgcggcggatctgcgcggcgacgcgggccggctggccgcttgcgcggcggttatgagcgccgtcgccacggcggtcgacgcgcgtgccctgcccgaccgcgcgttcctggtcggcatgatgggtgcgggcaaatcgacgctcggccgcgcgctcgcggcatcgctcggctggacgttcgccgacagcgatgacgagatcgcgcggcgcaccggccgctcggtcgccgagctgttcgacagggtcggcgaaggcggctttcgtctgctcgaaacgcaaatcgtcgacgaactgacgcagcgcccgaacgtcgtcgtggcgaccggcgggggcgcggtgctgaatccgcgcagccgcgcgcgcctgagcgagcgcggctgcgtgatctacctgcatgcggaccccgatgcgctgtggcgccgcacgcgcgatgacacgcggcggccgctgctgcaggtggccgacccgcggcaaaccctcgccgcgctgtaccggatgcgcgacccgctgtatcgcgaatgcgcacatgcgctcgtcgatacgacggcgcaggacgtcgcgcgcgcgacggccgacgtgttgacggtgctgctggcgcggatcgatgcgccggattgacggcgcgtgcgacggacgttcgcttccctgcccccgaagcgacggcgggacgcatgggcgtggcgcgaacttcgagtatccgacgcgttttcgaaacggcgagtttggattttcaatcgtgttgttgtgataagaaaagttatctcgatgatgcgggacggaaccgaaaagcgctgggcaggcgtcgcttaaacgtgggccgtttcatgccggatttcctggccggcgcttcgatcggagcgcaatttccgcggcacggccggatgtgcgtcggcatgctgccgatacgcatcgtttcgtccgctttcgggagcggctcgggaatgaatggcggctgcctgccttcacgaattggcgcatcgtctccggcgagcttcgcgggtcccggttcatcgacgactgcgcctcgcgccaacgggcgacaactgccctccgccgcatttgttcccgagacgcaagactgttgcgccacggtgggtgttcgagatcgtgaccggcgtgtctacagtgagcccatcggattcatcgatccgttcggcactgaagccgggaacccatcacctatcgaggcaaatcatgagcgcatccaaggtcgtcatcgtcaccggcgcatcgcaaggcatcggcgcggaaacggtcgacgcattccgggctcgcggccatcgcgtcgtcgcgacgtcacgttcgatcggcccgtcaaacgatccggatctcgtcaccgtcgcgggtgacatcggcgatccggccgtcgcgcggcgcgtggtcgacgcagccatcgagcacttcggccgcgtcgacacgctcgtcaacaacgccggcgtgttcatcgcgaagccgttcacgcagtacaccgcggacgactatgcgcagatcacgagcgtcaacctgagcggcttcttccacgtcacgcagcatgcgatcgccgtgatgcagaaacatggcggcggccacgtggtcagcatcacgacgagcctggtcgatcatgcgaacagcaacgtgccgtcggtgctcgcatcgctgacgaagggcggattgaatgcggcgacgaagtcgctcgcgatcgagtatgcgaaggccggcattcgcgtgaatgcggtgtcgcccggcatcatcaagtcgccgatgcatgcgcccgacacccatgcgacgcttgcgtcgctgcatccggtcggccgcatgggcgagatgagcgacatcgtcgacgcgatcctgtacctggactcggcaccgttcgtcacgggcgagatcctgcacgtcgacggcggccagagcgccgggcattgagtcgcggcgtcgaaaccgcgagccggcgcgcctatcgcgacgcgccggcccgcctggcgcgtgtcccggccggccgcctggccggctcgcgcgccagctgctcgacgagaaaatcgacgaacacgcgcacgcgcgacgacaggaagcgcgcatgcggatacagcagcatgaagggccgcgaccggccgccgaggccgggcagcacttccacgagcgtgccggcgcgcaggtcctgctcgacgatgaagcggtaggtctggaacaggcccgcaccgccgcgcgcgagcgtcacaccggcgaggacgtcgcccgacgtaccgtagctgccggtcgtcgcgacgtcgacttcctccgatccatcgttgaacagccagggaatcggccgcccgctgctcggcagctcgaactggatgcattcgtgcgcatgcagatcgtcgatggcggccggcatgcccgcgcgcttcaggtagccgggcgtcgcgacgaccacgagttcggcgtcctccagcttgcgcgcgaccaggttcgaatcggccggcgcgcgcccgcgaatcgcgagatcgtagccttcctccgcgaaatcgatgttgcggttgctcaggtgggtttcgacgcgcacgtccggataccgctcgcgaaatgccggcagcagcggcagcacgcgatagtgcccgtacggcgtcggcatgctgatccgcagcaggccggcgggcgtggcctgctggccggttgcctcgcgctccgcgtcgacgagttgcgccagcgcgtcgcggcattgctcgaagtagcggcggccgggatcggtcaggcggatctggcgtgtcgtgcgcacgaacagccgcacgccgagacgctcctcgagccgcgccaccgaccggctgaccgcggccggcgtgacgctcgccgcgtttgccgcgagcgtgaagctgccgagttcggcggcaagacagaacagctcgatgctgcccagcagcagatcgtcgaattgtcgttgcatggttcctgcggtctccggcggatggcgcgcgttggagcgacgagtgtgcatgaatcccgtgcgggaaaccagcggttgcgcatggcgcgattcgttacaccgcgtcgtgaatcaattgcgcgaccgacatttaccggcttcggctgcgtgactacagtgcagtgactcgcaggcagtaccgatcgcccgacccttttcccgcaaggagcatgacatgaccgtcgaacagaagctggccgacctcggcctcgcgttacccgaaccgccgaacccgctcggcagctatacggccgtcagcgaagcgggcaacctgctgttcgtgtcgggacaactgccgctcgtcgacggcaaggtcgcgtataccggccgcgtcggcgaacagttgagcgtcgacgacggcaagcatgccgcccggctcgcggcgctgaacgtgctcgcgcagatccgccggcacctgggcggcttcgagcgcctgagcaagatcgtgcgcgtcgagggcacgtcagttcggccgacggctttttcgggcagccggccgtgatcgacggcgcgtcggacctcttcgccgccgtgctgggcgacaaggcgggacacgcgcgctcggcgctctcccagcgccagttgccggccgacgcggccgtgatcctcgtcgtgatcgccgcgatcgatccggcgtgacggttcggccgccccgcagggccgcaaacgacctccccgcgctatacggccgtcagcggcgccggcacgccgcctttccgaatcagcacgtcgggcgtcaggccgctgcaccgttcgacgcccagcatggccatgttccggtccacttcgtcgcgcagcagcccgatcgcgtgcatgacgccggcttcaccggccacggccgccgcgtaattgaacggccgtccgacgaacaccatgcgcgcgcccatcgcgaccgccttcagcacgtccgacccgcgccgaaagccgctgtcgatcatcaccggatagtccgtgcccagcgcccgaaccacgtcgggcaggatccgcatcggcgagaccgcgccgtcaagctggcggccgccatgattcgacaggatgatgccgtcggcgccggcgtcgcgggcgatgacggcatcgtccacgctgaggatgcccttgatcaccagctcgcccttccattcctgccggatccgttccaggtggccccagtcgagatggtcgcgggccgagaaatcccgctgcaccgtggacgacaggatcggcgcgccgcgggtggcaaaggagttctcgaaatgcggcatgccgtgcgcgagcaacgtccgggcgaaggtgccggcgagccagcgcgggcgcacgatgccgtcccagaacaggcgcggcccggggcgcagcggcgtggtgaagccggtacgcacgttgttttcgcgattggcggacacggggatgtcgaccgtgatcacgagcgtccggtagccggcacgcgccacgcgttcgagcagcgcgccgatgcggcctgcgtcgccgggcaggtatgcctggaaccaggtttccggcgcggcggcggcgacctcctccagtggaatgagcgacgagccgctcatgatcgacgcgatgcccgcgcgctgtgcggcacgcgccagcacgatatcgccgcgataggccgacagcgcatggatccccatcggcgcgatgccgaaaggcgacgcgtagcgtcgtccgaacagctcgacgccctgctcccgctgtgaaacgttgcgcagcacgcgcgtcgcaaacccgtactcgtcgaacacggcacgattgtcgtcgcgcgtgcggttgtcttccgcggcgccgctgacgtagccgaagatcgggcgcggcagcgcgcgtgccgcggcttcgaaatcgtggaggcacagcatctttcgcagcacgcgcggcatgtgcggcgtgcgcgtatcggccagggggcggcttgttccgggaacggatgaggcggaaggagtcatgtctgaagcctgttttcgaatcgatggcggaattttaggtacgcgcggcatgcttaaaagcgataatcttccaatgaatttgttcgataaaagcgaaagacaatggcgaccccgactctcaagcagctcgacgcgttctactgggcggcgacctgcgctaacttctcgaccgccgcgcaacggctgcacctgtcggtgtcgtcgctgtccaagcgcatcaacgaactggaacaggtcgtcgaacgcacgctgttcgaccggagcggccaccgggccgtgctgaccgacgacggcgaggcgctgctgccggccgtggtgcgggtgctcgagtccgtcgccgcgctgcaggaatcggttgccagggacgaagggttgagcggccggctgcgcttcggcgtcggtgaactgtcggcgctgacgtggctgccccgcttcgtggcggcggttcagaagcagcacccgaagctggcgctggagccgcatgtcgacgtgggcgcggcactggaggagaaagtcgatgccggtgaactggatttcgcggtgatcgccggccggtcgtcgcgcagcagtgtgctgtcgcagccggtggcggaagcgcggttcgcgtggatggcggccgaggcgctggtcggccgcgagcgcgtcctgacgccggcgctgctcgccagccatgcgctggtgctgctgccgtccggttcgggcgtgacacgtattctcgacgactggctgctcgcgtgcggcgtcaatcacgcgcgcaggatcgagtgcaacaactggagtgcggtggccggcatgctgggcgaaggcgtcggcatcggcttcctgcccgtcgactgggcacgcgtgcggccgggcggccatctcgtgcagctgacgagcgagccgcctctggcgccgcttcaatatgcgttccagtggcgccgcggcgacgtgcgcgggctgattccgtcgatgctgtcgctggtgcggcattacgcggacttctgctgaacccgtgacttgccgcccggcgtcaggcccgggcgatcgcgaagatgcgtgccgtcgtcacgcttcgtcgatgcgcgagacctgcctgggatcgggcatccacaggtagcacagcagcgacacgagcacgcacgccgacacgtagtagaagaaccacgcttcgtgtccgatgctcttcatccacagcgcgacgtattcggccgttccgccgaacagcgacaccgtgatcgcgtacggcaacccgacgcccagtgcgcgcacgccgaccggaaacagttcggccttggccacggcgctgaccgacgaatacaggctgacgatcagcagcgcggcgacgatcagcgccagcgcggcgccggttgtctgaacgccgcggagcgcctggaaaatcggcacggtgcagagcgtgccgagtacgccgaacgcgatcagcagcgggcgacgcccgacgcgatcggacaggctgccgaagatcggctgcatcgcgacgaatgccagcaggctgatcacggagaccatcgatgcgtcggccttgctcatccccgcgctgttgacgaggaatttctgcatgtacgtcgtataggcataaaacgcgaccgtgccgccgagcgtcaggccggccacgatcaggcactcgcgtttgtggtgaaacaggtcggcgatcgacgcgtggcggcgcttgctgcggcggtgctgctcgaacgatgccgtttcctgcatgttgctgcgcaggaagatcgcgctgcaggccagcaacgatccgagcaggaacgggatgcgccatccccagctttcgagttgcgcggtggtcaggaaaaactgctgcagcacgaccagcacgcccatcgcgagcaactggccgagcgacaaggtcgcgaacaggaagctcgaatagaagccgcgccgggacttgtcggccatctcgctcaggtacgttgccgaactcgcgtattcgccgccgaggctcagcccttgcagcagtcgcgcgaagaccaggagcaccggcgcggcaaggccgatcgtgtcataaccggggtcaggccgatgatcagcgagccgacgcacatcgccagcaccgagacgagcagcgcggccttgcgtccgttgcgatccgcgtacaggccgacgagccagccgccgatcggccgcatgacgaaaccgacggcgaagatggccgccgtgttcagcaactgcacggtcaggttgccgttgggaaagaacgccttcgcgaaatacagcgaaaacgcggaatacacgtaccagtcgtaatactcgatgaggttgcctaccgatccgctgaagatggatcggaggttcgcgagggttccggtcggccgggaatccgtggccgttgcaagagggctgacgcgcgacacgtaatgtctccgtttcgattgtgctcgtgatccgtgcaagtgccggccgtgggcgggccgcttgcgatcgggtgtggcaagggtagaagagacattgcgttgtagaaagcgaaataatgacaaggagcctgttcgctttctggaaagtcaggctggcaactccccgcttccgtgtctgtttcggcgtcgttccgtgttccccggttatcagggatcgatcgccggaaaggcttgtcctggaaggcgccccgcgttccggatacattgaaatacaaaatatcgcatacgatttaatcgaatgcgcttgacgtggacgggcgacaagaccaaactgcgtcgcatgcgatcgaatcgcatctgagacaaacctcaactgacggagcaaatgatgagcaagatcgaacaagtgctgtacacgggcaagacgcatacgacttccggcggccgcgacggtgcggcacgcagttccgacggccgcctcgacatccagttgtcgtcgccgggcagcgccggcaccggcaccaatcccgagcaactgttcgcggcaggctggtcggcctgcttcatcggcgcgatgcagctcgcggcgcgtgccgcgaaggtgacgttgccggccgatctcgccgtcgacgccgaagtggatctcggcaccgccggcaacgcgtactttgcaggcccggctgaacgtgagcgtgccggggctcgatcgcgacgtcgcgcagcgcatcgtcgatgccgcgcaccagacctgcccgtattcgaaggcgacgcgcggcaacatcgacgtcgacatccgtatcgcttgaacgtgcgtcgggcggcccggcgccgcctgaccgaatgcccggttcttattctttttcgaggtgaatgatgaatacccgactgatcgccgcccttctcgtcgctgtttcggcctctgctgccgcaccggcgttctccagcgaaaccaccgtggcgcgtgcgcaggtgcgcgccgaactcacccagctgcaacacgccggctacccgctgaatcgcgcgaccgacgcaacctatccggacgatctccaggccgcactcacgcggatccaggcggccgatgcggtcgccggcaacgaccaggcgtccggctatggcggcaacggcgatgcggccacgcaatcgggccgccggcaagcagtcagcgtggccgaccgctcggtgtatttcggacattgagcgtgccgcgccgcctgtcgaaacgcgaaccctgaatcccttccatccctgttctgtcgaggtaaatgatgaaaacccaattgatcgccgcccttctcgtcgccgtgtccgcctccgccgccgtaccggcgttcgccgctgaagccgtcgtgtcccgcgcgcaggtgcgtgccgagctcgtccagctggaacaggccggttatcagccgggccgcgcgaacgatccgcactatccggtcgacctgcaggccgcgctgacgcgcattcacgcgaacgacgccgtggtggccggtgcggtgacatccggttacggcagcgaaaccgtcgccgcgacgcagtcgggccgccggcccgcgacacgcgtcgccgaacgctcgatctacttcggtcattgaacgaaaccgcgaacggcgccggctgccggcgcacgatgcgcaaccgctgaatccatttttgtcgaggtgaatgatgaagaccccactgatcgccacccttcttgttgccgtgtcggccgccgttgccgcgccgacgtacgctggcgaaagcaccgtgtcgcgtgcgcaggtgcgtgcggaactggccgcactgcaaaaggccggctacctgccgaaccgtcccaacgacccgaactatccggacaatctgcaggccgcgctgcgccgggtccacgacaacgatgcggtcgcggtcgggtcgcaagcgtccggttacggcgacgatgccgtcggggcgacgcagtcgggaaaccgcagcgtgattcgcatggcggagcgctcgatctacttcggccattgagcatgcgtcgccggaatcgttacgcccgtccgggcggcgcggtacgacgtgcggggaacgggggcgcgcgagcacgacgcgctcctcgtcgcctttcggcagcaagcagcgatgcaggttgatgtacatccgttacttgcatcggcccgggattcgatcgcgcgcggcaccgatacggcagccggttctcgcgaccagtgcgcatgcaagaagagacagcattcgtggcaggccgaacaacaccccattcccaagcgcgttcacgatgatgaacgcacgtctgccgatggccctgcgccgctcgaatcgagtgacggcgtatggcgcaaccgggtgatatcgacgccgtgcaggatcgttgcttccgcaaccgcatcccgctgcggcggtgcatcgggccattgacggccgattgcatcgacccggcgttcgaagcggtacacgatggcgggcggaaagttcatccacgcgatgccgatccggatggcgcgaatgtgcatcgcctccaggtagcgcggcacgtaggtgaacgggtagaacacgccatccgcggccaggtggcgcacgaacgcgcagtgaacgatcgcgacggcctgttcggccggcatcgcgacaagcggcatctcgtcgaggtgactgccggtaccggaggggatgggctggcggtgatcctgtcgtttccagtcagggcggagccggcgcgccggcaacgctggcccgggcttcgcaacacgtgccgcgcatcccgcaccgtgccggtgacacgatcgatgttgcgccgcgccctgcctctccggtcccggtctatgctgtgcaaccgaaaccttcaatcgaggagcagccgatgtccgatgcaacgaccggaaacgcaacaggcgcaacaggcagtacgcacccgctcgaccatgtggtgtggaacgcgctgaccggcaggcagcgccgctttgcgctcggcgacggccgtgcatggcggtttccggccgccatcgcgccgtttgccgcgatcgaggataccggcgcggcatcgttcgacgcgttgcgcgcactggtcgccgcacacggaccggcggcactcgtcatgccggacgagatcgaactgccggcgggcttgtcggcgatccggcgcgcgaccctgttgcaaatggtctggcaagggacgcccgccccggcacctgaagcgggccacgtcacgctcgccgaagccgacgtgccggacatgctcgcgctgaccacggccgcgcagcccggcccgttcggcccgcgcacgttcgagctcggccgctacatcggcatccgcagcgaaggcaggctggccgcgatggccggcgagcggatgcaggtcgacgggtataccgagatcagcgccgtgtgcgtggatgccgcgttccggcggcaagggctggcggcacgtctgatccggtcgttgatcgcggccatcgatgcgcgcgcggaaacgcctttcctgcacgtcctcacgtccaaccgggtcgcgatcgagcgttatctcgcactgggttttgtcgtgcgccgcgagatgcacctgctggtgctgggcgacgggcacgcatgacgacgcggccggcacgatgcacgtgccggccactggtagcccgtggggttattcgtcggtcgactggatcaggttgccgcgcagcgtgacgatcgccttctgcatcttcgcgaattcgtccggcttcagcccggtggcctcgacgaggttcatgtcgagccccttctcgcgcacgcggcgcccgctcttcgtcaggctgacgagcacctggcgttcgtccgacggatcgcgatgccgctccaggtagcccattgcctcgagcttcttcaggattggcgtcagcgtattggattcgaggaacagcttctcgccgagctggccgaccgtctggttgtcctgctcccacagcgcaatgatcgtgatgtattgcgtgtacgtgaggcccagctcttcgaggatcggcttgtaggccttgccgaacgcgaggttcgtcgagtagatcgcgaagcacaggaactcggacagcttcggcgcggcggtggatggtgcttcggtcggtttcatgaacgtcctccagcgacgcgaacggccgcagatggacggattatatatcgcgtgcgatcttatcggaagcatgataaatcggtctcgatgaaccaacgggcgccgcgcgccgtcaatgcggcgtgcggcgcttgccggtctgcacacggctggccgacagcagcgtgcattgcaccggatgcgcgatttcggtcgcgaccccgcctgccgcaaacagcaggatcatcagccagcgtttcatgcgtcctccacgaccgaaaggctcgcgccgtcggcgaccgtcgcgtcgagcgcatacgggtcgataccgtcgaggcagccgagattgacgcgccagcaggccggggccttgcgggtctgatggaacggatagacgccgcaatggctgcagaaatagtggcgcgccgtgtgtgtgttgaagcggtagcacgtcagcgcgccctcgccttcgacgatcttcagttcgctcgcggcgaacatcgggctcatcagcgcgccgcgccggcggcacaggttgcagttgcagcgaaccgccggcgtcacggcggctcggacttcgaatctgacggccccgcaatggcaggaccctttgagccaggttgcagacatcgtgcactccagaagaggtcatgcctgctttatagcggacgcccgaacctgcgatgtatcgcgatgtatcggcggttcgcgcagatacaggatgtttcaaatcggcggcgggcaatcgggttgcattttccgattgccggcatgcgcatgcggcccgccgcgtgtggagcgcggatcgtgcgatcaatccagcacgtgctgcatccgctcgattgccgcccgcgtctcgcgttcgagtgcggcgaacagctcggccgccggcagctgccgcacgagcggcgccgcctgcccggcccactgcgcgccgtagccgaattcgccctttgccttcgcggctgcatgcagcgccttgccggcgtcgtaggcgatcgggtacgcgggcgtggccggcgcctgcgggtcgtcgccgagcgcggtcagccggttcgcgatcccgcgcgcggtccggccggagatcgcggccgtgaacgtcgtgcgccgtgcggcgtcgcttagcagcgcgcggcgataaccgtcgtcgatcgctgtctccgggcacgcgacgaacgccgtgccgagctgcgcggcctgcgcgccgagcgcgagcgcggcggcgatgccctcgccgtccatgatgccgccggcggcgatcaccggcagcgcgcattcgcgcacgatcaggcgcgtgagcgcgaacgtgccgaggcggtcgtcacgggcggtcgaatcgaacacgccacggtggccgcccgcttcgatgccctgcgcgacgatcgcgtcgatgccggcggcggcgatccggcgtgcctcgtcgagattcgtcgcggtcgcgaacagcgtgacgcccgcgcgcttcagcgcgtcgatcacgtccgcggacggcagcccgaaatggaagctgacgacggccggcttctcttcgacgagcagcgcctgcatcgcgtcgtccgcgacgaagctcgtatagatctccgacagcgatgcgggcggcgttgcgccgtattcgcggaacgccggcgcgagccagtcgagccaggcgcgttcgacggccgcgtcggcgcgtgccggccggtggcagaacacgttgatgttgaacggccggtcggtgagcgcgcgcgtgtcgcggatcatcttgcgggcgccttcggcgttcgtcgcgcccacgccgagcgagccgagcccgcccgcattcgacacggcggccgccagcaccggcgtgctgacgccggccatcggcgcctggacgatcggtgtgcgcacgccgagcgtgcgcaacagcgtccggttgtcggtcgattgattcatgtcgctggcctcctgcaagatccgcaatcgaaatgcctcgaccggatgcgggccgaagcgcgtgggtcgggttcggatcggtgcgcgtgggtcgtgccttgcgcgcagccggtcgcatgaaagttctgtcgaaaaggcgcgcagccgtgcggtgcggtgtttgccgtcgcggcgacggcgtacgacatcgcgcgttgcgcggcgcggcacctgctgctgcgcccatcctacgcccgcccgtgacccgccggccagcggctatcggccgcgcgcccaatgcgcgagccccgcgcaagccgccagcagcgcacccgtcacgaagaacaccgaatgcagcccgagcgcgacgccgatctgcccgccgatcaccgggccgatcacctgcccgctgaactgggcggactgcaggtagccgagcatctgcccggtcgcgcgctcgtcgaccgattgccgcacgagcttgccgatcgacggcagcaagcccgcgagggtcatgcccatcagcgcgcgcagcgcggcgagctgccaccagtgcgtgacgaacgcctgcggcaccatcgcgagcgcggtcagcaacaggcagccgatgatcacgttccagctgccgatccggtcggccagcgcgccgagccgggcggcggtcagcatgctgccgagcgccgaacacgccatcacgacgccggcgatacgcgcaagatgatcgccaccgacaccgaggccgccgatatagacggtgatgatcggttcgatcgacatgttcgcgagcagcaccatcatcgccgtcaccagcagcgcggccaccgccgcacgattcgtgccgcgtgacgtgccggccgtcgcgctcgtggtgcgcggtttcgcgtcggtgcccgcgtggaaatcctccttcacgacgaagatcgtcagcagcgcggcgacggcgatcatcgcgccaccggcgaagaacgtaccgcgaatgccgagccagcccggcagcagcccgccgacgagcggcccgaccaggttgcccgcgagcgcgccggtcgacaggatgccgagcgcccagcccgcgcgttcgcgcggcgcctgcgtgccgaccatcacggtcgaggccgacgcgtaaccgccgacgagccccgcgagcagccgcagcacgacgagttcgaccacgttgtgcgcgacgccgatcagcgacatcacgatcgccatgccgatcgccgcgcgcacgagcatcggcttgcggccgaagcggtccgcgagccggccccacagcggcgcggtgacggccgtgccgagaaacgtcgcgccgaacgcgacgcccgaccactggatcacggacgactgcgcgtcgacgccgagttgccgcacgtacagcggcaggaacggcagcagcatgctcaggctgacgagcgtcgtgaacgacccgaacacgcagacggcgagattgcgccgccagtagcgcgcgttgcgttcggcgtagccggcggcgggccgttcggcccgtgccgcggcggggcttgcgagatcgtgctcattgcgccctcgccgttgcggtcatcggtgcggcaaacccttgcacgacgaagtgcgccggcaacggcaccaaggcgaaacgcgcaacgccgatgccggatccggcgcggcgcgcgccgaacgcacgggcgcggggccggccaggaagcgctcgatccatgttgacctccattcgctgaacgggcgccatgcgcgtccgttggttgaaggaagtctagattgagccgattgccgagtgaatcgccgtcactcgaaagccattcttccgcatcccggttcaatcgccgtcggtgatggccgccagccgcgcgaagtgctcgcgcaggcgcggcgccgcgaaatcgacgaacgcacgcaccttcggtacggaaaggcgcccgtaaggcgtgacgagatggatcggcaatggcgcgtgttcgctgtcgcgcagcacgatccgcagcgtgccgtcccgcaccggttcggcgacgtggtaggaaaagagccgcgtgacgccgtggccggcgacggccgacgcgaccgcgccgcggatcgtgttgatgatgaagcgcggcgcgaactggacgacctgcggcagcgccgtcggcgcggacggcggaagctccacgaatcgaggccgaaatgcgtcatcgagatgatccggtgccgggcgagatcggccggcgtctcgatggccggatgcctggccagataatcgggcgacgccacgacgacccgccgcaccgcgccgaccggaatcgcgaccagcgtcgaatcgctcaggtgcgcgatccgcagcgcgacgtccatgccttcgtcgatcaggctgacgggacggtcgagcaactgcaggcggatcgacacggcgggatggcgttcgatgaattcgtcgagcagcgcgcgcagcacgtcctcgcccgcggcgaccggtgcggtgacggtaagcatgccgcgcggcgccgagcgttcgtcggcgaccagcatgtcggcttcctcgagatcggacaggatgcggcggcacgcggcggcgtagcgttcgccggcttcgctgagccggatcgtccgggtcgtgcggtacagcagcgcggtgcccgtgtgcgcctcgagaaacgcgatcgcgcggctgaccgccgccggcgaccggccgagcttgcggcccgcgcccgcgaggctgccttcgtccagcgtggcgacgaacaccttcatcgcgtcgattcgatccatggtttgagcgggccgggtgcgaacggtcgtgtgatgggcggcaggcaagcgagcgagcagtctaccgcacaccggtgcgatgcccggcccggggatgctgcacttgccgctttggccctacaatgcgcaggcgaaaaaccgcacgaaaggccgtcagggcgccgcgttcgtcgaacgcagcgtctgacattcaagcggttccgctgaataacgaaccacaaccaaccatcactcatgaaaagaagaacatttctcgcgctgcccgccgtggccgcgtccggcatgcttgccggctgctccaatttcggccccgtcaccaaggcgtggatgagcgattcgaaatacgacgaaaccttgtcgacgttcctgattaccgcggacggcaaacagctcgtcgtgctcggcaagaagtatcactacatcttcgagatgccgccgagccttgcgacggtgctcaacgcccctatcgccccaagattcacacggcgttcagtgatttcgaggcgcacggcgacgcgattaccggtcaatacacgatgaggctggactacgcggatgcgccgaccggctccgacgtgcgcgagcgtgcgctcgcggacggtttcaagaaggacggcgcctacctggagtcggaaggcaggatcagcggcaagcgctatctgccgaacgatgtcacgtcttcgtcagtcccgcaggcgttcaatcggccgtacgaggtcacggtgacggacaagctgacggctgtcggccgcggcgcgaagctggccttgtcgccgatcgcgatggcggccgatggcgcgttgggcctgctcggcctcgcgctgtttccgatcgcgctcaccaccttcatcatcgtggcgagttgaggtgcgatcggcgatgaaatctcctgtccgaaacctgttccgcatcggctgcgcggcggcctgcctcgcgttcgcgcagcatgcctttgccgaaagcgactgggacgccgcgcgccatgtccgtaccgactgggtgttcgcgtcgatgaaggaaagcgatgtgcggcccacgctcgatcgcgcgctgaaggaccaggcgcgctgggccggcctgcccggcaacgcaccggatgccggtgcgttcagctgcacgaagctcgcgctgccgccgccgtctgccgaagcgcaggccgcgttcgacgcggcgccgtcgtcgcgcggccgcgacgccgacaaggcctacgcgaaggccgcatcgctcggttcgtggcgtgcggccgcgcgcctcgcgagcagttcgctcgacgacgaggattgggaaggcgcgcagccggcgattgcgtggctgctcgttcatcacgtgccggccggctacaacaagctcgcggatgtcttgcaggcgatgtcgggctacgacggcgaaacgcccggcgagggcatgagcgggatgatcgcgtcgctgcgctggcgcgcggcgcgcgaaggcgatccggtcgcgcagatggaaatggccgacctgttcgagaagctcggccagcccgatctcgtcaccgcgttgcgcgcgtgtgcgacgcagcagaatcccgcgctgaaatgatgcgagccggtatgcggcaatgacgggcggcataccggctcgtgcggtgacatttgccgtgacgccgccgcatcagacttcgtaccgcaccgcgtgcgcctcggtgggcagtggcggatcccagcgcggcagcatcgcctcgagcgcgcggttcgtcagcgacgtgtcgcgccgcgcgttgcggcgcaacagctccgcgcgcggctgctcgagatagacgagcgtcacgtcggcgccgtacgcgaacagcaggtcgagcgtcttcttgcgcatcagcggcgacaggttcgtcgcgttccacacgaacggccgcttctcccgcaacagcgcttttgcggcgtcgaccgcatggtgcgcgacggcgccctcgttttggccatggcgcagccccaatgcatcgcgtgcatcgtcgaacgacacgacgggcaggtccggatgatgccgcgcgacccacgtgttcttgcccgacgcgggcaggcccgacatcacgacgacccgcgagcccggcgtgcggaacagcggatagtcgggatgcacgtccgcgccgcgaaagtagctgagcgcggtgtgcgcatcggcgaacgcgcgcggctggccataacacccctcgtcccgcgccagttcccgcaacagttcgatgttgtcgagcacgcgctgcgtatcgctgcagatgcgcccgcgcatatcggcttcggcgagcaggcacagcagcggcaggctcacctgccacgacagttcgcgcgcgatgaactcgggcgtgccgcggcgcgacccgctcatcgcgaagaacggcacctggtgcacggcgatcatccggcagatcgcctcgcgcaccgcgaacggcacgccggcatcccacagcgcgatacgcgcatcgatcgccccttgcgcgagtggccgggatgaccgatcgcgccggtgacgggatcgacgatcgtcgtgcggtacttcgcgatgtcgtgcagcagcgcggccaggaacacgatttcctggtcggcgcgcgatgcggcctgataaccgggcaacgcgagcagcgtatcgatcaccatcgtcgtatgcgtccacacgtcgccttcgccgtgatgcgtcggctcctgcggtgtcgttttcgcctgttcgagcgcgggaaacgccgcgatgcatgcgcggtagtccggctgccgtccaggcgcgggcacgagtgcctgcagttgttcgtacttcatgatcaagactcctctcgaaacggcgcagggccgttccgcattcatgggtgcgtgcgtgtcgcggcgatcgatcgccacgtgaccgtcggccgcggcgcatacaggtcgacatccggtgcgagcaggttcgggatgaacggctgctccgagtgatggcgcgccgattcaagaatcgcctgcacgaaatcgtggcggacccacttcaggcgcgcggtcgtcgtgtcgtccgtctcgaccttcacgtagagcccttccgcgcgcgccgacttgtcgcactgctgccatgcgcgtgcgaggtcgagccctgccgccgcaccgtttcctcgaacgcgcgacgccagtccggcgtcttcgcgagcgacgggccgagcagtgccttcaggtcggcgagccgcgccggggcgatgccgtcgtacagcacgggcaccgacagcacaggcccgtcggcaagcagcgcgcgacgcgcgcacgtcgacaggaaacggcccgtcgtgcggtcgaacacgtcgaattcgaagaagtgatgcggcagcgcgtcgtagaacaccgcgtgcttcttgctcatcgtctcgccgtacatcacgtagcgatcgccgaggcggtcgagcagccagcctgcatgggcggcggcccacgtcttcacgaaaccgaactgccgctcgcggccgccgccggccagatagtggccgcgcgactgcagcagcagttcgcccgccgggccgaagctgatgcccgtattcgcgccgtcgagcttttcctcgacgacgatgtgcgcccgcgagggtgcgatagggaacgtgttcgcgaccttcgtcgccgtcctgcaggcgcgagcctttgagatgcggcgtgcgcgggtagcgggcgaggtcgagcgattgcgcgtatgcgcgaaaatccagcgtcatggtctttctccggaaacagggaaaaagccgacgacgtgaacgaacggtctggtgtgcgttgcggtgtcagtgcttgtccgggcgcgttcctgcagtcgacgttccggcgccgcgaggcaggcggaaacgggcaggacgacacgcggccgggacggcagtcgtcggcgtatcaggcgaagggacgaatgtttgcgggcacttggatcaccggttcgatgagggttcagggatgaagcaggcggatgctacgaaacggcttttgcactgtcaagcgctgtcggaacccgctgatgcagccgcctgcatgcgttgaatacctgctgtggcgtgccgcaagcgccatcggcacgaagattgtcaggatgtctatatgtgtgtttttcgccacatcgggcgacgattcggtaggcgccgccgcgctacccgcttgctgcgcccgctgcgtgcatgctagagtcgccgccattccgatcaacccctcactcgcaaggagaagaacatcatgacgtcacgccaacgctcctcccgtcgcgggtcgtagtccgggtttttcgcgtccgtccgtttcatcgttcacgccacgcagccgcacaccgtatcgccgtcacggcgatgagccgggtcgttccgatccggtcgtgccgccctcttcccgacttccgatgtcaggcagcgcattcgagcgctgcctgtgccatggcccgccgttctaccttttcatcgaacggaaacctccatgggcaattccatgcaatacctgggcgagcgcgtcaccttgtgcgcttgcgccaccacctggatcgaaggtgaggccatccggcagctcgaacacgctgccaccctccccggcatgcggcgtgtcgccggcatgcccgatcttcaccccggacgcggctacccggtcggcgccgcgttctttcgacgggccggctgtacccggcgctgatcggcggcgatatcggctgcggaatggcgctgtggcaaaccgcgctcgatgcgcggcgcgtcagcccgtcgaagctcgcgagccggctcggctcgatcgacaccacgcccgatgcaagctggcagccgctcatcgcggccgccgggttcgcggatcacgcgttcgcggcatcgctcggcacgatcggcagcggcaatcatttcgcggaagcgcagcggatcgacgcggtgtacgacgccgatgccgtccaggcgctcggcctcgatcacgaccgcctgctgctgctcgtgcacagcgggtcgcgcggtttcggccagtcgatcctcgaacagcacatgcgcgagcacggctacaacgggctcgacgacacggatgccgcatgcacggcataccttgcgcgccacgacgcggcgttgcgctacgcgatcgcgaatcgcgacctgatcgcgcggcgcatgctggcgcgctggcgcagcgacggccggtgcgtgctcgacgtgaaccacaacctggtgagccgcgcgcgcgtcgacggcgagcccggctggctgcatcgcaaaggcgcgacgccggccgatgcggggccggtcgtcattcccggtcgcgcggcgactacagctatctcgttgcccccgtgcggcccgacgatgcggccagcctcgcgtcgcttgcacacggcgcgggccgcaagtgggcgcgcggcgattgcaaggggcgtctcgaacggcgcttcaccccgtcgcagctcacgcgtacgccgctcggcagccacgtcgtctgcgaagaccgcgaactgctgtacgaggaagcaccgcaggcctacaagccgatcgacagcgtcgtcgacgcgctcgaggcggccggcctgctgcgcaagctcgcgcggctcgcgccggtgctgacctacaagacgtccgggaggccggccgatgctgatgcagatttcttcggcgcacgggccgctggagtgccagctcgccgcagccaatgcgttgcggcgcctgcaggcggaagccgatgcgcagcgcgtcgtcgtcacggtgctcgatgtgcagccgggcgaacggcccggcacgctgcgctcggcgctgctcgatctcgacggtgccggcgcgcaggcgctggcggaccgctggacgggcacgctgcaatggatttgcgcaagcccgtaccggttgcgccatccgcgcaagaactggttcatcggtgtcacgcgctgcgccgacgcgcagccgctgccggatggcgacgtgcggttcgaagcgatgcgcgcacgcgggccgggcggccagcacgtgaacaagacgagctcggcgattcgtgcgacccatgtcgcgaccggcctgtcggtgcgcgtggaaagcgagcgcagccagcacgcgaacaagcgcctcgcgctgcagttgctgcaggttcgactgcagcaggaagccgaccgtcacgcgtccgacgcgcgccggcagcggcggatgcagcactttgcgctcgagcgcggcaaccccgtgcgcgtgtttcacggggcggcgttcgtgccggccgactgagcatgacggcccgactgccggcggttgtttcgccggcagtcgcgcaacgggcctcatggttttcccggccagccggttgcgtgagcgcgccggcggttccggtgcgcgaccgcacgccacgcaggctgcacgggcctcacgcgcggatgccggctgtcgcgtgttccgcaccctttctgcgcgggaaaggatgcttgaaacatccgcaattatcacgtgccgcggatttgcccaccatgtgccggacgatcggtacagcccgcctgtccggccctttcaacggccttgcggtgcctgccgccacgtcgtgcgaccggatgcatcgcgccggtcgcgaacggccgggcttcgcgccacggcgtaccgataatcaggagacacgatgaacagccattccctcgatctcggcggcaacgcgggcgaacccgcgcccgcacgacctgcgtccgccgccggcacgggcgctgccgggtcggccctcccgcccgccgcgtcacgctcggcgatttcatggacgacctgccggttggcgcattgcaccggttcgtcgtctgggtgatcggtatcgggctgtttttcgacatgtacgagatcttcctcgtcagcacgatcggttccgcgttgcagaacgaatacggactgagccggcagagcaccgatttcaagctgctgctggcctcggcgttcatcggcatgttcgtcggcgcgatgtgcctcggcagcctcgccgaccgcatcggccggcgcaaggctttcctgctgacgctcacgtggtacagcgcgttctcgctggtcggcgcgttttccgtgaacgccgacatgctcgtcgcgtgccggttcctgaccggcatcggcgtcggcgcgatctatccggttgccgacagcttcctgtccgagatcctgccgaaggaaaagcgcgggcgcctcgccgcgtgggcctatacgacttcctatgtcgcggtgccgctcgtcggtttcctcgcgctgtggctgaatccgctgcacgtgggcggcgtggccggctggcgcatcatcctcgcgatcggcagcctcggcgcggtgtacgtgctgttcgtccagcaccggctgccggaaagcccgcgctggctgctcgcgcagggccgcaccgccgatgcatacgcggcattgcggcgcttcgcggagggcaccggcgtgcgcgtgcccgagcaattcgcggaaccggtcgagccgcaacggccgctcgggctcggcgagcgtttcgcgctgctgcggcgcgaaccgtacggcgcgcgctacctgatgctcgcgatctttcatctgttccagggcttcggttattacggcttcggcacgctggccggcacggtcgtgaagagccgcggcttcgacgtgacggacagtacgctgttcatcgcgctgtcgttcatcggctatccggtcggctcgctgctgtcgattccgctgctcaactggatcgagcgccgcacgctcgtgattgcgtcgatcctgtcgatcgcggcgttcgggctgtgcttcgcgtactcggggcaaaccgtgctgatcgtcggcttcgggttcctgacgacctgcgcgtcgaacgtgttcagcaacgcgtatcacgtgtaccaggcggagatctttccggcgcgcgtgcgctcgacggcgatcggcagtacctatgcgctgtcgcgcatcgtcagcggtgcgctgccgttcgtgttgctgccggtgctcggcggttacggcgcgggcgcgatgttcggcgtgatctcggttgcgctcggcatggtcgccgtcacgctgcgcgcgctcgggccgctgacgacgcggcgcagccaggacgagatcaatccggtttgagcgtgtgtcgatgcggggcgcgggaacgcgctcacgcatcgttcctgatgcttcgcggatggccgggctatcggtcgcccggcggcccacggcagacggtcgcatcttccgcgcacggtcacggttacggccgcggtcacgcaacgcccgcgtgcgccgaccgctggcgggcgaaatccgaagcgggatgcccggcgatcgacggttgcgcccttcactgcgcgccgtcgccgcaagggccctgcgacgccatgtccgcgcgagaaacgacgaccgtgaattcgatcccggattcaaaatccagtgtcatggtcgagaagcgcggatcgtcatcgagatagtgcttgtacggtcgaacggcgtcctcggccgtgtacatgttgtcggccagaacgatcgaccgcgggcgcagcaagcgctcgatctgcctgaacaacttcaggtaggcgtcggcccagacgtcgatgaataccatgtcgaagtgcccgtccagttcggcaacggtctcgaatacgtcgccttcccggatgtcgacatgggcatccaggcccgccgtgccgacgtgatcgcgcaatcgggcgcacttgagcgggtcgcgttcggtcgcgacgaccacgccacggcccaacgtgcgcagtgcctcggcgaaatacagcgtggacacgccgcacgagctgccgagttcgaggatgcgggccggccgttgcgagagcaccatgttgcgcaagaacccgcccgtttccggcgacacggccaacgatagccggctgccttccggggattcgaagtcgtcggtgaacagcccgaacgtttcgagaaaccgcccccgcagacgagggcgatcgcttcgtattcctctgctaacgacagaagctcctcgttcgatcccaggaactgcgcgcgggcgcgggcgatgatttcggtccggctctcttcgtggagccgtcgcagaagaacggcggtgggtgaagccatgtgcgttccttgacgagattgatcacgtcgacgatgtattcggcggcgcctctcccgccagggtttcggcgcggtcgctcgatatcggcgacatgcggaggttgtcatgcgattcgggcgagcgtgatggcgcgctcggggcacgcggtcacacatagtccgcatgaccggcacgcatgcgcgttcggcgtgtaggcgacttccatgccgtgcacgcgcagcttcaggcgatgcatcaggccgaggccgacgtaatcggccgggtcgatgcgtctgacctcgaacacgttttcagggcaaaccgcgacacaatccctttgccttcgcaacgcttcagatcgacgaccggcgcgatcacgcccggttgctgtttgcagtcgcccgtggatttttcgcgcacgttcacgctcccgagggccggtcgtcgccggagcgccacgcgttgcggaaatgctcgcgttcctcgggcgtcatcgattcccacttgcgccagtggcgccggccgcgccagccgtggtgtccgcggaatccgccgaacaggatgcggctcaacacgagcaggcccagcgcccgggcgaaatcgatcgtacgggcaccgacgaacagcgccggcatcacccagttccacaacatcatgacgacccatccgagcacgcctatggcgatcaagacgagcaccgccttgcccgcgcatctgattcgaaaattcatttgtcgactcctctagatattgtccagttcgtcatgaatgagctgcagtcgtgcacgcagatgcaagaccgcatagcgtttgcgcgcgagcagcgtattgagcgcgacgccgctttgcgtggccatctccttgaaggaacggccctccagttcgtgcgcgataaacacctcgcgctgattcgccggcagctcgtcgagcgcatcctgcaaggcttcgagcaggagcgtgcgcgcgtagactgcttcggggccggcatcgtgcgccggcagcacgagatccaggcggtactcactgtccgcgtcgtcgtcggcctcggacagatcggtcagcggctgctccttcttcttgcgaaagcggtcgacgatacggttgcgcgccgcgcggaacagccacgcgctcacctgttcgatcggcgccggaagccggtaagcctggacgaattcgtgaaacacgtcctgaaggatgtcctcggcatcgtccgggtcgcgaatccgacgccggatgaagctcaccagcctcgttcgttcacgcatcactatcgcggtgatgtcgcggtctgggtcggtcatgtgcgtgaagtgggtggcgattccatgcacctgaagacgtttcaggcgcgggaatattgtgtcgagtgcgaaaatgactgctcaacccggcggcttcaagggagagatcggttacaccgcccatccagcgggcagcaattgggccggcccgacggtcatcgccgacacgagcgggaacggtgtaacgatagtgcaaggaacgaacccgcgacgacaaggcgaagtgtgcgggcggcggcacgggcgttgctggggcccgacaggaaagtacgtgccgtgctcgcgactgtcggctgcatccgggttgtactactcgccggctgttcgcggtcgtccgccggtcggtctgacgcggctgctacgaatcggcttcccgcaacggcatcggcttcccgccgcggcgagccgaacgcgccccgacgatcgcccttcccgaagccgcaccgcgacaattcccgccagctcgcaggccggcctcaacgcgccgacatgaaatcgaacagcttcgcgatatcggtcgtcagcaccgttccggccttcacgccgacccaaagcgtgcgcgtcgcccacgcatcgtcgagcctcacgactccgagccgcgccgcgcgctcgccggtcaccgcgtcgcgcggcaggatgccgatcccgagccccgcctcgatcatccggctcacgccgtcgaaattcgatacctggatccgcagcttcagcgaacgctcgaccgcgaacgcggcgtcggtcatgcgcgcgagcagcgaactgccgtcgctgagcccgacgtagtcctcgtcgagcgtgtccgcgaagcggaggctgtcgcgcgcggcgaaccggtgcgtgcgcggcacgagcagcacgagttcgtcgcggcggtacagccgccgttcgataccggggccggcacgttgtcggcgaacacgccgagatcggccttgccggacgcgagcgcgtcgacgatctcgtggctcaaacgctcctcgaggctgaccttgatacccggattgtcggtgaggaacgccgcgagatcggcgggcaggaactggacgatcgcggacgtgttggtccacacatggatgtggccacgcacgccggcgacgtagtcgctcatctcgtgcgccatccggttgacctgctcgatcaccttcgccgcatggtcgagcagcgcgcggcccgcgggcgtcagctcaacaccgcgcgcatgccggacgaacagcgcgctgcccgtcacgctttcgagctcggcgatgcgcttgctgaccgcggacagcgtgagctggccatgctcggccgctttcgtcaggctgccgtgctcggcgacgagcgcgaacacgcgcagcgattgcagatcgaaatgaagcgggttcaccatgtcgtgggtcctgggtaggccaggccggcgcttgccgtcagcacggcggcctgacgccgatcatacgcccggccgcccccgcgcgatacggtgcggtacggcgcaaaacagcgcctagcgcggcgcgatcgactgcaacgcggcgagcatcgcaccgtccggtttcgcgagatcgtcgagcacgtcgaagtgccgcatgccgggagcccgacgtggacgatccgttcgcctgccgcttcgcatgccgtcgcatagtcgcgtgcctgccggacgagttcgggcagctcggcatcgccgaccgcaacgaccgtcggtgcgccgggcccgacatggcgcaacgggctgtacgcgtcgacttcgcgcgcgctgagctgcagcttgtcgttcaggacgcacaacgagatcggttcgagatcgacgagcgggctgatcgcgagcgccgacacgacggccggatgcgcgcggtacacggccgtcaggtggccgcccgccgaatggccgctcaggtggatcggccgcccggcggtgccgattgcgtcggggtcgttcgccaggtagtcgagcagcgcgccgatctcgccgacgatgtcggtcatcgtcgcgaccggcgccagcgtgtattcggcgagtatcacgtcgaaaccgcgcgcgagcggcccgctcgccgcgtacgcgaaatcctctttcgcgcagtgctgccagtagccgccatgaatgaacacgaacagcggcgcatcgggccgaccgcacgacagccagtcgaatcgctgcgcgggctgcgcaccgtaacgcaggtcgcgccggccgcgcgtcgtgtcgtagagcgccgcgctgcgcgcatgcatcgacgccagcagcgcaggaaatcgggtaccaccttcgtgttcagataggcggcgtcgagtgccgcgcggtccatgccgcgatagaggatcgtcatcggaatcgtttgggtcgggttgcggaagcgcggacgcaggcgtcgcgtccggtgcgaaggcggcttctcagtcgccgaagcacgcattatccgcagcgcggcatgggccggctatccggaatcggcgagcgcggaaaccggctgtccgttttcggcggcagatcgacgcggcatgcgttcgcaccggtacgatccgggccgcatgcgcgatggcacgagatgcccgccggcgcgcccggcggtcggctcgagtcagatcagctcggagatctcgatcaggttcaggtcgggatcgcgcacgtagaccgaccggatcttccgcgtcgcgcccgtgcgttcgacgggcccttcgacgatcggccattcgacgcgcttcaggtgcgcgatcacgtcgtcgagcggcaccgacgcgatgaagcacaggtcgagcgcgccgggcaccggcacatgcgctttcggttcgaactccgcgccgcgcacgtgcaggttgatcttctggttgccgaagcggaacgcgatccggccggctccgaaggtttcgagctgcatctgcagcacctcggtgtagaaatgcgtcgtccggtcgggatcgacgcaggtcagcacgagatggtcgaggtggtcaatcagtgccatgaggttcgctccggttggtcgttcacgagaaagcgcgttgcgcgggcatgtcgccggcgtccgcgcgcggtggcggatgaaggtccgagcggcgcccggccttcaggatctggctcggcacgtcatggccgatcagcgcgggcagccgcgccgacgcggccagcacggccgcgagatcgacgcccgtatcgtagccgtcgagttcgagcatgtgcacgagttcctctgtgcacgcgttgccggtcgcgcccggcgcgtacgggcagccgccgaggccgccgagcgatgcgtcgaagcggtcgatcccggcgtcgagtgccgcgagcgtgttcgcgagcgccatcccgcgtgtgttgtggaagtgcagcgtgagctgcagcgcaccgaagcgctcgcgtgcacgtgtcgacagttcgcgcacttgcgacggatatgccatgcccgtcgtatcgcacagcgtgaagccgtgcacgccgagatccgcgaagcgctgcatccacgcgagcacgccctcggccgcgacgtccccttccatcgggcagcccatcgcggtcgacagcgagacgttgatggcgacacccgtgccgcgcaccgcgtcgatcacgtcgcgcagctgtgcgaacgattgctcgcgcgtcatccgcaggttcgcgcggttgtggctttcgctcgtcgacatcacgaggttcacttcgtcgacgccgcacgacagcgcgcgctcggcaccgcgcacgttcggcacgagcaccgtgtagacgacgcccggtgcgcgcgcgatgccgtgcatcacggcctcggcgtcgcgcagcgcggggatcgccctcggcgacgtgaacgacgtgacctcgatcttcgcgtagccgcaggcgctcagcgcgtcgacgagcgcgatcttgtcatcggtgtcgacgaatgccgcttcgttctggaaaccgtcgcgcgtcgcgacttcgtggatatagagccgtgtgcgttgcccgctcatgtcgtcgtctcctggttcgggttcagatcacgctgcgcgtgcgccagtcgccgcgtgtcgccgcatcgatgccgagcgcttcgagtaccgcgtcggtatccgcgcccagcgcgggcgccgggcgctcgatgcgcccgggcgtcgcaccgagcttcggcacgatgccgggcacgagcacgggcgtgccgtcgggcagcgcggcatcgacgagcatgtcgcgcgcgcggtaatgcggatcggcggcgatgtcggccacgtcgtagatgcgcccggacgggatgcgtgcgtcgttcaacgcggccagcacggcgtcgagatcgtgccgcgcgctccacgcgccgatcgccgcgtcgatgcgttcgacctgcgcgacgcgcccgtcgttgtgcgcgagcgcgggatcgttgccgagatcgggccggccgatcagctccatcaggcgccggaagatgctgtcgccgttcccggcgatcagtgcgtaccggccgtcgcggcagcgatacgcgttggtcggcgcgatgccgggcaggctgctgccggccgcctcgcgcacggcaccgaacgccgagtattcgggcagcaggctttccatcatgttgaataccgactcgtacagcgcgacatcgacgacctgccccttgccgccctgctgctcgcgatgccgcagcgcgagcagcacgccgatcacgccgtgcagcgccgacagcgaatcgccgagcgagatgccgacgcgcaccggcgtgcggcccggctcgccggtcaggtgccgcaggccgcccatcgcctcggcgatcacgccgaagccgggacggtcgcggtacgggcccgtctggccgaagcccgacacgcgcagcatcacgagccccgggttgatcgcggacagcgcgtcccagccgagcccccaggcttcgagcgtgccgggccggaagttctcgatcagcacgtcggtttccgcgacgaggcggcgcacgacgtcctgcccttcgggcgtgcgcaggtcgagcgtcagcgagcgcttgttgcgcgactgcgcggcccaccagaccgacgtgccgtcgtgcagcagccgccatttgcgcagcgggtcgccgagcgcgggcggctcgaccttgagcacgtccgcaccgaattcggcgagcatccggcccgcgaacgggccggcgatcagttgtccgagttccagcacgcggatgccgtcgagggacgtgtcatggctgtctccgatgaaatcgtgttgtcgatgacggcgatcatgacggcgttcccgcccggcgaaaatcgatcgatgctcaaccagcctttccgaaacggaaaggcgtgcgccgcggccgttcacatatgcggtgcgccagcctttccatccgggaaagtgcactcgcgcaacggtcaaacgacggcccgcgcgccgccggcagaatcgaacccgttccgcgcccgccccgggcgcctgccagcgaggcccgccatgttttccgtttcctctcccgcgaagatcgtgttcctcgaccgcgcgacgctgtcgccgcaaaccgtgctgaagccgttcccgtttccgcacgcgttgtgcacgttcgagcggacggccgtgcacgaggtcgcttcgcgcatcggcgacgcggacatcgtcgtgaccaacaaggtgcggctcgacgcggcggcgcttgccggcgcgcggcgcctgcggatgatcgcgatcgccgcgacgggcaccgacatcgtcgatctcgacgcgtgtgccgcgcacagcatcgtcgtgagcaacattcgcgggtatgcggccagcacggtgcccgagcacacgttcgcgctgatcttcgcgctgcgccgcagcctcgtcgcgtaccgcgacgcggtgcgtgcggggcgttggctcgacagcgggcagttctgcttcttcgatcatccgattcgcgacctggccggctcgacgctcgggatcgtcggcgacggcgtgctcgggcgcgcggtggccggcatcgcgcgcgcgctcgacatgcgggtacggttcgccgcgcacggcgatgcgtcggggacgactacgcgccgctcgacacactgctccgggacagcgacgtgatcacgctgcactgtccgctcacgcccgcgacgcggcacctgatcgacgcggccgcgttcgcgcggatggcgcgccggccgctgctgatcaataccgcgcgcggcgggctcgtggatgaaaacgcgctcgtcgacgcattgcagtcgcggcagatcgcgggcgcggggttcgacgtggtcacgcaggagccgctgccggccgcgcatccgttccacgcgatcctgtcgcatccggccttcatcctgacgccgcacgtcgcgtgggcgagcgacgaggcgatgcaggcgctcgccgatcagctcgtcgacaatgtcgccgcgttcgtcgagggcgctccgacgcatgtggtgtgatgcgcagccgcggggatcgtttcgacggccctacgagaaaagccccgctcgattgctcgaagcggggctttggattgggagttgcttacgccggcgacccggcacgtagcgggtttgtgcatccaccctgtcctgcagcgggtttatggatgcctgacgagcgctacgtcaaggaactcgggccgccgatgcggcagggccggcctggcgctggccgggccccgcactggaactcgccggctttggctgcggcgcaccacccggcgcgctggtcccgccccgaatgcgcgcgtttcagtaagcggacatctcgacgcaaggatcgaccttggacggcgagcagatgaccgaatacttggcgctctcgcgcatcagcgcttcgccttcgtgcagcgcgatcttgatctcggggtgacgctcgtacgcgaggaatgccgagcacacgaccgcggacatcacgacgaggaaaacacaaatttttcaagggtttggaaacgttcaggcatggttcgacctatcacttaggccgtgattatatctcgaaataagggttttccctataagccggcccgcataccgaggatgcattcggtcgcgcgcggacgcgatgctcgcgccctttgtccctgccagtccgcgcctgagtgtcggtcgaacaggatggggcgaccggttgcggggttcgcgccgtaccggcgctgccggtaaccgtgtccggccaccgggccggtcgcgggcgccgccccgccgctgcgccagccccggtgcatccgtcgatgcgctcgcgggcaatcggtcggtggcgtgaagtcggcggaaggcgcggcgcggcgttcgggcgcgacaggccgcgtattaccggaggaaaacgccccgcccgtcgccctcgcaggtcaccgcgtcaccgcgtcactgcgtcactgcggcgccgacgcgccgcttgccgcattgccgggccatgccttgccgatctggtcgaccagcgatttcgcggtgcccgtcacgatcgccgcgtcgacgccggacgtctgccacgagccgtcggcggccttcacgaaggtcaggttcgcgcgcgacggcttgtagtcggtattgcgccacgtgaccacgacgtcgcacgagtaggtgcgatcgccgaccttcttgcagtcgccgtcgggcttcgccgacacgacatcggccgagacgggcagcggctggccgaacagcgcgttcagcccgccgtggttttccgcctcgagcgcgcggcgcacggcggcatcgacgtcgcccgatccggggccgtcgtggagcaggttgcaggcggccaggagggtcgatgcaccggcgagtgtcagcagcgtctggaacttcatggatatccgttatcggggaacgccgcgtagtctgcaacgtccgcgtatcgtgcgcggtatccatttgtaaccaattgcacgggcgcgatcgcccctccgcttttccctcgcctgctgacgcgcctactgccgctcctgcttcacgcggctcacgagttgcgtcgggctcacgaactgcagcgcgatgaccacccatacgagcgtgatggccatgtagatcatcgccatcgcgtcgatcgactgcggcgcgcgcacgccggtcgagaacaccgcgtaatacagcgcgacgacgagcgtctgcgtgctcggccccgcggtgaagaaggtcagctcgaacatcccgatcgtgcgcaccagcacgagcagccccgccgcgagcatgccgggcacgagcagcggcagcagcacatggcggaaatagcgccacgtgttcgcgccgaagatgcgcgcggcggcttcgagattcggatcgatctgctcgatgaacggcgtcatcacgaggatcacgaacggcagcgccggcacgaggttcgcgaggatcacgccgggcagcgtgcccgcgagcccgaccttgtacatcacggtggccatcgggatcccgtacgtgacgggcggcaccatcagcggcagcaggaacaccagcagcgcgaagcgcttgccgcgaaactgcacgcgcgcgagcgcataggcggccggcacgccgagcgcgatcgacagcagcacgaccgcgccgacgacctcgacggtcacccacagcacgctcgcgagctggaagtccgcccacgccttcgcgtaccagtgcagcgtgaagccctgcggcagcggcgtgccgaaccagcgtgtcgcgaccgagttcaccgcgacggtcgcgatcagcagcatcacgttcagcaggaagaacgccatcagcccccagacgagcgcgtgccacgcacggccggcgagatggcccgccatcttccgcggtttcctcgcgtcggcgggccgcacgtcgggcgggtcgggtgcatcgtgcttcggcggccacgcgcgggcggcatgattgtcggtcgccatcagcccttgcccccgtcaccgcgccggtatagaagaagcggcgcgcgccgagcatcgacgcgaccaccagcagctgcacgaaacccatcacgatcgcgatcgccgacgcgagcgaatagtcgtagctctcgaacgccgcttccgccgccgcgatcgagatcacgcgcgtgggcccggccggcgcgccgagcagcacggccgacgggaacaccgagaacgcctgcacgaacgacaggcacgcggccatcgtgagccccggcacgagcagcggcaggtagatccgccggaactgctgccacgggttcgcgccgagcgtcgccgccgcgcgcgcgagtgtcgggtcgatgccgctgatgtacgagagcatcagcaggaacgcgaacggaaaacccgacacgatcagcgacagcagcacgccccagtagttgtgcgtgagacgcacttcgtcggtgtacaggtgcagcccctgcaacgcctgcgggaaccagccgttcggcccgaaatacgtgagcatcccgtcggcgacgagcaccgtgccgagcgtgacgggaatcacgagcagcgtcgtgacgaacttctggtacggcgaattgcggcgcagcgcgaacgcgacgggcaccgcgacgccgacgttgagcagcgtcgccggcaccgccagcttcagcgtgacgagcaccgtgggccacatcgcggtgtcggtgaagaactgcacgtagttcgcgagcgcgccgccgccgttcatcggctggaacgacagcacgagaccgtatgcgaacggatagatgaacagcgcgacgatgaacgcgagtgcgggtgtgacgagccaggctttcgcgtcgcgcggtgtgccgcctgccgggagcgtgctcacgcggcctcccggtggcgcgttgcggcgcacacgatgcggcggccgttcatcgcgcgtctcccgcatagacgagcgtgcgcgacggcgcaacacataatcgcaaatgctcgccttccgagaattcgcccgccacgcgcgcccagatcgggccgaacggcgtggccgcacggatcagcgaatcgcggccgccgtattcgaccgtttcgacggtcgcgtcgaacgcgttgccggcgccgtctgccgcgcgctcgatgtcgtcggggcgcagcgcgaccgcgacgtccttcgcgtcgaagccggccatcggcacgcccgtgagccgcacgcctgcggcgctgacgttgacgtggccgccggccatcccgtcgagcgtgaacggcagcacgttgcgatagcccatgaaacgcgcgacgtgcaggttgtgcgggcgcgtgtagacgtccttcggcgtcgcgacctgctgtacgacaccctccttcatcacgacgatgcggtcggccatcgacagcgcctcgtcctggtcgtgcgtcacgtagatcgtcgcgcgttcgagctgcgtgtggatgcggcggatctcggcgcgcatctcgatgcgcagcttcgtgtcgaggttcgacagcggttcgtccatcagcacgagcggcggctcgatgacgatcgcgcgtgcgatcgcgacgcgctgctgctgcccgcccgacaactgcccgggcagcttgccctcatgcccgacgagctgcacgagttcgagcgcctgctgcgcgcgccgccgcgtttcctgcttcggcacgccgcgcatcttgaggccgaaaccgacgttgtcgagcaccgacaggtgcggaaacagcgcgtagttctgaaacaccatcccgaagccgcggcgctcgggcggcagcacgtcgatgcgcgtgtcgtcgagccagatgccgccgctcgtgagcggctgcagccccgcgatgcagttcagcgcggtcgacttgccgcagcccgacgggccgagcagcgcgatgaactcgccgcgccggatctcgaggtcgagcccgttcagcgcggcgacctgcgcaccttccgcattggtgaagctgcggctgacgccatcgagccgcagccgttcgaaactgtgcttcattgcgcgaactccatcgacgcgggcgccgcggcgccgccggcccatgcgtcacttcgacttctgcgaaccgatctcgcgatcccacttctggaatgcggcgaccatcgcctgcgcgctgagcggctgcacgtgcgggcgatccgccagcagcttcgcgtattcggggcggccgaacttgcggatcacttcctggctgtgcgcgggcgccatctcgagcgtcacgcccttcaccgccgggcccggatagaagtaaccgtcgtcgtaggtcatcgcctgctgcgccggttcgagcagaaagttcatcagcttgaacagcacgtcgagcttgtccttcggcacgcccttcgggatcaccatgtagtgcgcatcgttgacccacgtcatgttgtcgaacgcctggacccggaactcggccggcacgatgccgagcgcacgcgggttgaggtcccagccggtgacggtcacggtcatgtcgcgcgtgccttcgccgagctccttcatcaccgccgacgtgccgcccgggtagtacgggacgcagtcgttgagctgcttcaggaacgcccaggtcttgtcccagccgttgatcgggtcctgcgggttcttgtcgccgagcacgtacggcagccccatcaggaacgtgcggccggggcccgagttcgccgggcgcgcgtagatcagcttgttcgggtgcgccttgcaccacgcgagcaactgatcgggtgttttcggcgggtcgccgaccttcgccgggttgtattcgagcagcgggccggccggcatgtaggtgacttcgaggccgaagccctgtgcgaggtcctgcatcttgcgcgggccgggtgcgtacctgtcgagcacgccgggaatgcgcccgcgttgtcgggcagcaccttcagccacaggttctgctcgatgccggcggccagcgcgtcggtgcccgtcagcacgaggtcgatgtcggcgcgccccgccgcctgcatcgccttgatcttgcccggcagctgcggcgccggcgcgttcgtgaacgtgacgctcgacacgagggtcgggttcttgtccctgaaggcttcgatggccttctgcgtgagttgcaggttgcccgcgacatcgacgatgttcagcgatacgggggcggcaacggctgccgaggccgacagcgtgaagcccacggcgagtgcgatccggcggacacggcgagcgatcgtggtggcgttcatgtctcctcacttcggtcggtggatgggacctttcttttcaggaaatcatgacggcgttatacgatgtcggtcaacaaaaaccgatcggcgcggggcgggactttcctgacaaacaccttccggtgagtgccaatttggttaccgggcaagatgggccggggatcgcggctggacgccaagtcgtcttgcgacgtcatatctctgcgggggcaatcccggcgaagtggtttcaacgggctcggactggaacggtgccgtcggcgttcggcaggtccggcatatcagcggttcttcagggcgatcaactcgtcccggtgtccggaaatgacttttcgcgccgcgcgcagcacgtcgcccttctcggcttcggtcgaagccttggcctcgctggtgggacggatgatcgtgcagggtttcaacatgactccgtacagcacctttcgtttgggatccacgacggcattccgcaaaaacgacagcgatcgtcaatcggatggagcggtcgcgtcgctgtcaatcatggcgtccgacgaacggacgaaaacggccgcaaggccggcaaacaatgcccgaatatcaattcctcaagcctgaatcgccttcgcccaacgccctcacctcttcgatcaaccgttccgcatcacgccactcgccatatcccgacgccggattcaggtgccccacttcgccgagatcgacgagcctgctgccccaccctgccgccagcgtttcgacacgctcgaagcgcgcgagcggatcgttgcggctcgcggcgacgatgctcggaaacggcagccgcccggtcggtaccggcgtccagccgttcgcgtcgattgcgtcgggcgccggataaccggcgggcatcggcgtatcgagatcggccggcgccgcgagcagcgcgccgtggatttcgcgcgtggcctgccgcgcccagtgcacggcaatcatcacccccgcgctgtgcgcgacgaggatcacggggccgtcgatcgcggccagcgccgcatcgagcgccgcgacgcgggcggcgcggctcagcttgtcggcttcgagcggcgcgacggcgcgtgcgttcggcaggcgtcgttcgaggtgcgtctgccagtggtcttcgacgtgatcgcgcaagccgggcacgatcaggatggtgggtgcggtcgtcagggtcatgcagcctccgaagcgttcaggaaagtctggacgcgcgccgttcgcgttcgacgcgcgcgaggtcggccacatagctcgcgcgtccgatcgcgaacagcacggcggccatgagcggcacgacgggaatccattggagtgcgccgacgaggccggcgcgatcggcggcccacccgtcagcagcgggcccggcgccatgccgagcaggttgttggcgagcgtgagcgtcgcgaacgccgatgcgtggatcgcggccggcgtcaggttcgcgaccatcgcgcccgacgcaccggacgcgcccgcgccgaccagcattcccgcgcagatcagcgcgagctgcagcggcccgggcggcagccggaacgcgaccgcgaggcaaacgccggtcagcacgcaatacgcgatcgcggtcagccacttgcgcttgccgtcggttttgccgacgcggtcggtgacgatcccgcagccgaccatcccgatacccgcgagcagcacgaaaccggcggcgagcacggccgcgcggtcgggcgccatcgcgtagtagcggttcaggtagctcggcagccatgcgaacagtgcgcccggcacgaacaggtgcagcccgctgccgagatatgcgcagatcaccgaacgcgacgcgaacagccccgacatcagcacgcgcacgctgccgcgcaggtcgcgcggcgtgtcggtgtcgcgccggcagggttcggcgccgtattcagtgccgcattcggtgccgtattcagagcgatatgcggcgagccgccgttcggtcacgacgcagcgatacgcgacgagcagcacgataccgagcgcggccatcacgccgaacgaccagcgccagccgagatgcgcgccgacgagcccgccgagcgccatgccgaacacggagccgaacgcgccgccggccatgaacgcgccggtcagcgtcgcgcgcagccgcgccgggaaaatgctgaggatcagcgcgacgccgacgctgccatatgcggcttcaccgagcccgacgaggccgcgcgcgacgagcatctccgtgtaatgggtcgacagcgcgcagccgagcgtcgcgacgctccacagcgcggccatcagcacgatgctgcgcacacgcccgaagcggtcggcgagcaccgacagcggaaacgtcagcagcccgaccagcagcgcgacgacgccggagagcgaaccgagctgcgtgtccgacagcgcccatgcttgcttgagcagcgggaacacggcgttgagcacctgccgcgacatgtagtccgacagcagcaggccgacggtcagcccgaacacgagccacgcataggcaggcgcgcgccggccggcggcggcgacgtcctggagcgacggctcgacatgatggatcagcatgcgtgtctcctccggcaccggagcgatcgtgctccggcgcggcttgcgtggccccgctccgttgaccggagtccgcccccgcatcacgcgcggggatgggtgccacgccacaacgatcggcgggccgcggccgccatggccgcgggcccggatgcgcggatgcgcggcgcgtcaggcggcccgcagcggcacgttcggctggcccggccggcggttcggcgccatcccgagctgagcgagggtctcgtcgatgccgtcgtactgcacgccgatccggtagatcgccttcgcctccttgccggtcgcgatgtcgcggccgagttcgcgcgcgatccgtgcgcactgctcgacctgctgcaccgacgtcatccggttgcccttctggtcgatgatcgtgtcctcgatcccgcagcgcggatgcaggcccagcgccatcgcaaccgtgttgatcggcagcacgttcttcatcagggattcgagcgtgatgcacgcgccgtccgggcagcgccgcacgaattccatgaagttgtacggattcgggccgtcgaagccgccgccgatgccgacccacgtgacgttcagcgggccgcgatagacgccgcggcggatgatccgttcgagcgtttccagcgcatgcatgccggtgagctggaaatgcggctggatcccggctgcctgcaggcggcgcaggtgctcgtcgacccagccggggccggccggcacggtcatctcgcggtacgcgtcccacaacgcggcttcgttcagcgacgtgccggcgatgtccttgcggttcatcagctcggtgatgttcatctgcacggtgttgatcgcgaccgtcacctggtcgggcttcggcgtcagctcggcgagcatgtggcgcgtgtcgtcggacagccatttcgcttccgcgccgtcgccttccggcgcgaacgagatcgagccgcccacctgcaggatcatgtcgggcaccgcctcgcgcagccggccgagcagctcgttgaacttcgacagccgcttgctgcccttgccgtcgagttcgcgcacatgcaggtgcagcaccgtcgcgcccgcgttgtagcagtcgacggccttctgcacgtgctcgtccatcgtcaccggaatgtcttccggaaaatcggcgggcatccattcggggccgtacggtgcgaccgtgatgactaccttgtcctggttttccgggtgcagcgaatcgtcgagaaattgcatgtcgtcctccagtggaaatcgttttggtgcaggcgtacgggcgtgcgtatcccgccgtgccgggcggcgggcccggcgcgttgtttggggtggcgaatcggttaaggtgcgagcgcgctcagaacggcacgtcgccgacgatgcccgcgcgctccatccggcgcacgcacggcgggtagtccatgaccgcgtaatgctgcgtgctgcggttgtcccagatcgcgacgctgttcttcttccagcgccagcgcacctggtattcggggatgtatgcctggctgatcaggtattgcagcagctggccggcgccgggattcgcgtcctgcccgacccgcacgcgcgcgggcgtgtggtagttcgtgaaatgcgtggtgaacgcgttcacgtacagcaccttctcgccggtttcggggtgcgtgcgcacgaccggatgctcggcgtccgggtactgcgccttcagcgcgaggcgcttgtcgatcggcatcgccgcaccgaagctcgcctcgatgctgtggcgcgcgcgcaagtcgtcgatctgctgcttcacgtggtccggcaggcgctcgtaggcgagcaccatgttcgcccacatcgtgtcgccgccaaccggcggaccgtcgatgcagcgcagcacgcagccgaacggcggcgccacgcgccagctcgcatcgctgtgccacgcattctcgtagcggtcgttcggctggtcgggcgacttgtagatccgcacgagccccgggtgttccgggtcgctgccggcgaccggatgatcctcgagctcgccgaagcgccgcgcgaacgcgacgtgctcggcgcgcgtgatgtcctggtcacgcaggaacagcacgcgatgccgcagcagctgcgcgcggatctcggcgaacaggccgtcgtcgtgcacggcgtcggcgaggctcacgtccagcagttccgcgccgagcgcacaggtcaagggttcgactcgcatgcgcgcctcctcagacgatgaacaccgacgaaccggtcgtcttgcgcgattcgagatcgcggtgtgcctgcgcggcatcctgcagcgcgtagcgctggttgatttcgatcctgatgcggccggccgcgacgtgcgcgaacagttcgccggccaggtcgttcttctcggccggatcggcgatgtagtcggccagcgccgggcgcgtcaggtacagcgagcccttcatcgcgaggcgctgcggatcgaacggcgggatcgggcccgacgcggtgccgacgcacaccatcagcccgcgccgcttcagcgaatcgagcgagccttcgaaggtgtccttgccgacgctgtcgaacacgacgtcgacgcccgcgccgtccgtcagttcgcgcacgcgtttcgcgacgtcctcgcggctgtagtcgatcgtatggtcgcagccgtgcgcgcgggcgatcgcggccttgtgctcgctcgaaaccgtgccgatcaccgtgagcccgagcagcttcgcccattgcgacacgatcagcccgacgccgccggcggccgcgtgcagcaggatcgtgtcgcccggcgcgaacgcgtggatacggcgcagcaggtaggccgacgtcaggccgcgcatcgtcatcgccgcggccgtttcgcacgaaatgccggccggcagccgcacgagcggcgcggcggggatcagccgctcggtgctgtacgcgccgagcgtgttcaggaagcccgtgtaggtcacgcggtcgccgacggcgacgttcgtcacgcccgggccgacggcatcgaccacgccggccgcctcgacgccgatcccggccggcagcggcaccggatacaggccgctgcggaaatacgtgtcggcgaaattcagcccgacggcctcgtgccgcaggcgcacctggccggcgcccgggtcgccgacgtcgaccgcttcccagcgcagcacgtcggggccgccggtttcgtggaatcgcactgcatgtgccatcgtgttctccgtatgttgtcagtcggatgcgcgccgcgcatcgtcgggttcgttcatgtccggcggcgtcgcggctgcgccgtccgccggcggttcatccagtccggcccagtccgcgtcgcccaggtagcgtcgcgcggccgggaaaatcacgccttccatccgccccatctgctcgaacgcgccgtgtgcataacgggcgagcgccgcgtcgaacgcggccgacggcagcccgtccgcggcgatccgctcgagcgcatcgagcgcttgcgcatcgcgctgccgctggcggtcgagttcgtccagttcggccgcgacgcactccgcgcgcacgcgcaatgccgcgaagaggtgcgcttcagcggccgtgccgacacgggcgcgctgcagcgcggcgagcgatgccagcgcacgctgtgcgtcggccgcgtgccgctgcggtacgtccgcgtttgcggcggacgccatcaggccatattgcgcgtcgctcgcttgccgctgctgctgtgcatccacgtccgcgtccacgccggacgccatcagcgcatgcagcaacccgccgaccgcgcgatgcgcatcgaggcaacgcgccatcacgcgcgcctcggcgggcgttcgccgcgacgtgcacacgagcaccggtacaccgctcgtcgcgagcaggtgctgccgctgcgcgcaggctgccgcatcggcatcgtgcggcagcgccgcgacgccgatcaggtcgcagccgagttcggccgccagcgcgccgggtgccgcatcgccggccccggaaggccggccccggatggccggcccccgcgatcgcatgggacaacccctgcgcccgcgcggcggcttccactttcgcaccgtgttccggcagccgcgctccagataaacgcgaggccggcgcggcgccggccagcaggaacgtgacccgggcgccgaccgcgcgcgccagttcgagcgcatggccgatcgcgtcgatgccgccgggcgcgccgtcgaccgtcacgagcagatggcggtacatcgtgccgctccgtttatccggcgagcgacgcgttgcgccgcgtgccgctcgatacgatgttcatggccctctcctcgttgcgttcgtcatggatcggaacccatgctatcgacgcggtgccggtacggccccactcgtcgcgggggattgacgcgcgaacgcgcttcagccgatccttccccacacccaccccggacgctggcccgcacggcaccgccggattccgactgctgcccgatggcccacccacccgctcgcgccgacgcgcctcccaccgaactggtcctgaagacgaccgcgccgcgcgtgccggcgcagttgctggcccgcgcgcggctgagcctcgcgtcgcccgctttcgacggccggccggtcacgctcgtgcaggcgccggccggttacggcaagacgtcgctgctcgcgcaatggcgccgcgagaccctcgcgctcggccgcgcggtcgtgtggctgtcggccgacgagcgcgacgatgcgccccggttgctgcaggggctcgtgcaggcggtgcggaccggttgcgcacggcccggcttcgggcgcctgatcccgtccggcgcggccgacgcggcgcgtgcgctcgagggcgtgaccgcctggctggccgaggtcgcgcaactgtcgatcgacgcgctcctgatcgtcgacgatgcggagcggttgccgccggccggcctcgaggcgctgacctacgtgctgcacaatgcgccgcaaaacctgcatgtcgtcgtcgccgcgcggcgcgggctcgaccacacggccggcgacctgctcgccggcggccaatgcacgctcgcgggccccgactggctgcgcttcacgctcgacgagacgatcgcgctggtcggcgcgcgctttgcgcagcgggtcgacgccgatgcgtgcgcgcggctgttcgaacgcgtcgacggctggccgctcggcctgcagctcgcgatggccgcgatggcgcgctcggccgatccgcgccaggcggtcgacgcgctcgccgcccgcgtggacggcacgcgcgaccgcctcgtcgagctgctgctcgcgaacctgtcggccgacgacacggcgttcctgatccgcacgagcgtcgccgatcgcctgcatccgtcgctgtgcgccgcgctgctcgacgacgcggacgcgccgggccgtctcgcgcggctcgcccgcgacacgccgctgttcatcgcgtcggacgattcggactggtgccggctgcatccgctcgtgcgcgacacgctgcgcgaccgcctcgccgcgggccccgacgccgagcgcagcgcgctgcatgcgcgtgcggccgcctggctcgacgcgcacgggatgaccgaggaagccgcgcgccacgcgtatgcggccggccagttcgaggtggcgtatgcgctcgcgcagcgctgcctcgaggatgcgatcaagcagggccgcatcaacgacgtgctcgactggctcgcgctgctgcccgacgcggagctcgacaagcgcccgacgctgcgcatcgcggtcgcgtgggcactggcgctcggcgagcgccacgtcgaggcgcagcgccagatcgcgggcatcctcgccgacaccggcacgcccgcggcgatgcgctacgaatgcgcgctgatcctcagcgcggccgcgtattacgccgacgaaatcgaccgtttcgtcgagctgttcgaaccgtgggccgacttcacgccgccggcggcgacctggctcgcgcaaatgcacgcgaaccggctgtcggcgcgcgcgatcatcgtcggcgaaccggcgcaggcgcgccgtttccagcacgcggcaccgcgcggcgagacggcggccgggttcggctacgtcgcgcgctggggcgagctgatcacgggcctgagctacctgcgcgaaggccaggtccggctggccgacgacacgctgtcgccggcgctggcacgcgcggaagccgatctcgggcgccgccatccgctgacctgcatgcttgcggcgatgtgcgcggcgctcgcgtacgaggccgaccgcgtcgaccaggccgccgcgttgctcgcgaaccggctcgacgtgctcgaacatgcgggcacgcccgataccgtgctgctcggctatcgcaccgccgcgcgcatcgcgctgctgcgcggcgtcgagcaccgcgcgatcgacctgctcgaagcgctcgacgcgatgggcgtcgcgcgccgcctgccgcgcctgtcggtcgcgagcctcgccgaacaggtgcgcattcacgcggcgcgttatcgcgaggcgacctgccatgcgctcgtcgagcggatcgatgcgatcgcggccgccgagtttccgtcgcacgggccgttgtggcggcgcccggtcgtgctgctgcaggcgagcgcgcatgcgggtgcggcgctggctgcgcgccgctgggacgacgcgcgcgcggcgctcgacgaagcggcggtgctggcccgtgaaatgagcatgggccaggcgcgcatcgagatcatggcgctcggcgcgttcgcgcgcgaacagtccggggacggcggccgcgcgctgctcgacgaggcgatgaacctcgcggagctgttcgggctcacgcgcacgctcgccgacgcgcatccggccatcgccgactgggcgcgccgcgccggcgacgaagcggccaccggcgccggccccgcgcggcacgcgctgccgccgccgcgcatcgtgccgcccgccccgcgcggcgcggccagcccgcgcgcggtgccgagcgtcgtgctgacgccgaaggagcgcgcgattctcgagctgctcgcgcgcaacctgtcgaacaaggagatcgcggtggcgctcgccgtcggcgaggaaaccgtgaagtggcacctgaagaacctgttcggcaagctcgacgccagctcgcgcaagcatgcggtgcgccgcgcgctggtgctcggcctgctcgaaagcgcgccgtaacgccggtttcgccgatcgggcggcgaaaccgcccccacctcccgcgattctccgcaaccctgcccccgcgcatgggggagcggccgcccgccgttgcgtagtctttccgcatggctcgcgcgggcgcccctgtcacgtcttcccgcccgcctcgttgcttccccgcttcacccggacgggctcgatcccctctggtccaatacgatcctggagacttcatgaagacgaaactggccgcgctcgcggcgcttgccggctgttcggcgctcgcgcacgcgcaatcctccgtcacgctctacggcgtgatcgacacgggcctgctgtaccagagcacgtcggcggcgtcgttcagccccaccgcgccgaatacgggcaaggtgttccgcatgaaggacggcggcatctactcgagcttctggggcatcaagggcagcgaggacatcggcggcggctacaaggtcaacttcaagctgcagggttcgttcgacagcggcaccggcaagctgcagctgagcgatacgccgggcgccgtcgcgatcttcaaccaggtcgcgtcgctcggcgtgtcgggcccgttcggcaccttcacggccggccgccagatcgtgccgatgatctacgcgatggccgacaccgacgtgcgcaacgcgcagttcttcggcagcgtgctgaccgcgtggctcggcctgaacacggcggccggctggcccgggacgagcaccaacggcgcgatcggcgcgctgtacgacagcaatgcgctcgtctatcagtcgccggtgttcgcaggcgcgtcgatcgcgctcgaatacgcgccgggcggcgtggccgggcagttccagggcggcacgcgcgaatcggtcgtgctcaagtatgcgaactacgggctgaacgcgtcggccgtctactacaacgggcacgacacgaacccggcgccgggcgtcgcgccgaccggcgtcgacaacaaccgcttcgtctacgtcggcgcgaaatacacgatccgcgacttctcggtgtcggcgtcgtacggcaacggccggaatccgtcgcatgcggacaaggtgaacctcgacatgctgtcggccggcatcggctatcgcttcacgcctttccttcaggtgagctcggccgtgtattacctgaaggatcgcaacgtctcggcgaacaagtcgatgtcggtcgtgctcgcggccgactacagcctgtcgaagcgcacgacggtctatgcgcaggtcggccacgtgaacaaccgcggcacgatggaccagatgctcgtgtacgggcagccggtcgcgccgggcgtcggcacgacggccgcgatggtcgggctgcggcacaattttgatgcctgcggggcgtgtggcggctgtttcgtgacaataaagttcggggtatttcccaattaagtggacctatccgtcattttgtaggcgaggcatatcatgaggtgcaaaggcgatggatatgctgatgaaaaagaaaagacgaacgtagcgtctcaggcagcggcccgcgtgccgctgcctgaactgcccaagaaactgctcgaatggttgatcaaagcgccaatgtcgtcagccgaggttcaggatctgatgcaggagttcgacgaggccgtcatcgaacgcgcgatgggcgccgagatgaatatgcatctgggttacccgccgagttcattcgaaactttgtgtgcgaggcataaactggcgaccaaggtgccacttttatgcctcgcaaacgcaaggaagaagtgacgattgaaccgggcaatggcttgaacctgcgacgaccggttgaattcgccttgaacaggctgccaagatggtcgagcaggtggtgcatatctacctgcaaccatgagcagccatatatcgccctgaaatacaaaacgcccgatgcgatgcatcgggcgttctattgcttggatactgtcaatctattccagagctttaaaatttttcagtaattcggccctgcagttactatgaaattttaagttgaagaagaaagtaaatctctagccgacttagtaataaggccttcccgaaaccttccggcacaatatgcattagcaatcgcttgctcactagaaaattgcttcaactcttctccaacttcgcttgccagtagactgaggaaaacttcatattttctcgactgctccatatcattaagcgcccccgcccagacaatcaactcgcgatgctgtgcaaacaaacgatcaagccgaaagtacatgtgtgactgttcgatacgggttatttcgccgattccgatgcggtcaaggcagaatcccacattaacaaaccactgttgacaaaaaccattttccactccgaccgcaatttgtgctccatttccagaaaagcacattaaattacctcgccggaggaagccgcgctccattagagacgcaaatataccttgcttgaattcgtttgacttcatcgcttatcctcagaatcaggtgtcggattacgcaatcgctcgaaaactctccgcggtttcctgcgatgaaccaattttgcgggtcacctcgtcaacgttcccagcttcgctggcatttccaaaatttattgtgccggagctggtgccgtcgcgcgcggccgccgccagcatcgatcgccgggatcggctacagtgggcgttttcggcgcgcgccgtcccgccgccgcgccaccgtccgtggcgcgcggcagcaagtacggtgcgcaagtcattcacttcgacgagcgaaccttcatgcccgatctgtccgccttcccgatcacgcaaaagtggccggcccagcatcccgaccgtctccagctctactcgctgccgacgccgaacggcgtcaaggtgtcgatcatgctcgaggaaaccggcctgccgtacgagccgcacctcgtgcgcttcgacacgaacgaccagttctcgcccgcgttcctgtcgctgaacccgaacaacaagatcccggcgatcatcgacccggacggccccgacggcaagccgctgccgctgttcgaatcgggcgcgatcctgatctatctcgcggacaagacgggccaactgatcccgaaggatctcgcgggccgctacgagacgatccagtgggtgatgttccagatgggcggcatcgggccgatgttcggccaggtcggcttcttccacaagttcgccggccgtgactacgaggacaagcgcccgcgcgaccgctacgtcgacgagtcgaagcgcctgctcggcgtgctcgacgcgcatctcgcgaaccgccagtgggtgatgggcgatacctacacgatcgccgacatcgcgatcttcccgtgggtgcgaaatcttgttggtttctatgaagcgggcgatctggtcggcttcagcgaattccgcaacgtcaagcgggtgctcgatgcgtttgttgcgcgtccggccgttgcgcgtgggctcaatattccggcgcggggctgagcggctgggcgggtcgcgcgttgtgcggcccgcgcggctgcagacttgaagcgcccgccgtgttgggcagcgggctttcggggtattgcgattttccggggaatgctggggagacggtcggtgttcggccagaagctgtcggtcgacgtgggcgcctacacggatgacaatcgatcagactcaccttgcacgcgacgtcccctaccaagttgaacaagatccgagatgaaatcgccctcaatagtcaagccacttgaacaccccttgacggctttcgcttcgaacatcgattccgcgcgcgacgtcgctgtcgctggactacgatggccaactccatattggtgtgacctcgcgatcggttggttggagcaaggcctggccgttgacgacgagatagccggcatactgcaagaaatttcccagaaccgccgctttccgcagaggctacggcatcgcgcgtttgtgcaacacgtacgattcacgaggacaaggcaagctggatagtcggtagatccgcagtgggccgagtttttgggggaagcgcggaagccctgctccgcgctggctgcaacgtaatgtctacgtcgacagtcggccagaggcagccgctcagtaggtgaaggaatacaattttctttgcgctcaagggagccaaccaacgatgcatagaatggaagcttctcatttctatcttggccggataactgacgcctcccgattttcaagctttctcgcagaacactacggcgaggatgaaagtcgaccagtttccgagttctacggctcccagggtgagttcttctgtgaccatgacttcatggaaacagggctgcgacagtcgggtacttcactggaagagttctttgcacctcactcgtactcggacaaatggtcggaagcgctatgtgaagcggcgcgcgccgcaaatttgggagatgcgaacgcactgattttcatcaattgcgaacagataaaatcgccaaggtcagtgcaagacgaaggattcgaactggtctacgtcggaatgttcgagtatccaatttgagcttctcgaacttggtttcgcctgatgcgacgcctactgctgggcgaccgctttcggccatgacgagccattcgacggcgacgcgcatttcgtcgacaatcctcggaaacgatgccgagattgacaagtcgacaaccaagtttcgagcgtcgttccatggcttcgataccgacgcgaaccaacgcaacggaacgataaccatggacgacaacagccgctttatgcatcaggcttgcgagtgtcgcgtggacgcctcttcatggcgcaacggtaccggaagagatgcggcccgaccatgcccaaaagaccagtcttccacactggttgtactgatgatcaccatgacatcctcgggaggaatgccagggctgacagcgagcagttcgacgagtctcgcgtagaacgcctccttacaggaccggctgcgggtgcgaccaccggtgatgtgaatcaggacgaaatcgctgctacgcggcccaccgcagtattcccggtcatataccagttcacccggctggcactgctgaaagacctgaaaacaatccccgccggaacctcgaacgtttgctcaagcgcatcctgcaggctcgttgaaatcgccgtcaaccagtcggcggattttccggcaagtaaggcaattcgtgagtatggcatctggaatctctccgttactcggacagcgcggccagtgcattgaccgcagatgctgcggcgggccagccggcgtagaacgcgaggtgcgtgaacaactcacccaactcgtcctttgtgactccgttggtgatcgctttctgcaggtgccccggcaattgctcgggacgatagagggccgtcaaggccgcgacggttgcgatgctgcgctcccgcggaaagcgccgggcgctgccagacatcgccgaagagaacgtcttcactcagctgagcaagcttcggggcgaattgagcgactttttgcaaatcagatgagggtttggtcacgtgtgctcctgttgtcgggattgacggcgttcaggttagcaagtcacagcggccccgaatatgtgaataatttgaatcgatgatcctgtttttcgaaccttcgtcacgactacaggtgaaacgatgctgcgccagtcgctgaacctgcccgatgaggccgagcgcatcgagacggcggtcaggcgggtgctcgcgcaagggctgcgcatggccgacatctggaaagccggcacgcgcaaagtcggaaccaaagagatgagcaacgcggtcgcggcggccttcacgacgcaagaggcagtttcgtaaaggctgctgtgcctgccttcaggtgttcggctcgatcgtgctgcagcacgtttgacgggtactggatgagtgtccgttgttgcgaatcctgcgcgtctcttgtgggtcgatctgcgccggtcatgcgtcaccgagcggcggccggccgcgctcggccagaagcagccatccgcagcattcattcggcgcactccgaatgtttcacccagaaaaatgatacttttatatccatgaatcatctttcattgggtggaagattaagtggatagactggaagcaatgtcgatcgtgctgctcacgatcgaaaaaggtagcctcactgcggccgcgaaggctttgaacatgccgctcccgaccgtcagccggaaggtcacggaactcgaagagtacctaggcacgaaattgctgcatcgttcaacgcgcaagctgaccttgaccgatgccggccaggcttacgtcgagtccgccaaacgcatcttggaagagatcgaggaaatcgaacgagctgcggccggcgagtacaccactccacgcggagagctggttctcaccgcgccggtgctgtttggccatatgtacatcctgcccattgtcacggacttcctggctgcctatcccgagatcaacgtccggttggttctctccgatcggaaccttcatctctatgatgaccacgttgacatggccgttcgcatcggcaccttgccggacagcaacatgattgcaacccgtgttggtgctatggatacactggtgtgcgcttcgccggacctgctagctgcgcacggcaaacccaaacacccgactgacctggaaaagcttccgtgcgttgtcttcactggcccttccaccgcaacatggtggtttcgggatccggcaaccaaacgtgatttcaatgtcaacatccttccgcgcctgtccgtcaccaccgctgaggctgccgtacaggcagcgctccgtcgcaccggtttgacgagggtgtaccgctaccactgcgatgccgcgctccgcaccggggagcttgtccacgtccttccgaagttcgatgtcgagtcggttcctgtcagtctcatccacggagagcgcgggctgttgccgctcaagatgagggtcttcctcgacttcgcaaccgaccggttgcgctcggcgatgtcggagctgggtaaagcctgacgggcgttcgctctaccgaatgcgcccctttcccattcctcgatactttcgttgaatggaaggtcggttctcgaaaatagccaattattgttttgggcggaagtccctactatctctcctaccgaagccgcagtggctcggatcaacggagaaatctcatggcccgccttgcaatcccctcgaaagaagctgctcccgccaaagcgcaaccgatcctcgcgaactacgaaaaagttctcggcgtgatcccgaacttcttcgccctgatctcgcaatccccgatgcactgaaggcgatcgccgacatgcacggcgcgctcggcaggagtctcggtcacaagacccgggaacgcatccacgtgatgaccgccgaagtgaacggctgcaactactgcctgtcggcgcacacctatctcggcgccaagctgcaggggctgacgccggaagacatggagctcaaccgcgacggtcattcgaccgatcccaaggccgacgccgcgctgcagttcgcctacaagatcgccacgtcgcgcggtcacatcgaagacgcggatgtcgaagccgtgcgtgctgcgggttacaccgacgagcagatcgttgacatcgtcgccgagacggcgttcagcttcatcaccaacctcttcaacaacacgttcaagaccgacatcgacgcgacgttcccgccgcttcagacccgggcccgtgaggccgcctgaagcccgggcggactgggcgccgtatgacgcgtccggctgcctggtctcgatggctggttgctccgttctgaccatgcgcaattctccatgcgcgcgtggtcggtcggaacacgtctattgaagcaatcacgttggattgtcgcgcctgacgggcgcggcgattcgtgaaggaaccgtcgatgtcccgtttgcacatctctacgcgagacgatgctccagtcgagagtaagccgatactggacgttgtctatcggaagctgggcgtcgtgccgaatttctaccgtctcatcggcagcagcccggtcgcattggcagcatttgcggcttttcaggacggcctgtccaccacgctcgattccaggaaccgtgagcgcattgcgttggcggttgcgcaagtcaatggatcggactactgcctgtccgcgcatcgttttctcgccaccaacttcgcaaagctatccccggacgaaattgaacttaaccgcagcggtggatcgaaggatccgaaggccgaagcggtcgtgaaattcgctgcgagcgtagccagacagcgcggtcatatcgactttcccgttgtggccgacccggcacatcgaccgcatgcggcagaggtccgatgaatcatggaccatccgcgcttcgtagatccgcgtatagcgaagggacgagcaagatccatttcagacgcgacgtctcagttcacgtttctcagggtatttgatggcgcgataaagcgggtatcaaagcaatggcgacccgggatgagcggcaggaaggcattccgctacatggaacgtgtgctgaagccagaactcgacaagcacctggtcacgtttccgctgatacgccttggcgaaatgaccctgtactgcggattgttcgagcaacgtggcgccactggcgggctggatttcttcttccttgtctgttcgtcagttgctcggccggaagacggtttgatgtaccggatcgaggttagccagcatgcgatgcaacggatcattcagcggacgggcctaactggcgaggacgaggttcgcacacgcctctacaccgccatggcgaatatttattggttgcagccgtggatctaccgggagaaatggttgcagttgggcctcgcgtgcgaagaaggcgtatttgtgggtgaagtgcgagacgactgctacagcatcaagacgttcatcccggcgatcgacaacggcaggccgtcgcgatggcgcgatttacatgccgacctgtggccccggatccagcaacgcgttccccgcgacaagacgtacgaagcggatcaaagctcgatcggcgactggtatttttcgcggatgggctgacgcggcgtcatccctttctgctgaagccttatgtaccgggacacgattatctagatgcggcatgggcgagtcgcccggttgactctggaaatatttgaagggtagccggagcgtcacatgccgcgcgcggcaacggacagttcagtgcgtgagattcgcctgccgataccccatgtagcctccggaatcaccagacgccatcagaaggtggcgatgagacttactccggagcgtgatccttgccgtccttcgaaagttcgagcaacgcggccatggcccgcttatacggcccgagatcgctgtttgccgcctgcaggatgagcgccccttgcaggcgagcaacccagtcctccgcgaaatgccgcgcccgtgccggcgacatgccgctttcacgcgccaaagcttcgatggcgtcgatccagtgcgaaaacgccagcaacaaaccctgtttcgcaaccgagccgatattggccgtggcgagttgaccgagcacgcaggggcgcgcccaccgacgtacatctggtccagcgtggccacgattttgcgaatgcgggcctttagcgtgccggacgatcgcgccgcgttcaggatttcgctgtcgattatcgctgtcgcgcgctccaacacggcctcggccatctgctcctttccgtcggggaagtggtgatagaggctcgacttgccgagaccggttgcgcgcgacagatcggtgatcgacgcaccctcgaagccgcgatcccggaacaccgtgaacagccggtcaatgatttcgtccttcgatgcctgagcagtggccatagatcttttcgcttccccaaaagtactgatcgttcggtacaagcggaagggtaagttgcctcgctcgttaaatcaacccttgacgtccgtaatttccggacgtactgtaccgatcgttcggtacagataattcaggccgacgcctctttccgtgattcaggagattttcgatgtccacactcgtgacgtatcaaaccacctccgtcgccgatcgtcgtaccggctcggccctcaatctgttctaccgggaagccggccagaaggacgcgcccgcggtgctgctgctgcacggtttcccgacttcgagccaccagtatcgcgggctgatcgagcgtctcgccgacaagtaccgggtgatcgcgccggacctgcccggtttcggcttctccgacgccccggaagcgaagacgttcggctacaccttcgaccatctcgcggaagtgatcgagagctttaccgacacgctcggcctgacgcgctatgcgctgtacgttttcgattacggcgcgccggtgggcttccgcctggctgcgtcgcgcccggatcgcgtgtccgcactcgtctcgcagaatggcaacgcgtacgaggaaggcctgagcgacggctggaatccgatgcgtgcttactggcaggacccgtccgatgcgaaccgtgagcaactgcgcggtttcctgacggccggcaccacgcagttccagtaccagcatggcgaggcggatacgtcgcatattgcgccggagagctacacgctcgaccagcacttcctcgaccgcgcgggtaacgacgatatccagctcgacctgttcggcgactacaaggcgaacgtcgcagcctatccgcgcttccacgaatacttccgcacgcatcgtccgccgacgctggctgtgtggggcaagaacgatccgttttcctgcctgcgggagccgaggcattcaagcgtgatatccccgatgccgaggtgcatttcgtcgatggcggtcatttcccgctcgaatcgcatctggacgaagtggccggcatcattcgcgcgttcttcgcacgcacgctggacgttgcacaaggtcaggcgctgtttggcgcactggacgacgtgtctgcgtcggcggaggcgcagccgctgttcgatgcgatgcgcggcgcattcggtttcgtgccgaatctcggccacgcgcttgcggtcgaaccgccggtgctatcggcttacctgcagtggcttcattctctcggtaccacgaccctcgatgcggtggcgcagcaggtcgcaatggcggccgcgagccgcgtgaatgccgcggactatggcgtggccgtccacgcgacgctggccggcaggctcggtgcccccgccgacgtggtcgacgcgttgcgtaccggcagcgcgcttgccgatccgaagctcgaagcggtgcgccagttcgcgacagccatcgcatcgaagcgcacgcaggtgtcggatagcgacgtgaacgcgctgaaggcggcaggcttcgaccgccgcgcggcggtggcgattgcgatggccgtggccggcaagacgctcgtcaacacggtcgcgcacctgtcgaagatcgagatcgatgcaggtttccttccggacgccgttgcctgacctgctgcgccggggcggcagtcaatggccgccccgcaagcagccttgaggatcgagagcatgtcgggtaatcagttcaatcaagaagtgagcaacgttcgtgcgccgctggaaataccggccggaagcggtcggcgcaacaatccgttgtcgcttgccgtggggctcgtttgcctggtgctgattggtgtgaatctgcggccgggcatcgttcgatcgggccattgctgccgtcgatcagccaggctttcggcctgtcgcatacggaggcatcgatgctgacgtcgatccccgatgtcctcatggggctactggcattgccgacgccgtggctcgcccgccgtttcgggcgcgatcgcgtcatcctggcggcgctgttcgtactgttcgcggcgaccttgggcagggcattcgcgggttccgtcgctcagattctcttgctgacggatcaaactgtcgcccgagtaacccgtgaatgtccactttaaggcgcgttgatcgtccgcttcgggccgccaagcgacatccacgaaaattcacgaagaaccttgtttttgcccgcggcgtgcatgtacatgacgcattccgcgacgctacttgccttccggctctcccggcgccccgcccccagccccgccagcagcttctccaacagtcgcgacaactgcgcctgctcatcatccgacagcacggccagcaacgcgcgctggttgtcgatatgcgcgacgaccgcttcgtcgatcagcgcgcggccggtatccgtcagcgcgacgagcgtgccgcgcccgtcggccgggttcggccggcgctcgacccagccggccttctgcagccggtcgatgcgcgcggtcatcccgcccgacgacatcatcagcgcgtcgtacagtgccgtcggcgtcagcgcgaacggcgcaccgccgcgccgcagcgtcgcgagcacgtcgaattcgcccggctgcatcccgtagcgcgcgaacagcggattgagacggtctcgcgcgatcacgagcgccgcttcctgcagccgccccatcacccccatcgacgacgcgtcgagatccggacgctcgttacgccattgcgcgagcgcatgcgcggctcgatccacctgatccattaaccctcctcggcccaccagttatcttgacgtcgagataaatcggcgtttatcttgatgtcgagatactttacatgaaaatcgcgcgacgcccttccggggccgcgcaccgatttcgagggccttgcgatgaatcgcttcacttccccggatggcggcttgccgccatcgtgctcgtcgggctgaacctgcggccggcgctcgccgcggtcggcccgctgctcgacatgatccagcgcgcgaccggcatcggcgacggcgcggccagcctgctgacgacgatcccgatcctgctgatggggctcggcgcgctgagcgcgcggcgcctgcagcgcgtgaccggcatcgcgggcggcgtgtggctcggcgtcgcgctgatcgggctggcctgcgtgtcgcgcatcggcgcgcagcacgcgtggctgctgctcgcgagcgcctgctgcgcgggtgtcgggatcgcgatggtgcaggcgctgctgcccggcttcgtgaaggcccatttcgcgacgcggatcggcggcgcgatgggcgtctattcgacgtcgatcatgggcggcgccgtgctcgcgagcgtcgtcgcgccgttcgccgcggcccgctggggctggctcgccgcgctcgcgggctgggcgctgccggccgcgatggcggcgctggcgtggccgctggccagccgcggcggcaacacgcttgccgccgggccggcgtcggcaacgcatgcgcggccgtcgcgctcgccgcgcgcgtggcggctcgcgctgttcttcggcatcgcgaccggcgcgtacacgctcgtgctcgcatggctgccgccctactacatgcggctcggctggtcgccgacggcggccggcagcctgctcggcggcgtgacgctcgcggaagtcgtcgcggggctgacgatctcggcgacgatcgaccgcctgcccgatcgccggcccgcgctgcatgcggcgatcgcgtcgctgttcgtcggtttgctggtgatgctggccgcgcccgaagcgctcgcgttgcccgccgcgctgctgatgggcgcggggatcggcgcgctgtttccgctgtcgctgatcgtcacggtcgatcatgcggcgacgccggccgatgccgcgtcgctgacggggttcgtgcagggcatcggctacctgatcgccgggctgtttccgttcgcggccggcatcgtgcgccagcatctcgcggacctgacgcccgcatgggtcgcgatggcctgcctgtgtgtcgcgctgttcgcgctggccgcggggtttgcaccgcggctcgcgcggcgtgttgcgcgtgcctagcgcgggacggggaacacggccgttgccgttcggctgcggccgccgctcagcagtgtccttgtgattgactgcggcgcgacaccgaacgcacatcgtcgacctggcccggaagcaacgttcgcggcgcgcgcgacaatgcatcgtactggagcgtggtcgtgctcaacccggtccccgtcgtcggcatcgccgcgtcgatcctgatcctcggtgaatcggcagcgccgatctacttcgtctgcgatgcgatcacgatctgcgcggcgcgctgcacgcacctgcgcgaacgccgtgccgaacccgtgcatgatcagcccgcattcgcgtacaacgtcgaatccgcaaacccttcggcgtcgagcacgcgcccgatcaggatcagcgcggtgcgctcgatctgcgtgccccgcaccttggcgacgatgtcggcgagcgtgccggtcacgcgttcttcatccggccagctcgcgcgatagatcaccgcgacggggcaatcggcgccgtaatgcggcagcacttcgtcgacgatgcgggcgagatggcgcacgccgagatggatcgcgagcgtcgcgcggtgcgcggcgagcgagcctagcgcttcgccttccggcatcgtcgtcttgcccgcgaagcgcgtgaggatcaccgtctgtgcgacgccgggcagcgtcagctcgacgccgagcgtcgccgcgcatgcggccgtggccgtcacgccgggcacgatttcgtacggtatcccgagtgtcttgagacggcggatctgttcgccgatcgcgccatacagcgacgggtcgcccgaatgcacgcgcgcgacgtcctgccctttcgcgtgcgcagaggcgagcagcgcgacgatggcatcgaggtcgagctcggccgtgttgacgacctgctccgcgcgatggccgtcgagcacggcggccggcaccagcgaacccgcatacaggatcaccgggcacgtgcgcacgaggcgctggcccttcaccgtgatcagctccgggtcgccggggcccgcgccgatgaaatacaccgtcatcgaaaaatctccgtcaattcatgggatgaccggccgcacggcgtcatgcgcgcgcggccggatcgagcgcatcgatgagcgccgcggacgagtcgaacgcgcggtcggcgtcgggcagcggcggccggcgcagcatcacgaccggcagcctgcgttcgcgcgcgacgtcgagcttggcttcggtggccgcgccaccgctgttcttgctgacgacgacgtcgatgcccgccagcgcgaacagcgcgcgctcgccgtccagcgtgaacggcccgcgcgcggcgacgacctgcgcacgcgcgttgccgggatgcgggtcgaggcagcgcacgagccagaactggtgcggcgggatcgcgtcgagatgtgcgagcggttcgcggccgagcgtgaacagcggccgccggaacggcgcgagcgcggcttcgatgccggcccagtcgtcgactatgcgccagtcgtcgccgggttgcggcgaccacggcgcgcggcgcagcgcccacagcggcacgcccgcttcacgcgccgcggcggcggcattcgcgctgatttgcgcggcatacggatgcgtcgcgtcgatcacgaggccgatgccggcgtcgcgcagataagcggccagcccggccgcgccgccgaaaccgccgacccgcacgtcgcagcgcaggtcgtcgggtgtcttgccgaggccggcgagactatagacatgatgcgggccgagcgcgcgcgcgatcttcagtgcgtcgccggtgccgccgagcagcagaatgcgggcgctcatcgcgctgtcccgacgaagcggccctgccggtcgatcgcgaacatctcgaccgcaaccgacggcggcacgatgtcgcgcgcgacgcgcagcgcgtgcgcgcagacgagatcgccgagcggcacaccgtcggcgtgcgcgagcttcagcgcttcctggctcgtgttcgcggcgcgcatcgccgcctgcagcgcgtcgctggcgccggcctcggccgcccactgcgcgagcagcggcaggtcgatgctcgaatggcggctgtgcaggtcgagatggccggccgcgagtttgctgagcttgccgaagccgccgcacatcgacagccgcgcgaccggcgcgcgccgcaggtgcttgagcaccgcgcccgcgaaatcgcccatctcgatcagcgccatgtcgggcaggtggtagtgcgcgcgcatcgcatcctcgcttgcgttgcccgtgcacgcggcgatatgcgtgatgccgttcgcccgcgcgacgtcgatgccctgatggatcgacgcgatataggccgagcacgagaacggccgcacgatgccggtcgtgccgaggatcgacaatccgccgacgatgccgaggcgcgggttcatcgtcttcagcgcgagcgcctcgccgccctcgacgccgatcgtcacgtcgaagccgcccgcataaccgtgctcggcagccagcgcttccaggtgcgtcgtcatcatctggcgcggcaccgggttgatcgccggttcgccgaccggcagcgtcagccccgcgcgcgtgaccgtgccgacacccggccccgcatgaaaacgcacgccgggcgccgccgcgagcgcgacacgcgcgaagatcagcgcgccgtgcgtgacgtccggatcgtcgccggcatccttgatcgtgccggcttccgcgccgtcggccgtcgtccggcagaactcgagccgcatcatcacgcgctgccccttcggcagcacgatctcgaccgcgtcgtccgcacgccccgcgagcagcagccgcgcggcggcgagcgacgtcgcggtcgcgcaactgccggtcgtgtagccgaagcgtagcggcgcgggctgttcggggtttcgtcgcgcatcacgcgtccgttgtatgcgtcgtggccggcgaagccgccgtgtcggccatgtcgaccgtgtccggcttgcgcacgtcgtacagcgtgaccggcagcggctgacgccaggtgtcgaagcggccgagcggctcggcatgcgcgagcgacacgcgcgtgagcgtgccgccatgcgtctcgcgccatgcggcgagcgccagctcgccctgcagcgtgaccgcgttcgcgaccagccggccgccgggcttcagcgatgcccagcacgcgtcgagcacgccggccgcggtcgccccgccgccgatgaagatcgcgtcgggcgcggcgagcccgcgagcgcatcgggtgcgcggcccgcgacgagttgcaggcccggcacgccgagcgcgtcgcggttgtgctcgatgaagcgctgccgctccgcatgcgcttcgatcgcgatcgcctggcatgacggatgcgcgcgcatccattcgatgccgatcgagccgctgccggcgccgacgtcccacagcagctcgccgggcacgggcgcgaggcggccgagcgtcatcgcacgcaggtcgcgcttggtgagctggccgtcgtggcggtacgcatcgtcgggcaggccgggcgtgagcgcgcggcgcggcgcgtcggggccggcccggcagtcgagcgcgaccagattgagcgcggccgtttcggcgacgcgccagtcctgcgcgagcccgtcgagacgccgctcgagcgggccgcccagatgctcgaacacgctgatgcgcgtcggcccgaagccgcgtgcgacgagttcggccgcgacggcggccggcgtccggccgtcggcgctcagcacgaacaggcggcggcccggcagcaggtggcgcgcgagcgccgcaagcggacggccgacgagcgagaccgcgccgacatcctgcagtgcccagccgaggcgtgcggccgccagcgacagcgacgacggcgcgggcagcacgcgccattcgtcaggggacagcgagcgcgcgagcgtggcgccgacgccgaacagcatcgggtcgccgctggcgagcacgcagacgggcgacgtgcgccgtgcaagcacgcccgcaaggtcgaacggcgacggccacgcttcgcgcgcggccggcagccttgcgggcagcatgtcgagatgccgcttcgcgccgacgacgagcgtcgcgtcgagcagcgcgcggcgcgcgctgcggccgagccccgcgtaaccgtcgtcgccgatgcccactaccgtcagccacgccgtcatgcacccttccccatcgttcgattccatcccgtttgttgcgatgcgcggctgccggagcgccgcgcgttgatccgttgctgatcccgatccgctttcgcgccacgcacgcccttcggtgcgatgcagcggcgacgtcagccgcgcggtacaccgccgaccagcgccagcacggccagaaccatgccgccgatcgacgcgatcagcagccagccgagcagcagccacatgagcggccgcgtcccgcttttcctgtacaggagcgtgccgcccgcgacgatcggcacgccgaggccggcgagcccgacattcttcggccactcggccgacggtgcaagcgggatcaacacgcacgcgagcaggacccatgcggggatggccagcaggcccagtgcgacgcccatgccgaacagttccgtcctgccgagtttcatggcggatgccggcggtcgccgatctgatgtcgaggcgccaatcctaccatttgcgagacagcgcaaaaccgtctgcggccatgctgcgacgcggttgcgcgacgtaccgccgatgccggatcgtcgcgaaaatcgggtatcctacggccgttcgttcgccggtgcccttcggggccgaagagggaacacagggcgccccacgcgccgctgtggctgcccccgcaactgtagacagcgagccgatctcccctcatgccactggtttcaccgggaaggccgggagccggcgccgacctgtcagccaggagacctgccggccagaaagtgcgtgcgtgccagtcggcgtcgggcggggtgtaccgacgcgttggccgcggcgcgacactgccccggtaccccgtgagttccgccccgattcgattcctgcgtcgcccgtcgtgcgcccgtcggcttgcccggggctcgtgcgcgtggtcgcggccgccgacggcgggctgtgccggatcaagctgccgggcggccggctcgatgcgcgtcaggcgcgcgcgatcgccgccgccgcgcgtgcctgcggctccggcgcgatcgacgcgaccaatcgcgcgaatctccagatgcgcggcattcgcgacgacgcggccgacgcgctgatacgcgcgttgctcgacgcgggcctcggcccgtccgtcgacgccaccgcggatgccgtcaccgataccgccgcgctcgccgcgagcgacgacgtccgcaacgtgatgctcagcccgctcgccggtgacgaccccgccgcccttgtcgacagccgcgcgctcgccgcgccgctcctcgacatgctggcgcgcgagccgcgccgtggcgagctgtcgccgaaattctcgatccagctcgacggcggcgaatcggttgcggcgctcgatcatccgcacgacatctggctcgccgcatggcgtcgcggcgacggtgcggtgcgcatcgcggccgggctggccggctgcccgccggtcgcgaacgacgaccgaccggcctcggtcgatgtcgcgcccgatcaaggtgtcgcgctggtccgcgcgctgctgctcgcgttcctcgatctcgcgccggcggacgtcacgcgaatgcgagccctgctcgcgacctgcggcgaacgcgcgctgctcgagcgcgcgcggcactatgtgccgttcgcgcttgcggccgatccggcgctcgccggctggcgccgcgcgcgcaccgatccggcgctgcgtttcggcgtgcacccgtcgcgcgataccgcgcgctgccacgtcggcgcgcaattcccgctcggccggctcgacgccacgcaactggaacggctcgccgcgctggccgaaaccgacggcgacggcacgctgtcgatgacgccctggcaaggcgtgttcatgcatcgcgtcccgcgtgaacgcgcgccggccacgctcgatgcactggcgtcgctcggcctcgtctgcgcgtcgtccgacccgctggcgtcgctcgtcgcgtgcaccggcagcgcgggctgcgcgaaagcgcgcgccgacacgaaacacgacgcgctcgcgctcgccgcgcgcatcggccatgcggccgacgtgcacctgaccggctgcgagcgccattgcgcgctgccgcatcccgcgacgcacacgctcgtcgcggttgcgcccgcgcactacgacctttaccggcgcgatgcggccgcgggcctcggcgccccgctcgcgcgccatctgacgattgaccaggccgcggcccgactgacgggcgcgcggcacagccaggacaccaccgatgcttgactacattcgcgacgggcaggaaatctaccgccagtcgttcgcgacgatccgcgccgaggccgacctgtcgcaggttccgcccgacctcgagaaactcgcggtgcgcgtgatccatgcgtgcgggatggtcgacgtcgtctacgacctgcgcttctcggccggtgccggcgcggcgggccgcacggcgctcgcggccggcgcgccgatcctgtgcgacgcgcgcatggtcgccgaaggcatcacgcgcgcgcggctgccggccggcaaccgcgtgatctgcacgctcggcgagccggaagtgcccgatctcgcgcgggatctcggcaacacgcgttcggccgccgcgctcgaactgtggcgtccgcagctcgccggcagcgtcgtcgtgatcggcaatgcgccgaccgcgctgttccatctgctcgacatgatcgacgccggcgcgccgcgccgccctgatcctcggtttcccggtcggcttcatcggtgcggccgaatcgaaggcgctgctcgatgccgacagccgcggcgtcccgtacgtcacgctgctcggccgccgcggcggcagcgcgatggccgctgcggcggtcaacgcactcgcgacggaggtcgaatgacgaccgcgcgcggacgcctgttcggggtcggcgtcggccccggcgatcccgaactgatgacgatcaaggcgctgcgcgtgctgcaggccgcgcccgtggttgcgtatttcgtcgcgaagggcaagaaaggcaatgcatacggcatcgtcgaggcgcacctgcgggacgggcagacgcaactgccgctcgtctatccggtgacgaccgaggcactgccgccgccgctctgctacgagacggtgatcgccgactttacgacacggccgccggggttgtcggtgcgcacctcgatgcggggcgcgacgtcgcggtgatctgcgaaggcgacccgttcttctacggctcgtacatgtacctgcacgaccgcctcgcgccaagctacgacacggaggtgatccccggcgtatgcgcgatgctcggcggcaccgccgtgctcggccagccgctcgtctatcgcaaccagagcctgtcggtgctgtcgggcgtgctgcccgagcacgagttgcgcacgcggctcgcgcaggccgatgcggccgtcgtgatgaagctcggccgcaatttcgacaaggtgcggcgcgtgctcgacgagctggggctcgcgaagcgcgcgctgtatgtcgagcgcgcgacgatggcgagccagcgcatcgtgccgctcgatgaagtcgatccgatggcgtcgccgtatttctcgctgctcgtcgtgccggggaaaaatggcaaggatgacgaccccgcccgcgatcgtgatcctcggcgcgggtgcgctcgataccgcgcggcgcatccaggcgcgttatccggggcgcgcgtgcacggcctcgcatcgcgcgtcgccgccgacgtgccgttcgacgatctcggcgcgcacttgcgcgaactctatgcacgcggcctgccgatcgtcgcgctgtgcgcggccggcatcgtgatccgctgcatcgctccggcgcttgccgacaagggcgtcgaaccgcccgtgctcgcggtggcggaagacggttcggcggtcgtgccgctgctcggcgggctgacgggcgtcaacgtgatggcgcgcgaaatcgctgcctgcgtcggcgtcgcgccggcgatcacgacgagcggcgaactgcgcttcggcgcgtgcgtgctcaatccgccggaaggctatgcactcgccgatctcgcccagggcaagcgcttcgtgtccgatctgctcgcgggtgcgtcgacgcgcatcgacggcgcggcgccgtggctcgacgatgtcgcgttgccgcgcgacgacgccgcggcgcatgcgatccgcgtgacgcccgaagcctggcgcggcacgcgtgacgagctcgtgattcatccgcgcagcgtggtggtgggcgtcgatgcgcacgctattcgcgcggacggcgcgctcgcggcgcgcatcgcggcgtccctcgacgcgcaggggctcgcccggctggcgctcgcggccatcgtggcgcccgcagcggcgatcggcgatgccgcgctggaggatgcggcgcacacgctcgacgtgccgcttcgtttcgtcgatgcagacggcgacggtgacggcggcgcaccggccgacgcggccgcgctgctcggcagcgcattgcgtgtcgcgcacacgctgcgggccacgacgaacggcatcgcatgcgcggtcgcgtcgcatccggtcgatcccgccacgctcggccgtgcgcgcggccgcctgacggtgctcgggctcggcccgggcgccgccgcgtggctcacgccggccgcgcgcgccgcgctcgcggacgcgaccgacatcctcggctacaccacctacgtgaacatggccggcccgttccgcgacgaccagcgcgtgcacggcaccgacaatcgcgaggagatgcagcgcgcgcgccatgcgttcgaactcgcggccgagggccggcgcgtcgcggtcgtgtcgtccggcgacccgggcgtgttcgcgatggccgcggccgtgctcgaggcgctcgacgaagcgcgcgacccgcactgggccgcggtcgacctgcgcgtggagcccggcatctcggcgtcgctcgcgacggccgcccaggccggcgcgccgctcggccacgatttctgcgcgatctcgctgtcggacaacctgaagccgtgggacgtgatcgagacgcgcctgcggcatgcggcgcaagccgatctggtgatggcgttctacaacccgatctcgcgcgcgcggccgtggcagctcgatcgcgcgctcgatgtcgtgcgcgcgcatcgcacggccgatacggtggtcgtgctgggccgcgacatcggccggccgggcgcgacgctcgcgacgacgacgctcggtgcattgcgcagcgaccaggtcgacatgcgcacgatggtgatcgtcggctcgtcgacgacgcgccgcttcgcgatcggcgagggtcgcgagtgggtctatacgccgcgctggtatcgctgaacccggtcagcgcgccggcctgacgccgtgcgcgccggcatacgccgtgccgcccgcccccagaaccggtacacgagcacgccgacgacggcctgcgcagcgaccacgaacgcgacgcagcctgcccatccccaccggtgccagccgggcaccggcaggatcgagccgaggctgccgccgaagtaatagcaggacaggtagatgccgatcgccgtcgagcgcgcgctcgacgccgcctgcgaaatgaacgtgttggccgacgcctgttcgacgaacacggcggtcgagccgagcgcgagaccggccaggatcaccggcacgtggtcggacagcgtgagcagcgctccgccgatcgcgagcgcggccgcggtgagccccggtgcgcgcgggccgcggtgccgcgcgaggcgccctgccagcggcgtcacgaccaccgccaccaggaacaccgcatagatcgcgccgatcccgaccgtgccgaagccgaacggcgcgcgggccaggcgcaggccgacgaacgtgaacgtcgcgacctgcgacgcgagcacgcacgcgccgatcgcgaacgacgcgagcagcgggccgcgcgtgacgatgcgccaggccggccccgcaccggcctccgtgtcgggttcgacacgccgcgcgatcgcaccggacgccggcaggctcgcgtagatcgtgacgcccgtgacgagacacagcgccgcgacgacgtcgagcgcatgccgccagccccacatcgacgtcatcaggttggtcgcgaagcgcccggcgaaaccgccgagcgtcgtgccggcgacgaacagcgcgctgatctcggccgacacgccgcgatcgaagcgctcggcgatatacgcgatcgacagcgcgaagacgaacggcatgaccaggccggcggcaaagcgcgcgccgagaaacgacgcgaaacctgccgcatgcgcggaccacacgaccggcagcgcgacggccatcgccgccagcgagatcgcgatgcgccgctcgatgcgcgcggccagcacgccgacgaacggcgcgataatggcgacggccgtcgtggtggcgctcacgccctgccccgcgcgctccgcgctgacgccgaaggtggccgcgagttcgtgcaggatgccctgcgtcgaatacagattgagaaacgcggcgaagccgcagagaaagaacgcgatgcgcgtggtcctgtcgttcatcggagctgcctggtcgtcgatgccgacagtctgacgagcgcgccgtgcgcacgccaataccgttttcatcgcgattgataccggaacgacaacaatgctcgacctgcgccgcctccgctatttcgtggtcgtcgccgacgaactgcacttcggccgcgcggcattgcgcctgcgcgtcgcgcagccgccgctcacgcgccatatcgccgcgctggaaagcgagctcggcgtgcggctgttcgagcgttcgacgcgcgcggtgcggctgacgccggcaggcgccgcgtttctcgaacaggcgcgcaacgtcgtcagcgcggccaccgaggccgaggcgagcgcgcgcaagctcgcgcaaggcatcgccggacgaatcgtgatcggctatgcgagcgccattccgatgtccgacacgttcccggacgtcatccgcgccgcgagccgcacgatgcccgacgtcgaattcgcgttccgcgaggcggcgaccgccagccagcaccggcagatcgcggacggcacgatggacatcggtttcggctgggcatggggcgacgcgcctggcgtgccggtggcgtcgctcgtcgtgtcgcgtgaaccgctcgtggccgccgtgccggccgcgaatccgctcgccggccgcgcgagcgtcgacgtcgcggcgctgtcgagcgaaaccttcgtgacttttccgccgggttacggctcggcactggccgcggcactggacgacctgtgcgcacaggccggattcgcgccgcgtatcggcgcgaccgcggcacagatcacgacgctcgtgtcgctggtggccgccgaacgcggcatcgcgatcgtgccgggcttcacggcgacgctgcgacgtccgggtgtcgtgtacgtgccgctcgccggcgcgcgcgcggtcgagcagatcgtgtcgtggagcgagccgtttgcgtcggcgtgcgtcgaacgcttcgtcgcactcgcgcgctcgcttgtgcagcccgcatcggcttgatgcgagtcaagcgatccggatcgatcttccccgtggtttcggcgttccggccgcgcaacaccctcttccgcaccgatcacgttcgccggaacggttgatcgccctcaccgaatgccgcgggtatcgccggaatgacgcgcgccgcactgccgccgcgacgcgcgtcccgaatgccggcgcgctcgcccgcgaaatcgatgagggctgctcgatacctcactgcaccacgatggtgtaaaccgctcgcgcgtcagccagtcctccgtcattcgtggccgtgacggtaaacgtgtaccgcccggtcttcctcggcgtaccaacgatcccgcccgtatcctgattgaactggaggcctgggggcaaaccccgttggtcaccgtgaagcggacggtcgcaggcgtattcgtcgtgattttcgctccgtagagcgtgccttgagtggccaccggcaggacggcggggcccagttgcggtgtgggtgccgatacggtctgcggagcgccgatcgggacgccgtcggcattcacctgctgcaacgaccagctttgcccggggtgacggcgctcagggtccacgaggtcgtctggtcgcgaagcgcggccctctgcttttcggtgaacgcgccgagattcctggcggtttcccactgcttgatcttgtcgaggatatccggcgtcgactctgccgagagcaggaatgccaccgtgctctggaagccaatgccggcgttgagcgccgcgccgcgtgcgagcctggtttcgatcatggtcaacgagacgcccgtgatatcgaaccatccaagcatgcccggcaggtagttggcctggtagaaggcgttgtcgcggtacagctgatccacgtccgggttggaccagctcgcgcgggtcagcgtgtcccatgcgttcgaggtcatccggctcgtctcgctgatgtatccgtcgtgcccggtctgggcggcgtaggtgccgttgatcaaccgggcaatgccgaagctgccccagccggtatcactggcggattccaccccgtcgaaggagtgggaccggatgccgacgttgttcctgatggcgcccagccgggtggcgatctcgtcgatgatgccgaggccgccgatggccccgccgtacgaattcacgatcaccctcgcaacgggcgtgccacgcgcggcttcggccgggacggagccccactggcctcgggtcagtccactgacttgccattcggtgacgcccctttggaccgcgttgaacgagatgaactcgttgccgatacgcagcatctgctcgttgatcccgtcccgcaccggcgcgaatccgctcaagtagagcatcgtgctcgtcatgctcaactgccgggacaaggcggcttgaccgcccaaggccagacgagggtccgcgggcggcgaaacgtacggatcgatggaggtgggctggccgacgctgatgaagtccgacatggtatggacgccgacgcggacgccgtactcctttgccgcttccaccagcttttcggctccgctgtcactgtcgccgaaggtgaagtcgaactgataatgcccggtgtatttccaggggccgcgataattccgtggcgagtagatgtagttgattcccgcgctgctggcgaatcgggctgccttgccgacattgccagtgtcgagatcgtccagcacgaaagacgactggccgctggcctgagccactttctgccactggccgttctgggtcggatacgggaggttttcacccgaggcaatgaacgacaacagggtcgtcacgagctccggtgcgctgccgtacagcgcaatcttcgaaccgatgaccgagcccgcgctgtcgagcgggccgagcgggatcggatagccattgggattgagccggtcgcgccggcgcgtatagtcgaacgtgaaggcgcgcagcacggcccccacgatgtcttcgccgccgcgcaccacggctccagcgccgccacgtccacgttgtaaggattggggatgacgtcgttttcccagccgtattgcggatattccttgggccacgcgccttcggtgcggtcgttgagcggcttgaggccgatcgcgaattcgttgtctcgcaccacacccgcggcttcgccgacggtctggttgatcgcgacaggcaacggcccccacagcagcgtctgaacgtcggaagcgggatcggtcgacacgcgggtgacttcaaaggtggcgtagccgtttttctgcaggacgcggacatcgacctcgaatgcgaggccggcatcattcacgaaggacagcgtgttgtcggtggacgaccatcggacgccggcgggcttcgccagtacgccgttgatcacgagcctgacgagcgggacggatttcccgggcgagatgtagttgcggccgctgcgcgaatcgatgagttcgacgacagcgccggtggagtccaggccgagcgtcaagtagccggccggaatgtgtagagtgcttgtcatgtttcgactttcctgacgaaaatggcggggccgcgagcggcgcagatgcacccgtacccccgtccttggcgtgccgcgagccaatgttggaattccgaatcgatcgacccgacggacagatggcgacggtcggcggataccccggacattggacgtagcgggtctgcccgaccgattcgagcgctcccgcgtgccgtcgatgccggcatctttcatcgaaaggccagcgtgccagcgctttcgagcgcgatcctttgcggcatctggatcgcgggatctgcgtcgcgagccctgggtccgacaacgcaccgtcaccgcctcaactgccctcgacagccctcgcctgcgcaaacaacctgcgcggagcatgcggcgcaacgagcgacgccgatggcggccagccgcagtgaatggctgcggctggccggccgccggaactgcctcgtcaaacttccggcggtgaaaccggcgcagttggaaagaggcagcggccgcgtgattccggttcgggttttactggctcggcacttcggcgatatacgaaacgtagaggttttgccccagtcgctgcccgaatagttggggaacaccctgtcttcgcgggtgatgttgacgttgaatccggtcgtcgtgaccttggtcaccgtcaccgagaacgtgtccggataactggatgcgtcgttgggatcctggagggccgtcaccaccacgatgggcgcggtcgaaaacgtgcccggaaacgtgatttgggcattgaaaggcgggttgatccaggaatcctgattgccgccttgaacgcttccgactgcctgctttgctacgattctttccagcatgttgagctcctgatggttggaacgacgtgacgtcgtgagtgagcctcgcgcgaaagcacttcgctcgcagacaacgttatgccgcgcatgcgtcgaaagcgattacacgtgattacatgattgaggcggccatcaaggggcgtcggaagcgtcgatttcatgtcgaaagcgacggcaattttgtcccgctccgcgcccgatgcatgacggaacgatgtcgaatcggcaagatcgttacgtatcgggaatcaaataacaaaagaacaactaagcattcactattcgacgcgaatcctccaagatgggcacgccgccggccgggcatgcccggtcgcccgaccggcggcgatacgcgggccagcgtatccctcttccacttggagaacacaatgcacaacaatgtgttgccgcgtttcatcccgcgcgcgcttgccgcgggttgcctgctcgccgtggcgagcgtgtcccagggcgccggcgtctatgcgccctatgtcgacgtgacgctctatccgacgccgctcgtcgaccagatcggcgtccggcaaggcatccagcagttcacgctcgcgttcgtggtcgcgggcaacgggtgtacgccgtcgtggggcggcgtgcagccgatcggcaacggcgcgagcggcggcctgctgaccgcgctgtcgacgtcgatcgcgagctatcgcgcgaaaggcggcgaagtcgccgtgtcgttcggcggcgcgaacggcacgccgctgatgcaggcatgctcgacggttcccgcgctggcgggcgcgtaccagaccgtgatcgacacgtacggcctcacgcacatcgacttcgacatcgagggcgcgtcgcagctcgacacggccgcggtcgcgcgcaacttccaggccgtcgcccagctgcaggcgagttatgcggcgaaaggcaagccgctgcacgtcacgctgacgctgccgacgatgccgaccgggctcacgcaggacggcctgaacgtcgtcaacgcggcgatctcgaacaaggccgtgttcgatgcggtgaacgtgatggcgatggactacggccccgcgaacatcgacatgggggcggccgcgatcagcgccgcgcaggcgctgtacgcgcaactcgatacggccttcaagtcggccggccagccgaagacccatgcccagctctggcagatggtcggcgtcacgccgatgatcggcgtgaacgacgtgcagggcgaaaccttcacgctcgcgaatgcgcagagcgtgctgaacgcggcggtcgccaacggctacggcttcttcggcaactggtcggtcggccgtgaccaggcgtgcccgtccggcggcacctatgcgtcgccgacctgttcgggcgtcgcgcagcagccgtacgcgttcgcgacgatcttcaggcagctcgacggcaagtggggcgcgggcgtcacgcaggatccgaactacggcggcggctcggacggcggcacgccgcaaccgggcgcgccctgggcggccggccaggtctatacggccggcgcgaccgtcacctaccagggcacgacgtatcaggcgcaatggtggacgcagggcgacgtgcccggccaggccgccgtgtggaaaccggtcggcggcggcacggccacgtggtcggcgaccaccgcgtattcaggcggcacctgcgtgatgtaccagggcgcgaaatactgcgcgaaatggtggacgcaaggcgacaacccgagtgcgggcggtgtgtgggtgaagtcgtgatgccgcggatcggccgtcgctaggcctgcgcgcgcatcggggccgttcacggcgatcgcggcccgatcgccggcggacggcccgcttcgcttgccggccctccttcggcgcgccccgcccgcggtcagccgcgcgcgtgctcggcgagcagcctggccttcgcatcgaccagcagcgccgcatgcgtatcgcgatgctggcggatccgctcggacggcccgaccaccgacaacccgtaccagtcgccgtcgagcgtcagcgcgaccgcgatcgccgacagctcgggcgcgctctcgccgaagttctcggcccagccgagttcgcgaaaccgagcggtttgcgcgacgagcgcgggcaggtccgtcaccgtcgcgtcggtgaagcgctcgaacggcaactgcacgccgagcgcctgctgcgcgtcgccggccagttccgcgaagatcgccttgccgatcgagttcgcatgcagcgggcgcagttcgcccggctcgcgcgtataacggatcgcctgctccgattcgacgacgtcgaggtaggtgaccgacacgccctggatcttgccgagcacggccgtctcgcggctcgcgtcgcgcagcgcgacgagatgcggatggacgatgtcgacgaccgggtcggtcgcgtcgatcgccgcggcgatcgtctgcaggcggcgcgtcgggtagtagccgccgcgcctgcgcacttcgtacaggtaaccgcggctcacgagcgtgcgcgccatcgcgaggcagctcgacgccggcacattgagcaggcgcgcgagttcggtgagcggcagcggccgccgttcggcggcgaacagctcgaacaggtcgagcgtgcgggcaacgagtttgacgtccatgacgagcgcttgaatcggaacgggaaaccgcgcaccgggccggccgccgggtcggtacggtcagtacgacttcggcagcccgagcaccttctccgcgatgtagcacaggatcagttgcggactcacgggcgcgagcctcggaatcatacactcgcgcaggtagcgttcgacatggtattccttcgcgtagcccatcccgccgtgcgtcgcgaccgccgtctggcacgcctggaacgcggcttccgcgccgaggtatttcgcggcgttcgcttccgcgccgcacggctgccccgcgtcgtagcgcgtggcggccttcatcaccatcagccacgcggcctcgagctgcatccacgcctgcgcgagcggatgctggatcgactggttctgcccgatcggccggccgaacacgacgcgctcgcacgcatactgcgtcgcgcggcgcagcgcggcctgcccgagcccgatcgcctccgccgcgatcaggatgcgctccggattcagcccgtgcagcagatagcggaagccgtcgccttcgttgccgatcaggtcgccttccggcacgcgcaggttgtcgatgaacagcatgttcgaatcgaccgccttgcgacccatcttctcgatctcgcgcacctcgacacgcgaccggtcgagatcggtgtagaacaggctcagcccgtcggtcggcttcgcgacccggtcgagcggcatcgtgcgcgcgatgatcagcatcttgttcgccacctgcgcggtcgagatccagatcttgcgcccgctcagcacgtagtggtcgccgtcgcggcgggcctgcgtgctcaagtgcgtggtgtcgaggcccgcatcgggttccgtcaccgcgaagcacgccttgtcgcgcccggcgatcagcggcggcaggaaacgcgccttctgtgcgtcgttgccgaacacctgcaccgggttcagcccgaagatgttcatgtggacggccgacgcgcccgacaggccggcacccgatgcgctgatcgtgcgcatcatcagcgcggcctcggtcatcccgagcccggccccgccgtgcgccgggtccatcgcgatgccgagccagccggcctcggcaagcgccgcgtggaaatcggcgggaaatccgcccgcgcgatcgcgttcgagccagtagtcgtcgccgaagcgcgcacagattttctcgatcgcgctttcgattgcgcgctggtcgtcggtcaggtcgaactgcatggatggctctccgggaaaggccgagcggccgcgccgctctaaagaaaatgccaggcggcgccagggggcacccggcggaacgttccctcgcgggatcgccccgtcggagcgccggcacgacgcggcaggcctggggcgctcacaacggaaacacgccgacgatcaccgcggcgaacaccatcagcaccgtggcggcgaacaggaacggaatcgtgaatttctgatgctcggcgagctcgacgccggtcaggccgacgatcaggaacgtcgcgggcgtgagcgggctcaccgggaaccccgtcgtcatctggccgagcagcgcggcctgcgccatctggatcggcggcacaccgagcagcttcgcgctttccgcgagcaccggcagcacgccgaagtagaacgaatcggggtcgaacagcaggctgagcggcatcgacagcagcccgagcacgaacggcatgtggcgcgcatgctcgaccggcacgtgcgcgaccaccacgtccgccatcgccttcagcatcccggtgccggacatgatgccggtgaacgcgccggccgcgagcagcacgctcgccatcatcagcgcggccttcgcatgcgcgtcgatccgctcgcgctgggcctgcacgtccgggtagttgatcacgagcgcggcgaccgtgccgagcatgaacatcaccatcgggtcgacgatgcccgacacgagcgtgacgagcaccacgagcgtcagcgcgagattgatccggaagcgttccggccggcgtaacgcgcgctcggcatcggtcagcgcacgcggcgcgatctcgagcggcgccgcgccggaacgatcgagcccgagccgtttcgcctcgcgcacgccgagcacgtacgcggtgccgaacacgaacacgagcccgacgatctgcaccggaatcatcggcatgaagatcgcggaaccgggaatgtgcagcgccgccgacgcccgcagcatcggcccgacccacggcaggaaattgacgccggccgccatcgacgcgacgcacgcgaggatgcgccgatccattccgagccgcgtatagagcggcatcatcgcgggcagcgtgacgagaaacgtgacggcgccggagccgtcgaggtgaatcagcagcgcgagcagcgccgagcccatcacgatgcgcggcggatggcagccgatcacgcgcagcacgcccgcgatgatcgggtcgagcatcccggcgtcggtgaggataccgaaaaagaatcgcaaaacgaacatcccggcgatcgggccgatgttctgtacgccgtgcacgatgaacttgccggtcgcgagcccgaaaccggccgcgagcgacgcggccaccggcacgacgatcagcgcgacgagcggcgacagccgcttcgtgatgatcaggccgaacagcgcgacgatggcgatcgcgccgatccatgcaagcatgatgcgtctcctcttcagccggtgcgcccgtgggtgggccggcgtggggttcgaatggtcgtgcggtacagcgccgccggtcgcgcggtacgcgccggcggccgtgatgccggtcagttccggcgcggggcgttgtcgcggtcgttgtcgcgttcggtagcgcagccggtcgtgccggcgtcggcgaatacctgcgccgcgtgttcgttcagcgcgggcggcggccgccggtacgtggccggcgtgcggccgagcttgatcggcgacgcgatgccgcgatgccggcccagctcgactttcatctcccgatgcgcgacatgcggatgatcgagcgccgcatcgagcccgagcaccggcgcgcacggcacgccgcggcgcatcagcgctcggcgagcgccgcgccgtcgtgcgcggccagcgccgtttcgagcaacgtgcgcagcacggcgcggttcgcgctgcgcgcgcggttgtccgcgaaacgcggatcgccgggccagtcgcgcgtgccgagcacgtcgcacagcgccgcgaactgtccgttgttgccgaccgcgagaaagatgtcgacgctcgccgtcggaaagctgtcgtacggcgtgatgttcggatgcgcgttgccggtgcgcacgggcgcgttgcccgaatggaagaagttcggcgtgtgcggatgcaggatcgacagcgcgcagtcgaacagcgtcgcttcgacgaactggccgcggccgctcgcgtcgcgctcgcgcagcgccatcagcacgccgagcgccgcgttcagcccggtgacgagatcgacgatcggcacgccgacccgcagcggcgcgccgcccgcttcgccattgacgctcatcagccccgcgagcgcctgcacggccgcgtcatagccgggcaacccgccgagcgggccgtccgcaccgaagcccgacacgcggcaatggacgaggcgcggaaaccgcgcatgcagtgcgtcgaaaccgagcccccagcgctccatcgtgccgatcttgaagttctcgacgatggcgtccgcgtcgtcgagcaggccgagcagccgcttgcggtcggccggttgcgtcaggtcgagcgcgatgccgagcttgttgcggttcaccccgaggaagtacgacgcggtatcgccgtcgaacggcggccccacgtgcgtgtttcgtcgccggacggcggttcgaccttgatcacctccgcgccgtggtcggcaaggatctgcgtggcgtacgggccgcccagcacccgcgacagatcgatgatgcgcaatcccgccagcgcgccctgctgctcgtgttccgccatgcgtcccgctcctggttccggttgatcggactgccggttccggcaggtcaggcgcctgcggcgcgaccgtccggattcgactaataattcttgtgtatgaatttatattcacactggggaattatgttgtcaaccccggcggcaccctgagaccgtgcggaagacgtccccgtgcgcaagtggggacgacaccgaacacgtgccggttgcgatggcgccccgcctttcgctaagctggcgggaaacctctatctcgaaaaatctcgaaaaattcaggcggactattcatgaaacggatgctgctggcggccctcgtgctggcgtcgacgctgggtgtcggacatgcgcagacccagacgttccatttcggcgagggacagacgcagatgcccggggagcgccgcacgccaccgcgccggccgcacggcacgcgagcccgccgcctcaccatcggcgtgccgttcacaagcgccgccatccgcgccacgtgaagccgacgcgcaacgggatctatacgcacacatgacccggcgtccgttgcgcgacgccgtgcacggaactgtcatgaacgaccggtaggatcgctgcggctgcctgcaagccgtcgcggccgcggccgggcaaagcgccgccgacgcgcactttctccacgattcagcacctgttttgccgaacatgagtaccgggccggacaccctcgccgtcatcaaggaacgcgccacgatcgtgtgccgccagcacggcagcgtgctgctggtcgctcgcaccgcgtcgcgctggtcgctgccgggcggcacgatccggcgcggcgagacgccgctcgacgccgcactgcgggagctcgccgaggaaacacggctggaggggctcgcactcgactacgcggtgcagttcggcgggctgacgaagctccaccatgtgttcgtggccgacgtgccggcgcacctgacgccgcgcgcgagcaacgagatcgcccgctgcaagtggttcaccgtcgaccggctcgacacgctccgggcgagcgtgccgacgcgcaagatcatcgagttgctgcggctcgactgtttttcggcgattgcgaacggccggctgcgctgacgtcgatcccgcccgcgcccgtcacgtgcgcaggaacgggccggccttgcgttcgagcagcatgacgagttcgggctgcatgtacgtgtagcgatcgggaatgtcgaggcagacgaccttcttgtgccgcagatgcgtaccgaattgcgcggccagcctggtcttgtgcgcgcgctccatcacgaacacgacgtcggcccagtcgagctgctcggcgcacacgtgcgtgtccgcatcgggcgcgaggcccgccgaatcggtttcgacacccggccacgcggcgaataccgcttcggccgtcgggctgcgcagccggttgcggctgcagatgaagagtgcccgtgtcatgtcgctgcgaggttcaaccttgcggaatcgtgcccggccggacgtacgcgagcatgtgcgacacgtagtcggccttgccgagttcgacgccatggtgacgcaggatcgcgtaagcggtgatcgcgtggaaattgaactgcggcagtgcccagtcgcgcgcgtactgttcgcccgtcatgtcgaatgcgactccgttcggcaactcgagcgcgatcggcagcgcgccgccgccgtcgagcgcgtccggcgcgagttcgccgagaaatgcgagcgtgccggcgatgatcgcctgcgcatcggcgagcgagccgggctgcgcatccgcattccatcccgcctcgcgcaaggccagcagtgcagccggcaacggttcgccacgcagccggtgaatgggctccatggcctggaagcacgagaagcgcacctgcgccgcgagcggatacatgtcgggcgccagcttcaacgtcatcgccgcgtcgggcgcgtcgcccgcggcctgccggtgcgcagcggccttgtcgagccacgcggtctgtgcgcgcagcatgtgggtgaaggtcggaacgagaagttgggtcggtgtcacgcgtgcgctcctgggttgggttgtcgtttgcgccacgatagcagcgtcggtgcaaacgtgcatcccggctcgggtgacgaacgcgattcgatgcggattcaacggtgcggcatggcgacgcatggcgtgcgggtgttccccgcttcaggacgatcacgacgcgcggccgttgtccccggcctcaaggcttgccgtgccgggccaggaaccggtcgagctgcgatgcaaacgtcttgccgtcgcgcgcgctgaacggcgccggcccgcccgtgtcgatcccggcgctgcgcaactggtccatcatcgcgcgcgtcgacaggcgttcctcgatgttctcgcggctgaaccagttgccgcgcgggtcgagcgcatgcgcgcccttgtcgaggacggcggcggccagcgggatgtcggcggtgatcacgaggtcgccggcttccgccagctcgacgatccgcgcatcggcgacgtcgaagccggccggcacctgcactgccttgatgaacggcgacggcggcgtgcgcaggaactggttcgcgaccagcgtcacgcagatttcggcacgacgcgcggcgcgaaacagcatgtccttgatgacggcgggacacgcgtcggcatcgaccagtacttgcatggcggtttttcccagtgggcagaagcagaagcggcgatcatagcgcaccgcggccggcgatcagccggtgcggcccgagcacagcgcgtcggccgtcacccactgcgcgccccacgcggcggccagccgctcgccctgcccgatccgcacggccgcatcgtcgaagtcgacgaacacgacgtgatcggccgccgcgggtttggccggcatctcgcgcgtgcgtccgtcggacagcacccacagccagcgctgcttgtccggatcgcgccgcgccgcgcgcgagcaactgcgcggcggccgcgacgccgtccgcgagcggcgtaccgccgccaccgtcgaccggttcgagccagcgcgcattccaccagcgcggcacggccgggccgaagcgccgcgctgcgccgtcaccgccgaaacagaccagcgcggtttcgactcgatcgcgcgcggcctggtcgaaatacgcgacgatcagccccttcgccagtgcgagccgcccgtgcgacagcatcgacgccgaacagtcgagcacgaagcaatgcagtgcatccggtgcgcccgcccgcttccggaagcgcagatggccgcgatgcaacggatcgccgcgcttcgcggcgaacgtcgccggccatgcgacggccgtgccggtgcgcaccgtgcccggcacgcgcgcggctgcgcctggctgccatcgaggaccgcgaacggcgttcgcggcggcgccggctcgatggctcagtgtttttagcggcagcggcaccacgctttcacgtcgcgcagccccgccggctcgggccgcaggtagccccagtcgccttgcgcgacggcggcgccgttcccgctggcggccggttgatcgtccggctgctggcgcgcatccggcggcgaacggtcgtcgcgtgcgcgatccggctgcgacgcgccggacgacggcggcgcaccggcatggcgccggtgccgcagcacggcttcggccacgcgcgccacatgcgacaccgtcaccgcatcggcctgctccagtgcggcgagcgcgcgcgccgcgcgcaacatcacgaggtcggcacgcagcccgtcgacggccgcgtcgatgcacagcgcgctgacgtgcgcatgcaccgcatcgccgaaatcgagcgtcaccagccgtgcgcgcgccgcgtgaatccggtcgccgagtgcgcgctgcgcggaggcatggcgcgcgcggaacgcctccggatcgagatcgaaggcaagccgggccttcacgatccgctcgcgctgcgcggcgtcgaagcagttctccagttcgaccatcaggccgaagcggtcgagcagttgcggacgcagctcgccctcctcgggattcatcgtgccgacgagcacgaagcgcgcgtcgtgcgcatgcgacacgccatcgcgttcgacgatgttcacgccgctcgcggcgacgtcgagcagcgtatcgacgagcccgtcggcgagcaggttcacctcgtcgacatacagcacgccgagatgcgcccgcgcgagcaggcccggccggaagcgcacgccgttttcggcgagtgcatgcgcgaggtcgagcgtccccgtcacctgctcgtcgctcgccgacagcggcagcgtgacgaactgcccttccggcaacaactcggcgaggccgcgcgcggcggtcgatttcgcggtgccgcgcgggccgctcacgagcacgccgccgagcgacgggtcgatcgcggcgagcagcagcgcctgctgcagcgcgtcctgtgcgacgagcgccgcaaacggaaaaaccgcgcgcgcgcggtgcgtcgtcggatcggtcatcgccgtccccttcctggagttgttcgctgtcgagccagaccgcttcgatccgctcgcgatagtcgcccggctgctgccacaggccgcgctgcatcgcctcgacgaagcgttcgcagatgccgtgcagcgccttcggattgtgccgttcgaggaacgcgcgggtggcgtcgtcgaacaggtacgcgtcggcgacgagcgcgtactggtggtcggacagcacgcgcgcggtcgcgtcatagccgtacaggtagtcgacggtcgccgccagctcggccgcacccttgtaaccatggcgcttcacgccgtcgagccatttcgggttgacgacgcgcgaacggatcacgcgcgcgatttcctcgcgcagcgtgcgcatcttcggcgcgaccgggttcgcgtggtcgccgtggtagatgctcggctgctgcccggacaggtgccgcaccgccgcggtcatcccgccctggaactggtagtagtcgttcgaatcgaggatgtcgtgctcgcggctgtcctggttctgcacgaccacgtcgatcgttgcgagccgctcgccgaacacgtcggccgcggcgtcgcccgcgctgttctgcgcatacgcatggccgccccactggcggtacgcctccgcgagatcggcgtcggtctgccagcggcgctggtcgatcaggtcctgcaggcccgcgccgtagctgcccggccgcgcgccgaacacgcgccagccggcgcggcgccgcgcttcgtccggcgccacgccctgtgcgacccacttcgcgcgttcgcgctcgatgcgcgcgcggatcgggttcagttcctccggctcgtcgagcgcggccaccgcctgcaccgctgcgtcgaacagatgcatcaggttcgggaacgcgtcgcggaagaaacccgatacgcgcagcgtcacgtcgatgcgcggccggtcgaagatctcgatcggcaggatctcgaagtcggtcacgcggtggctgccgtgcgcccatttcggccgcacgccaagcagcgcgaacgcctgcgcgatgtcgtcgccgcccgtgcgcatcgtcgccgtgccccacaccgacagcccgatcgcgcgcggatagtcgccgtgatcctgcagatggcgctcgatcagctgctgcgcggatttcaggccgagcgtccacgcggcctgcgtcggcaccgcgcgcgtgtcgaccgagtagaaattgcggccggtcggcagcacgtcggggcggccgcgcgacggcgagccgctcggccccggcggcacgaagcggccgtcgagcccgcgcagcagctgccgcatttcctcgccgccgcacgcgtcgagcgccggcagcagcgtcgcgcggacgcgctcgatcacggcgagcgtgtgcggccagtcgccgggggcgtcgcgtcttccgcacccgtacggctgccgtcggctgcacacagcctgtccagccattgctgcgcgagccgttcgagccgctcgcgcgtatcgcccgcgtggcgccacggcgatgcgtcgagcgcctgcaggatcgccggtcgcgggccgacccacggcgcggcccagtcggccgcgagcggatcgaaatcgtcgccgagcgcgagatcgcgcgcgagcgcgccgatcagtcctgcgcgtgcgcccttgccgtcgccgaccggaaagcgcgcgagcgccagcagcgtgtcgcgccgctggcgcccggccggcgacgcgccgaacacgtgcagcccgtcgcgaatctgcgcttccttcagttcgcacagccacgcgtcgacgcgcgtcagcagcgcatcctcgtcgcccgcgtcgcgcggcggcgacacgctcagctcgtcgtgcagccggtgttcggcgatcgtcgcgaggatcgtcttgcgcagcagcttcgcgcgccgcgcatcgaccatcagcgcttcgtagtattcgtcgacctgccgctcgagatcctgcagcgggccgtagttttccgcgcgcgtgagcggcggcatcaggtgatcgacgatcacggcctgcgcgcggcgcttcgcctggctgccctcgcccggatcgttgacgatgaacggataaagatgcggcagcggcccgagggtcaggtcgggccagcacgcgtcggacagcgcgacgctcttgcccggcagccattcgaggttgccgtgcttgccgaggtggatgaccgcgtcgatgcgatacgcatcgcgcagccagaaatagaacgcgagatacgcatgcggcggcacgagatccgcgtcgtggtagctcgcgtagtcgttctcgccgcgcgagcgcgacggctggatgccgacgaacacgttgcccgcgcgccagccggcgatcgtgaagcgcccttgccgcagcgtcggatcggcttcgggcggaccccagcgttcgttcagcgcgtcgcgcacggccgccggcagccgcgcgaaatgcgcgacgtagtcggccagcgggaagctctggaaggcggggcgcagcgcatgcacggccgcatcgttggtcacgccttcggtgagccgtgcgatcagcgcgtcgccgtcgggcggcaggtcggccaccgcatagcccgcgtcgcgcagcgccgcgagcacgcgcagcgcggacgccggcgtatcgagcccgacgccgttgccgatccgcccttcgctttgcggatagttcgcgagaatcagcgcgacgcgcttggtcgcgttgtcgagcgtgcgcagcccgcaccagccgcgcgcgagcgccgcgacgaacgcgatccgctcggcgtccggctggtagcgcacgacgtcgacctcggtgtgcgggcagcggtacgcgagcccttgaagctcaccgcgcgcgtgacgatccggccgtcgacctcgggcagcgcgatgtgcatcgcgatgtcgcgcgcatgcaggccctggttgtcggccacccacgcgtcgcgattgccgccggacaggatcacctgcaataccggcgcgtcgccggcgagcacgtcgtgttccgggctgtcgatcgcgccggccgcgaacgcggtcgtgttcagtacgagtgcgacgtcgtgcgtgtcgcagagctgcgtgatgacttcgcggctcaccgcatccttcagcgacgtgaccgcgaccggcagcggattcagcccctcccgcacgagcgcatcggccagcgcatcgaacacggccgtgttcgcggcctgccagtgcgcgcgatagaacaggatcacgacgacgggcgcgccaggcgtccagcgcggccgccagtcgtcgacgctcgcgcggtcgcgcgccgggtgatacagcgcggcggccggcagcgggcgcggcggttcgggttcgtcgccgaacccgagtgtgtggaatgcgatgctgcgcagcagcgcctcggcgttgtgcacgccgccttctcgcaggtagcgccaccacagccggcacaggccgggcgcgacggtgctcttcgcgacgaggttcgggtcttcctgcaggtcgcccgagaacatcgcgagctgctgcgcgcgcttcgacgcgagcgacacggcctgctcgatcccgtacggccagtacgcctcgccgccgagatggtcgatcacgaccgccttcgcgtgctgcaacacgtcgtcgacgtagaaatcgaccgacgccggctgccgcaggaacgtgacgctcgcgagccgcacgctcgggaagccggccggcaggtgcggcacgacgctggcaagcagcgacagcgtcgtgtcggccgagctcaggatcacgatgtcggccggctgctggtcgatccggacgacaccctgcgtatcgtcgacgaagccgcccggcgtggtgcgcagcagatgcatcgtgcgttacgcctgttgcggctcggccgcgcacgcggcgtcgaacgcgcgttgcagcgccgccgcgtcgagatcctcgccgatcagcacgaagcggctcgcgcgggtttcgccgtcctgccagcgacggtcgaaatagctgtcgaagcggcggccgacaccctggatcacgagccgcatcggtgcgccgggcagcgcggcgaaacctttcgcgcggtagatcgtatgcgcttcgacgacgcgctgcagcgcggcgatcgtcgcctcgcgcgtgccggcgtcgccggacacgaccaccgagtcgaaatcgtcgtgatggtggtcgtgatcgccgtcgtcggccgagccgtgatggtcgtggcgcaggtggatcgtttcttccgatgccgattcgaggccgagcagcatcgcgagatcgagctcgccgcgcgtcgcgcgcacgatcttcacctgcggcgggatctcgtcgcggatcgcggtttcgatctgcgcaaattccgcgtcgccgacgagatcggccttgttcacgatcacgagatcggcggacgacagttgatcggcgaacagctcgtgcagcggcgattcgtggtcgaggttcggatcggcgcggcgctgcgcgtccacggcctgcgggttttccgcgaactggccggctgcggcggccggcccgtcgacgacggtcacgaccgcgtcgaccgtgaagctgttgcggatcgtcggccagttgaacgcctgcacgagcggcttcggcagcgcgagcccggacgtctcgatcagcacgtggtcgatgtccgcgcggcgctcgacgagcgcttccatcaccggatagaactcttcctgcacggtgcagcacaggcagccgttcgcgagttcgtagagctggcccgacgcttcgccctgcgcaccatcggcatcctcgcagccgatgccgcaacccttgaggatttcgccgtcgatgccgagttcgccgaattcgttgacgatcaccgcgatgcggcggccttcggcgtgctgcaggatgtggcgcatcagcgtcgtcttgccgctgccgagaaagcccgtgacgatcgtgacgggaagcttgcgtagggtcatggtaggtcctgtgtcgaaaaaggaatcagcccgggatcgtcgcgtcgatggcggcgtggcagttcatctggcggatcgcgggcatgccgccgcgcgatccggacggacagtcgcgggacgggcggaacgacgaatcggacatggtgcttccttgcgaacggtcgacatcgtgaatgccaacacggctgccgccggcccggctcgcgcgcctgccgttcaccgcgccggccggcgcgggttcgcgcagcggcagatcggcggtggaaacgagcaacacgcgggcgtcgggccggctgcggccgtggacgatgcgccgcctcccgcggcgctgaaccccaacgtttgggccggtatccgggctggcgaacacgccgcttcgccttcccggatgcacagcaatccagtggcggtcgtccgcatgcgcgcggcatgcggcgaagcggcgctgcgtggcgcttgcgcgcgacgcgttcgcttaccgttgcgggggcagcacaggttggctcgactgcggcgcaggcaggctccctgtttcccgtttaactgcgcgcaccggagcggcgcgcgcgagcaccaaaacgcgtgcgagtgtaggcggcggtgcggggagcgtcaaggcaaaacgggccgccgggcccggttcggaggaccgccgcgcgcggccggacgccgcgcacggcggttcgcgcgggtggaccgctgtgctatcgtagcgccgcgttcggtgctcgcatgcgcattccgtgcatgcagttaaacgggaaacaggaggcggatcgccgccctgcctgtgctgtccccgcaacggtacgccgcccgcgcgacgcgcttcccgcgcacgcgcccatgccgcccacgatgccactgcccgtccaccgggcgggaaggctgcggcctggcaagcggccagcccggataccggccgacgcaaggggcgagcccgatgctcgccgaacgcccgatccgcggggacggatcgagtgcgcattccgcccgcgtccgcgcgggcttcgtccgatccgtcatgcttcacctgtctgctggccgccgccccgcccgccttcccgtttccactgtttcgacacggtgcgcgccgtgccgcgcccgatgagccgcgcctggctcatcggcgccggccccggcgacgccgacctgctgacgctcaaggccgtccacgcgatcggctcggccgacgtgctgctcgtcgacgatctcgtgaaccccgacgtgctgcgccatgcgcgcgccgatgcgcacatcgagcacgtcggcaagcgcggcggtcatgcatcgacgccgcaggaggtaatcgtcgcggcgatgctcgcgcatctgcgcgcgggccgcagcgtcgcacggctcaagggcggcgacccgttcgtgttcggccgcggcggcgaggagctggccgcgctcggcgccgcgggatttcaagtcgaggtcgtgagcggcgtcacggcgggcatcgccgcgccggccgcgctcggcattccggtcacgcagcgcggcgacgcgcagggcgtgatcttcgtcacgggccacggcgcgggcgccgacgaacccgactggcgcgcgctcgcggccacgcgcatgacgatcgtcgtctacatgggcatccgccggctcgacacgattgcagccgcgctgcgcgaaggcggcctgcccggcgacacgccgtgcgcggcgatcgagaacgcgacgcgccccgaacagcggcacgtgctcgcgacgctcgacacgctcgtcgagcgtgtcggcgcgaccggcatcggttcgccggcgatcgtcgtgatcggccgcgtcgcggcgttcgccaacgatcccgcggtacgcgccgcactcggcggccgcgcgtgatgcgcgtcgcgatcggtgtcggtttccgcgcgggcgtgacggccgcgcaactcgatgccgcgatccgcatcgcgctgatgcggtacccggctgccgaaccggcgctcgtcgccacgctcgccgacaaggcgcgcgcacgcgcgctgcgcacgctgtgcgcgagacgcggctggccgctcgtcgcgttcgacgcggcacagctcgcgagccgccccgaactggccgtgagcggcccgtcggatgccgcgctcgcccgcttcggcgtcgcgggcgtggccgagccgtgcgcgcagctcgcggcgccgcacggccggctgctgggtcccaaatccatccgggacggcgtgacggtcgcactcgccggcccgctctgaaccctttgtttcgctttctttcgacaggacgaatccgatgaaaaccgacgccgaatcccatcaacggatgaccgaacgccgccgcgcgggccacgagaagaagcaggccgccgccgtcaacgaaaagggcctgctgatcgtcaacaccggcaacggcaagggcaagagcacggccgcgttcggcatggccgtgcgcgtgctcggccacggcatgcggctcggtgtcgtgcagttcatcaagggcgcgctgcacacgtccgagcgcgacttcctcggcgcggttgccgagtgcgatttcgtgacgatgggcgacggctacacgtggaacacgcagaaccgcgacgccgacatcgcgaccgcgcgcaagggctgggacgaggcgcgccgcatgatcgaaagcggcgactaccggatggtgatcctcgacgagttgaacacggtgctgaagtacgaatacctgccgctcgacgaagtgctcgcgacgcttgccgcgcgtcccgattcggtccacgtcgtcgtgaccgggcggcatgcgcccgatgcgctgatcgacgcggccgacctcgtcaccgagatgcggctcgtcaagcatccgtacaaggagcaaggcgtgaaggcgcagcgcggcgtggagttctgagcatgcccgcctgccccgcgctgttcgtcagtgcgcccgcgtcgggccagggcaagacgtcggtgacggccggcctcgcgcggctgcaccgccggctcggccgccgcgtgcgcgtgttcaagaccgggcccgactttctcgatccgatgctgctcgaacgcgcgagcggcgccccgtgcatgcgctcgatctcgggatggtcggcgaggccggttgccgcgcgttgcttgccgatgccgcacgcgatgccgacctgatcctgatcgaaggcgtgatggggctgttcgacggcacgccgagcagtgccgacctcgcgactgcattcggcgtgccggtcgtcgcggtgatttccgcgaaggcgatggcgcagacgttcgcggcgatcgcgttcgggctcgcccggttccggccggggctgccgtttcacggcgtgctcgcgaaccgcgtcggctcggcccggcacgccgaactgctgcaacaggcgctgcccgacgacctgcactggctcgggcacgtgccggctgacgcgggcatcgctctgccggagcggcatctcggcctgcaccagccggccgacatcgacgatctcgacgtgcggctcgatcgcgcggccgacgtgctcgcgcagacggcgctcgccgaattgccgcccgccgtcgcgttcgccgaaccggacgccgcggcgccgctgccgcgtgcgctcgccggcaagcggatcgcgattgcgcgcgacgcggcgttttcgttcatctatccggcgaatctcgcgctgctcgaggcgctcggcgcgcggttgcgcttcttctcgccgctcgccgacgaacccgtgccggacgattgcgacgcgctgttcctgccgggcggctatccggaactgcatgcggcgacgctcgcggcgaaagacgccaccgcacggacccttcgcgcgcatgcggcggctcgccggccgatcgtcgcggaatgcgggggatggtgtatctgtgtgaatcgctgaccgacgtcgacggtgtcacgacgtcgatgctcgggctgttgccggggcgggcgacgatgcagcgccggttcgcggcgctcggcatgcagcagctcgatacgcgtaccgggccgatgcgcggccatacgtttcattattcgacgctcgcgacgccgctggaaccggtcgcgtacgcggcgcgccccgacggcaagccgggcagcggcgaagccgtctatcgccacggcgcgatcgtcgcgacgtacatgcacctgtactggccgtcgaatccggaggcggtcgtggcgctgttcggcggcacggcgttctgaccgaaaaacggcgaggcgccgcgatgtcagggtttttcgcggcccggcgcttccgagcgcgaagtgcggatcacggtgccgtcgggcgagaaatgcgcgttgaacatcgcgtcgcccgatacgccgccctcggcccagtgccagctccacacctcttcgtggctcagcgcgtattgcgcgatctcggtcggcttgccgagcagttggcgcacgtcgtccttcgacatcccgggcacgaccttcgcgatgttcgccgccgtcagcgcctgcgtgatcgacacgagccggccgtcgggcccgaaatcgagcatgtaggtgctcgtgccgtacgggccgcgcggatattcgaaccgctgcgagccgtcgtcgccctgcctgaccatttccggcttgcccgcctggcggagcacgtcctcggtcgtcgacacgcccggctgcagattgccgaacgccatcggatcgggcttgatcgcattcaccgcgtcagccactttctggtcgtcgcacccggctgccagcatggcgaccgcacaggcggtcagcacggtcagaagctgttttcgcatttcatccacacctgtattcatcgcgccggtccggcgtcgcgcgcagcgtagcacgcgacctgttccgtcgatgtcaaggagcgtcaaatgcggtcacggccgccgcgaccggttttgcaggcgtggcagctcgcacgccgccgcgccgccgcatcacaccaggaacgcctcggtcagcttgacccagtacgacgcgccggtaggcagtgccgcgtcgttgaagtcgtagccggggttgtgcaccatgcagccgccctctccgtcgccgttgccgatgatcaggtagcagcccggccgcttctcgagcaggaacgcgaaatcctcgctgccggtgagcggcaccatcccgtcgatcaggttcgcttcgcccacccactcgcgcgcgacgccgcgcgcgaacgcggtcatatccgtgtcgttgacgagcaccgggtagcggcgctggtagtcgatcgtcgcggtcgcgccgaacacggcggcctgcgcatgcacgacttccttgatgcgcgtctcgagcaggtcgcgcacctccggcttcagcgcgcgcaccgacaggcgcatctgcgcgcgatcgggaatcacgttcggcgcctcgcccgcgtggatcgcgccgaccgtgacgatcgccatgtcgagcggcgacacgttgcgcgacacgatcgtctgcagcgcaatgacgatctgcgcgcacacgaccaccgaatcgaccgccttgtgcggcaccgcgccgtggccgccgcggccctgcacgtcgatgacgacggtatcggacgacgccatgaacggccccggcaggaagccgaatttgcccgtggggaaccccggcatgttgtgcatcgcgaagatcgcgtcgcacgggaacagctcgaacagcccttcgtcgagcatcttctttgcgccgccgagcccttcttccgctggctggaaaatcaggttcagcgtgcccgagaagcggcgctcgcgcgcaagatgcttcgcggcggcgagcagcatcgccgtgtggccgtcgtgaccgcatgcgtgcatcttgccggcgatcttgctctcgtacggcaggcccgtggcctcgtggatcggcaacgcatccatgtcggcgcgcaggccgaggcgctgcgtgccgttaccgaccttcagctgcgcgacgacgcccgtgccgcccagcccgcgatgcaccgtgtagccccacgactgcagttgctcggcgacgaggtcgctcgtcgcgaattcctcgaagccgagctcggggtgggcatggatgcggtgccggatctcgatcatttcatcggcgaggcctgcgggaatcacgctgtgcgtcacggtgtcgtctcctgtttctgcggggaatgtgcaggcaaggatagtcggttcgccggcaaccgggcagacgaaaagtcgtcgcggtagcaaccaacggttgccgtttctggtaccgcgcacgatatgagttaaccggccatccgggtgactgccgcacacggttcgggcgcgtgagactgtgggcttgacagcgatttgacgagcgccaggattcgacgatgaccgttcgagcatccagaataatgccgacacatcaatgtgttacagacaattgttcatttttgacgcctgtacatttttgtgtacgctgatgaggaagtgaacaagcaatcgcctccgatgcccgagaacgcccccttccgatgtcggaacagcacgtgctcgacgaagcctgcgccgcgttcgaacgcgcgacccggcgcttcggcgcgcggcccgtgcgcgtgccggccgcgtatgccgggcaagccgacgcgatgatccgcttcgacgttgccgggcacgtattcgagatgccggccgccgtgagcctgcgcgtcgaatcgctgccgggcgcactcgcggcactgcgccgccgcggcggtgcgaccacgacacccggcgagcggccgctgatgctgatcgcccctatctttcggccgaactggccgccggcctgaccgaccagggcatcccgtttctcgacaccgcgggcaacgcatgcctgatccagccggaagcgaccgtgatgatcgcgggccggccaaaacccgcacgcacgccgcgccggcaggcatcgcgcgcgacgacgccgaaagggctggccgtgatgttcgcggtcgcgacacagccgggcctcgtcgcgcagccgtatcgggcgattgcggccgcatcgggtgtcgcgctcggcacggtcaaccttgcgatggacgacctgatcgcgcgcggcctcgtcgggcagcgccgcaatggcgagcgcctgatacccgactggccgcgcttcgtgcacgaatgggttgcgctgtacccgagccgcctgcgcgcgaaactgccgagccgtcgttatgccagcctcgcgcccgactggtggcgcgatttcgatttcgcgtcgttcgatgcgcggctcggcggcgaaccggcggccgacctgctgacgcacgatctgaagccggccgagatcaccgtctatacgcacggcgcggcatcgaaccgactgctgctccaggcccgcctgcgcccggacgaccgcggcgacgtcgaaatcgtcgaagcattctggccgcactcgcccgcgctcgattggcacgagccgcgcatgccgctcgtaccgccgctcctgatctatgcggatctcgtctcgtccggggacagccgcaaccttgccgccgccgaacggatccatgaccgatacctctcccatccgcccgcttgaaatcgacgcacgccggccgctcgacccggcggcggtcgcgctcttgcaagcggtgagccgtgcctgcgcgcgcgtcgatgcggccttcgtcgtcgccggcgcaaccgcgcgcgacatcctgatgtggcacgtccacggcatccggccggtgcgtgcgacacgggacgtcgacgtcgcggtgtgcgcggtgagctggccgtttcacgcgcagctcgtcgatacgctcgttgcgaccgggcaattcacgcgagcaccgaaacaacagcagaaactgctgttcgacagcggcacgcatggttttcgcaccgaactcgatctcgtgccgttcgggccgctcgaaacgccgccgggcgcgatcgcgtggccgccgggcggcgaattcgtgctgaacgtgctcggtttccaggaagcggtggacaccgcgcagccggtatcgatcgacgcgcgcaccgtcgtgccggtggccagcctgccggcgctcgcgctgctgaagctgctcgcctggaaggaccggcgtgcacgccagaacagcgatgcgtacgacctgctgttcctgctgcggaattttcacgatgcaggcaatcgcgagcgcatctgggacgccgcccccgacctgctggagctgcacgcgttccagcccggccttgccgccgccgcgctgctcgcgcgagacgcgaaacggattgcctcgccgcacacgcgcgacgcgatccgcgtgctgttgtccgacgaagcgacctatgccacgctcggccaggatctgctggcacgtgcgttcgcgctgttgccgggtgaattcagcgatgacgccaaccggtatctcgacgcattccgcgacgcctttctcgcggattcacccgcaccgcacgcatgacacgacgctgtggatgtgaagccgcgacgtcatcccgctttcgcactgccgcgctcaggccgcccagtcttcgagcgacaacccggccacccggccgaactcccggccgttgttcgtgacgagcaccgcaccggcggcgatcgcatgcccggcgatcgacgcatcgttcgcaccgatcggcgtgccgcgcgcggcgagatcggcgcaaatcgcggccgtcgcatcgacggccgccgtatcccacgacagcacgccatcgagccgcgagacaaaggccgtcacgagttccgcatgcttcggcgacgccttcctgccgactgcgccgaaccgcatttcggcataagtgatggccgacacgacgatccggtgctgcgcattgacgcacgattgcagccgcgacagcactaccggcggccgctcgcgcatgatgaacgaacagatgttcgtatcgagcatgtagagcgtggtcactggccggactccgtcggcgcggcgccgccggaaaggtcgaagcggccggactcgatcacggccgggcgttcggcgaggaaatcggcgtcggccagcggttcgctcgcgaacgagagccacgtgggccgcaccggccgcagcatcagtgtgtcgccctcgcggcggatctcgagttccgtcacccctcgaactccatgtccttcgggatgcggattgcctggttacgggcgttcttgaaaatggaaacggtgcgcatgagccactccatgggagtacgatgcgcccattctagacatatgccagcatatgtcaaattgagaggacgcaaatcggacgtcgcgccccacgctgccacgggtgtttttgtcatgttgccggcctgtcgtcgatgaggagagcgatccattcttcacgacgcaggccacgcagtccatatcccgaacggccgatgccggtgcggcaccgcaccgcgcgcaacgtcgcaccgacgctgcgcacccgcgccgtcacggcaaccggaaagtgtcgaagaatgtgtctcgctcgatcacggtgagcgccgcgcgcttgtgcgggaagtcgaactccttcagcgtgtagaacccgagccggtgcatgtacgcgatgtgccgcacgtgatcgacgcgcggctcgccgacgagccgctgcgtgcgcggttcgtcgacgaacatgtagtgcagcacccgctccaccatgcatgcagcttgccggcgctctggaaccgcgagtcgccgatcagcaggtgcagcccgcgatcgtagtcgtgcgcatcgtagaacggcgcgagacgatcctccttcgcccagtagaactcgaaatagccgaacggcgtgtcgtcgaaatagccgatcatcgggtgcatgtgcggatcggcgagccgctcggcaagatacgccgcgtgctcgtcgcgcgtgccgcgctggtcccagaaatgcgcgacgcgatcgaggttcatccagccgctgaacaggtccgcatgcgcgtcgatgtcgacggtgcgcaggctgaacgtcatcccgacctgcggcatatggcgtgcatagatctcgccggccggcgacggcggccgcaccgggtgccggtgcccgttcgtgattgcatggcgcagcggcatcccgcccgacgcgggcgccttcagccacggtcgcgggttctgccagaaggtcgtgcgcgatacggtgaaccgcagcgtgtcgccctcggcctgcgcgccgtcgatcacgccctcgcgcaccgcgcgcgccacgtacgacgcaacagccgccgcatcggcgccgccgagcggcaccgtgatcgtcgccgcgtcgtatcgcgtgtcggtgttgaagagcgcgacgaacgccgcgagcagtgcctccggcgaatcgtcgggccgccacgcgtcgagcgagcgctcggcgaccatcatcgccggcccgtgcgcggcgccgtcgagcgccgcggccacttcaccttcgacggcgtcggcggcgccggccggtttcgtcagcgtgtcttgcatcacagtgctcccgcgtcgtggcgatcggcgagaacgtgcagccccgctcgagcgccggaaacaggctgcgctggaagttgttccagcgcagttcgagaatcgtgtcgtccggtgcgatcggcgtgtcgagcacgtcgcagatcacctcgccggaatcgatgccgttgtcgacgtagtggaacgacgcgcccgtcatcatcacgggctcgacggacgacgtcgcgccgctcgcccagtcgacccgttcgccgcgcgcgccgtgcagcgcgtcgagcgtcgcccatgcgccgcgccgctggtacggcgaaccgtcggcggtgatgcccgggtggatgttggcgatgcgccggtgaaagcgcgcgccgggccgcacgagctcgtcgaggatcacgagcagcccgtcgagcacgacgacatcggcttcgagttcgagcaggcgctcgagcaggcggcgctcgaacgcctgtttgccggctgcacgctcgcgtgcgtcgcgcggcagccgccggtacgtcgacgcaatcgtgcagaacagttcgtcgaccggccggccctgcaccgtcaacccttccggcaggatccacgggcggcccggcgtgcgcgcgaaaccgtagtcggccaccttcgcgcggtcggccggcgaaccgtcgtcgtcgtcgacgatcacgcccttgagcgtgtagcgctcgccgagcggcgagtcgttcaggcgctcgacgaggaattcgagcggcgccttcatgtagcgcgtgccgccctgataagcgaccggctggccggcgcgatcggccgcgccgttgcgcagcgactggatgtagacgagatttttcttcggcatggatgcgtcgtggaaaagcggacgaaggcgccgcggccggcccgcaccggccacgaaagccggccggcgggccgcggcgcgcatcgtcaccagttgtatttcgcggtcgcgatcaccgtgcggtcggtgccgaacacgcagacgttcaccgactggcagccgctgatgtagtggcggttggccaggttcgtcgcattcacggcgaagcgccagttgcgcgtgtcgtagtgcacgcccgcgtcgaacagcgtgacgctcgacaccgtcagcgcgttgtcggacccaccggccgacgcgctctggtagcgaacaccgccgccgaagcccagccccgcaagcgcccccgtatgccacgtccagtcggcccacagcgacgccatctggcgcggacgcggaatgtcgaccggccagttgttcagcgagttgtcgttcgccttgatgaccttcacgtcctggtagacgtacgaggcgatcagcgacaggttcggcgtgaccttgccggtcgcactcagctcgatcccgcgcgaacgcacctcgccggactgtaccgacttggtgccgctgtcgtcctggctcggcagcgccggcgtgatgccgttggtctggttgatctggtagatcgccgcgttcagcatcaggttcttgccgggcggctgccagcgcaggccggcctcgatctgcttgccgcgcgtcggctgcggcagcccgccgccgagcaggttcacaccgatcagcgggttgaacgaagtcgcgtagctgatgtacggcgacagcccgtagtcgccctggtacgtgaggccgacgcggccggtgaatgccgtcacgtccgccttcgtcgacgtgccgcccgcgcggtcgtccatccgcatgttgacccagtcctcgcggccgccgagcgtcagcgtccagcggttccacttgatctggtcctgcgcgtacaggccgaacgtgttcatcgccgtgtacgtgttggtgcgacccgtggtctccgggttggagaacaccgacgtggtcacgggcgtgtacaccgggttgtagatgttcaacggcggcgcggcggcaatccactcgctgtcggttgcggtctgccggttgtactggaagccgagcagcagcgtgtgctgcagcgggcccgtcgcgaagcggccctcgacgttgttgtcgatgtcgaagcggctgtagttcatctggaacacgccggcccagcggctgacatcggtcgtgctgccgtcgacgaagccgttgccccacaccgaaccgttgtcgagcgacaggtgcatcaggcggacgttctgccggaacgtccacgccgaagtcaggttctgctcgaactggtagccgaccgaccactgcttcttgcggtagtagttgaagttcgggtcgccttcgtacacgtccttgttgatctggccgttcgggttcggcagcaccgtgccctgcgcgggcaggaagttcgacgagatgtcgccccagtcctgcaggtacgtcgcggacagcgtcagcgacgtatccgcattcgggcgccagcggaacgacggcgcgagcgcgacgcgctggtcgttgttcgggccggtcagcgcattgccgtcgcgcgcgacgccgacgaaccggtacgcgtacttgccgtccgggtcgagcttgtcgcccacgtcgatcatgaactgcttgcgcgcgtagttgccgatctgcacgccggcctcgcgcacgcgctcgccgtcggcgagcttggtctgcacgtcgatgatcgcgccggggtcgcccgcgccgtacagcaccgaggtcggcccgcgcagcacggtgatgctgtcgatcatgtacggatcgacgcgccagctcgcgaggttgatcgtgttcggcacctgcagcccgttcacgtaggcggtcggcgtgaagccgcgcagtgccgcgtaccagtcggaacggttgtccgaaccgtacgacgagaaacccggcacgtagcgcagtgccgcgttcacgtcggtcgcgccggtcatctcgatctgctgcgcggtgacgacgttgatcgtctgcgggatctcgttgatcggtgtatcggtcttcgtgccggtccggctgcgcttcgcgacgagcccgaccgtgccgtccccttccgaggccgcgttgacgttgatcgtcggcagcgtaccggtcgacgcactggccgccgcaccgccctgcgcactgctggccgacgccgcggcgcctgcgttcacggccggcgccgtctgggcatatgcctgccccgccgccgcaccgaacgccacgcttgccgcggctgcgatcgcacgcaaacgcgtgcctgttgcccactccatctttctcagctccactttttcatgcggtctccgaccgcgcctttgtcaaagagcgaaagccatccggcccgcgctcaccccgttttcttgtcttgccttggccgcgccttcgtcatgggcgggcgcgatcccgtcttcgagcgacgcgcagatttcgtccgcgcggcgtgccagcaccgacagcagcgtgtcggacaatccatggctgtcttcgcagcagccttgcaggtagatgcgcggcgcgaagtgcgcgggcgtcgcgagcaggtagtcgcgcgtcacgtcgccacgctcgagcgcatcgcccaggtgcggcgcgagcccttcgagcagcgccgaatgggtgtcgcggcggtagccggtcgcgagcacgagcgcgtcgaagcgctcgacgcgcgtcgccccgctcatccggtcgcgcaacgtcagctcgatgcgaccgtcggcggtgcgcgccgcgccctcgatcgcgctgttcgcgagcagcgcatgacgcggcgtgccgtcgatgcgctgcaggtacagcatttcgtagatctgttcgatcagcggccggtcgaccaccgcgtagttcgtgtcgcgatagcgctcgagcagcgcgcggcgcgcgtcatgcggctgcgcatagacgacatcggtgaattcggggctgaagatctcgttgacgaacgggctgtcgtcggccggcagagcgcgcccgcgcgcatcacgaggctcgcgtcgacatgcgggaagcggcgcgcgagatcgatgaacacctcggccgcgctctgccccgcgccgatcaccgcgacgcggcggcgctcgccgtccggcgacgcgacgagccggtcgatgtcggtcaggtaggacgacgagtggatcacgcggtcgcggccgagcgcgacgaacgcgtccgggatcgccggcgtcccgccgacgccgaccgacagcgcgcgcgtgacgcgctggcgctcgtggccggcggcgtcgcgcgacaacacgcgcagcgcgtcgatccgcgcgccgtcgccgcgcacgggctcgatgcccagcacggtctcgctgtaatggacgcgatcatcgaacgcgtcggccacccagctcaggtagtcgtggaattcgacgcgggtcgggtagaagttcttcaggttgacgaattcgttcagccggccgcgttcgaacaggtagttgatgaacgtgtagcggcttttcggatcgcgcatcgtgacgagatccttcagaaacgagatctgcatccggcagtcgtcgagcagcatcccgcgatgccagccgaattcaggctggcgctcgacgaagcaatgggcgaacgtacgtgcgccgccgcgctccgcgaggcgcacggccagcgccagattcgacggcccgaagccgacgccgatcaggtcgaatacggtttctctctgcatgtctcagctcccttgtcggtgaatccggcccgtcagacgtgacggccggagaagaacgtctcgcgcagcgtgcgcatccacagcggctgcgcgtcggccagcgcgagacggcgctgccgcgcgaagccatgccgcgcgagatggtcggcaacccgcgcgtggccggccggaacggcacagccgaccgcttcggtacgcgggtcgtcgagaaacaggtaatgaacgacggacggcagccagcccgccacgcaatgcgggccgcgccagcgcgattcgccgaccagcatccgcagcccgcggtcgtagtcgcgcgccgcgacgtgcggcgcgagcgcgtcttccttcagccagaacgcctcgaaatacgcgaacggttcgccgtcgaagcagccgacgagcggtatgacgtgcgggtcggcatccggcgcggcaccctgcccgccgtccacgccaggctgcgcgcccggccagccgtcgcgcacgcgcggctcgtcgaaccagcgcgcgacgcgttgggcatcctcggccggctgccagccgcgcagcgtgaagcgcacgccgagcgccggcaggtcgcgcgcatagacttcgccgcgcggcgccggcggccggcgcgggtggcggcggccatcggtgaacaccggcagcgtcgcgcacggcagatgcgggccgacgagccacaggtcggcctgctgtgcccagccttcgcgcatgcaacagccggcgtcggcgagcacgccgctcgcgcgcagcgcatcgagcgcgaccgccggccacgcggccgggtcgagccggatcgacgcgtggcgcgcgctgtcggaaaacgccgcggccaatgcggccagcagcgcacgccgctggtcggccggcgacgcgcgatggttgtatgcgacgaggcgcagcgcgccgtcgtcgccgagttgcgcgcgcaacagctgcgcgccgatgccgtcgccctgcgcgacgcggatctccgcgccgtcgcgcacggcgaacaggccgtccgcgaacgcgaggcggtaggtatcgagcatcgtgaatccgtccggacgcacttcagccagcatggcgttcctcctgtcccgtttccgtgcatgtgtcgagccgcgcgccgagtgccgcgaacgtcggcgacgcgaacaggtcggcgaccgtcagcgcgtgaccggcccggctggccgcgtcgacgaagcgcacgacgtcgaacgacgtcgcgcccgcttcgaacaggtcggcatcgggctcgggcgcggccgtcgcgaacgtgtcggaccacagcgccgcgagcgcggcagccgcatgcggtgcgcgcgacgacgttgcggcgcgtgcgtcgcctgccgcgggcgcgcgcggcgacgcttgcgcagcggcatgcgtgtcgggcgcgccgagcgcggcttccgacgcgccggcgaagcgcgcgacttcgtcgtggtaaacgtcgacgagcgcatcgacgaagcggcggtcgagcagttcgtccgcatacgagaacgcggcgctcacgcgcccgtccggatgctcgacgacgtccagctccagcgtgaacacgacgcgatggcgtacctcgtcgaacccggccagcgacaggccggcccagtcgcgcgcggcggcaccggtcgggcgcaggtagttgaacatcacctggaacagcggattggcctgcgcggcacgcggcgcgcgcagcgccgcgacgacgtccgcgaacggcacgtcggcgtgcgcataggccgcgagtgccgtgtcgcgcacctgtgccagcacgtccgcgcgacgcgcggccgggtcgatccgcgtacgcacgacgaccgaattgatgaagaggccgagcgcctcgcgggccgcgtcgcccgtcagctcgcgcgtcgacgcgagcacgccgaccggctggtcggccgcacccgtcgcgcggaacaaggcggtgttgagcgccgcgtgcagcagcatcggcagcgtcgcgtgcgcggccgacgccgtatcgcgtgcggcgcggatcaacgcaccgtcgaattcgaacgcgatgcgcgccgcgcgccattgcggcacggccggcgcgttggcgcgctgcggcagcaggcgcgccggcaggccggccagcgcatcgcgccagtaagcaacgcgggccggatggcacggcgcgggcagcacgagcggccgggcgaccggctgggcgatctcccggccgccacggcaccgccctgcatgcgggcgacatagcgcgcgcgaaccgcatcgagccacagctcgatcgattcgccatccgacacgatgtgatgaatcgtcagcgacagcacgtgatcgtccgcgccgagccgcagcacccgcgcgcgccacagcggcgcatcggccgcgaggtcgaacggcgcgagcgcatcctcgtcggtcagcgccgccgcgcggcaagcacatcggcttgcgccgacaggtcgatcaccggcagttcgacggaaacgcctgtgtcgatccgctggcccggcagcgcgccgtcacgcgccacaagccgcgcgcgcagcgccggatgcacggccgcgacatccgagaaggccgcacgcagcgcatcgacgtcgagcgggccgcgcacccgcagcgcgaccggaatgttgtacgcggcgctgtccggctgcgcgcgccacaggaaccacaggccgagctgcgccggcgacagcggccacacgccgtgggcgtccggttgcgccaccgcaacgcccggcgccgcggcaccggcatgcgcggcgcgcggcgcatcgaccacctgacgcgcgtactgcgcgagcaccggcgcttcgaacagcgcgcgcaccggcacgtcgcggccgagccgttcggccacgcgcgtcgcgacgcgcacggcggcgagcgaatggccgccgagatcgaagaagtgatcgccccggcccacacgctcgagattcagcacgtcgcaccagatcgccgcgagcgcggcttcatcgccgtcctgcggcgcttcgtacgcgcgttcgacgcgcacgggcgccggcagccgtgcgcggtcgaccttgctgttcgcgttgcgcggcagcgcgtcgagcacgatcagttgcgcgggcaccatgtaatcgggcagcgtgcggcgcaggtgtgcgtcgagcgtcgcggcttcgaccggctgcgcggccgcctgggcgtcggcggtcagctcgacgtacgcgacgagctgcgcgagtgcgccctgcccgtgcacgaccgcgcatgcttcacgcaccgcgtcgtgtgcggcaagctgcgcctcgatctcgccgagttcgatgcgcagcccgcgcagcttcacctggtggtcgacgcggccgatgaagtcgaacacgccgtccgcgcgacgccgcacgaggtcgcccgtgcggtacagccgcgcacccggcgcgccgtacggatcaggcacgaaacgctcggccgtcagcgccgggcggtcgagatagccgcgcgcgacgccgatcccctcgccgcccagatacagttcgccgatcacgccgaccggcagcggatgcagccgctcgtcgagcacgtgcgcggtgcgtgcgccgaccagcgtaccgatcggcaggtacgcggcgtcgccgagtttcgcgagatcgtcgccgggccggaacatccatagcgtcggcgtgatgaccgtctcggtcggcccgtagccgttgaccacgcgcacgttcggcagcgcgcggcgcagcatcgcgaacgcctcgcgcgacgtcgcttcgccgccgacggtcagcgaccgcagtgtcggcggcgcgccgtgcgcgagcgcccattcggcgagctgcgcggcgcagccgggcggcacgtaggtcatcgtcacgccgtcgcggaccatcatcgcgcaggtctgcgcgggcggcctaacacatcagccgtcaccgacacggcggcgcccgacatgtattgcgagaaccagccttcatgcgcgccgtcgaagttgaccgactggaacagcaggaacacgtcctgctcgcccgcgccgtagcgctcggcgatcgccgcgcaatgcagcgcgaacgatgcatggtcgacgatcacgcccttcggcttgccggtcgagcccgacgtgtagatcgcataagccgcatgccccggcagcacgtccggcagcacgacgtgcgccgcttcgtcgagtgcagcgacttcatcggcgcgccacacgcgcagcgccggcagctcgggcagcgacgcggcgctcgcgccgtcggtcagcacgtgcgcgatgttcgcgtcgccgacgatctgcgtgagccgttcgcgcggatgagccggatcgagcggcacgaacgcggcgcccgacttcaataccgcgatcagcgcgacgagcaggtcgaccgagcgctgcagcgcgacgccgactcgcatttccggccgtacgccggccgccaccagatggcgcgccaggcgggccgcgcgcgcatcgacttcgccgcgcgtgaacgcacgatcgatatcggcgacgccgcgcgcgtcgggccgtgcctgcgcatgcgcggcgatgcgtgcatgcacgggcacgaacggctcggcatcggtcgcgccggccggcgcgttccatgcaggagctgcgcgcgctcggcggcgggcagccagtcgagatcgccgaccggcatgtcggggcgcgcgagcgcatcggcgagcagcgtgacgaagcgcgcggccagccgttcgatcgcatccgcatcgaacaggtcgagcgcgtagatgaacgcggcgtcgaacgtgccgtccggcgtcgcttcgaccgacagcgtcaagtcgaatttcgcggaaggcgtaccggacggcagcaacgcggccgacgccgcgccgagcgccggcaacgcgcgacgctcgccgtacgcggccatcacctggaacagcggatggtggctcgcgctgcgcggcacgccgagcgcgtcgaccacctgctcgaacggcacgtcctgatgcatctgcgcgtcgacgagcgcacgctgcgtgcgcgcgaccagcgacgagaaatcgccgtgcgcgggcacgtcgacgtcgatcgccagcgtgttgacgaagaagccgatcaggccggcgacttccgcgcgttcgcggttcgcggccggcacgccgacgcagatccgcgcatcgcccgtcgcgcgcgcgagcagcgcatcgagcgcggcgagcagcaccgcgaacggcgtggcgcccgatgcggccgcgaacgcgcgcagttgcgcgccgatgcgcgcgtcaagcgaaaacacgtggcgagcgccgcgcgcactgcggcgcgcgggtcgtgcggccgcgcccggcagcgtcagcacaccgcgctgcggatcgagccgttcgcgccagaacgcgagctggcgttcgcgctcgccggcgtcgagccagcggcgctgccacagcgcgtagtcggcgtactggatcggcagcggcgcgagcggcaccggccggtcggacgcatacgtgcgatagaacgccgcgagttcctcgagcatcacgcccgacgaccagccgtccgacacgatgtggtgcacggtcagcgcgagccagtgatgcgtcgcgtcgaagcgcaccaggtgggcgcgcacgagcggcgccacgccgagatcgaacggttcggcttcctcggccgtcgcgacggcttgcgcgcgcgccgtgcgctgcgcgtccggcagcgcttcgagaccggtttcgcgccacgggcagcgcatcggcgcgtggatcgtttgcgcgacgccgtcctgcgcttcgtcgaaggtcgtgcgcagcgcctcgtggcgcgcgatcagcgcgtcgcatgccaggcgcaacgcgtgcgcgtcgagcgggcccgtcagcgccaggcgctcggtgatgtggtacgcgtccggcgcatcgatcagccgcgcatgcagccacagccgcgtctgtgcgaacgacgccggcacgcggtcgctgcgcggcgtgcgcggcgggatcggcagcacgcgaaaatcgatgccggccgcgccgagcttgtcgatgaacaccgcgcgctgcgcgtcgggcagttgcgcgaaacgcgtcgcgagcgccagccagtcgggttgaaccttcgtcatccgtcgtccttattgggtttccagttcgccgagcagcgcgtcgatcgcgctcgccgcatcggtcgcgccgcgtgccgcgcaggccgcatcgatcgcttccgcgcaacgcgccagcgtgcgcgtgtcgaacagcgtgcgcagcgacaacgcgagccccagtgcaggttcgcctgcgcatgggcctgcgtcgcgagcagcgaatggccgccgagcaggaagaagtcgccgtcgcggcagatcgcgtccacgtgcagcacgcgttgccagatcccggcgagcgcgcgttccgtgtcggtcgcgagtgccgcttcggccgccgtctcgcgtaccggcgcgggcagcgcatggcggtcgcacttgccgttcggcgtgacgggcaacgcgtcgagttcgaccagctgcgacggcaccatgtaggccggcagttgcgcgcgcagcgagtcgagcagcgccgcccggtcgagcggggccgcatcgccgcgtgcgacataaccgaccagttgctcgtcgcgcacgatcacgaccgcatcgttcacgccaggcaccgcgcgcagcagcgcctcgatctcgcccggctcgatccgctggccgcgcagcttgacctgcgtatcgacgcggccgaggtagtcgagcgcaccgtccgcccgccgtcgcgcgaggtcgcccgtgcggtacatgcgcgcgcccggtacgaacggatcgggcacgaagcgctcggcggtcagcgccggacggccgagataaccgcgcgcgaggcccgcgcccgcgagatacagttcgccggtcgcgccggccggcaccggctgccatgcggcatcgagcacgtgcaattgcaggttcgcgatcggatggccgatcggcaccgcgaccgcctgcgcgtcgtcggggccgcacgtccagtgcgacacgtcgatcgcggcctcggtcggcccgtacaggttgacgagcgtcgcgtgcggcagcagccgcgccattttctcgacgagttcgggcgcgagcgcctcgccgctcgcgacgatcaggcgcacgctgtcgcattgcgcggcggccgcgaaatcgtcgagatgcgcggcgaacgcggcgagcatcgacggcacgaagtgcagcaccgtcacgccgtgcgcatggatcgcggccgcgagacgcgccggatcgcgatggtcgccgggcgcggcgatcgcgagcttcgcgccgatcgccagcggccacacgaattccacaccgacacgtcgaagccgaacggcgtcttgtgcagcacgacgtcgtcgcgcgtcagccggtacgcgtgctgcatccacgcgatccggttcgcgagcgcgccgtgcgtgttgccggcgcccttcggcttgccggtcgagccggacgtgtagatcaggtaggcaagctgtgcgtcgtcgacctcggcggtcacgccggcggtgtcgtcgaccgtttcgtcgaccgtttcgtcgacggtttcgtcggccagcaggtccgcgaccgtcagcagctgcgtcgttgcaccgtcgcccagcgccgcctcgacctgctcgcgcagatgggcctgggtgatcgcgacggccggccgcgcgtcgcgcaacagatacgcgatgcgttcggccggatagtcgggatcgaccggcaggtaggccgcgccggccttcagcacgccgaccagcgccatcaccatgtcgaacgaacgctcgacgcacagcgcgaccggcgtatcgggccgcacgccgcgccggcgcagcgcggccgcgatgcgcgacgtaccgacgtcgagctcgcgataggtcgcgcgatgcacgccgccgtgaacgtccgcgtattcgagcgcgatcgcgtcgggcgtcgcccgcgccgcatcggcgaattgcaggtgcagcggctgccgttgcgaagccggccatgtgcgcgcggtgtcctgcgcccgcgccagtgcgtcgcgggtggcgtcgtcggcgatcgacagtgtgccgagcagcgcatccggcgtgcgggccagcgcatcgagtgcgcaggcgaacgcgcggtgccaggtttcgacctgccgcgcatcgacgcgcgcggtgtcgtagccgtagtcgatcgtcagctcggcgccgctctcgatcacgagcgtcagcgcgaaatcggtggcttcgatgctgcgcacgccgttcaaaaccagcgcgcgcggatcggcatcgcgcgccgtgtcgtcgaccggatagttctcgaacacgaccagcgtgtcgaacagtgcgccgcccgcgccgcgcgcccagcgctggatgtcggcaagcggcgtatgcgcgtgctcggcggccgccgcgttgtcgcgttgcagggcttgcagccagtcggccgcgcgttgctgcggcgccggcgcggtgatcaccggcaccgtgttgatgaagaggccgagcaccgaatcgacgtccgcgagtgcgtcgggacggcccgcgacggtcgcgccgaacgcgacggccggctggtgcgtcatccgttgcagcgcgagcgcccatgcaccctgcaccagcgtgttgacggtcagcttcagcgcgcgtgccgtctgcgcgacacgcgtcatcgcgtcggcatcgagcgtcgcgcgccacgtgaccatgtcggcatccgcacggtcggccgtgcggtcggcgatcagcgtcggggcgtcgagtcgtgcgaggcgttcggtccagaagcgttcgtcggcgtcgcggtcgcgcgtgccgagccaggcgatgaagtcgcgataccggagtgccgggcggctcgcgaacggcgatacggcgtccgggtcgcgatagtcgcgcagcacgtccgccagcaggcgcgcggtgctccagccgtcgagcagcacgtggtgacgcgtccacacgacgcgccatgcgtcgtcggtcacgcggatcagcgtgaggcgcatcaacggcggctcgcgccagtcgaagccgcgtgcgcgatcggccgcgagccatgcgtcgaaatcggcgtcgagcgtgtcgccgcgcgtgcgccagtcgagctgttcgaccggcatccgggcgtggcgatgcacgcactgcaacggcgcggcttcgtccggcatcacgctcgtgcgcaggatgtcgtggcgcgcgatggacgcttcgaacgcggcgacgagccggtcggcatcgagcgcggccgcggtcgcgacgagctggttcacgtagctggcgtgaccgggtgcgaacagcgcatggaacaggatgccctgctgcatcggcgacagcggatagacgtcgtcgatcgtgcgccagtcgagcggcgtgcgttcgatcgcggcctgcgtgagaccggcggcctgcgcaagcggaaatcgcccggcgtcgcgccggcgccgcgatgcgcgacgcgtgacgcacacgcgtcgacgagctcgcgcagcgccgccgcgaagcgttcggcacatgcgtcgatcgtcgtgcgctcgaattgcggtgcaccgtagacccagtgcactttcagcgtgcgtgcgccgtcgcgatccgtatcgaggtacgcgtggatcgcgagcgcattgccgagcggaccttgcggatcgcgctcgacgccggtgccgccgaagcgcggcacgagcgtggcatcgcgcggggcgtcgaactggccgagatagttgaacgtgacgcgcggacgcggcacggcggcgagcaccgcgcgcgtcgccgcatcgccgtagtgcgcgagcacgccgaagccgagccccttgtgcggcacggcgcgcaacgtgtccttgaccgcgcacagcgtgtcgcgcgcggtggccgcgaccggcagcgtcaccgggtaatggctcgtcagccagccgatcgtgcggctcgcatcggcatcgtcgaacagcgcctcgcggccatgtccttccagttcgatacggcacgaggcggcgccgctggcgccggccagcgccattgcgagcgcggcaccgagcaattcgatcgtctgcgtgcgataggcggcatgcgcatcggtcagcgccgcgcgggtcaatgccgcgtcgatcgtctgcacgacgacggctgcatcggcgttcgttgccgtggcgtcggggtggtcgggcacaacgtcgtcaccctgcgccatgccggcccagtacgccgcctcggccgcgaacggcgaagccggttccgtcgccgcacgggccagccgcgacgcccaggcatccgcgcgcaggcccggctgcgacagccggatgggcgtgcgctcgcatgccgcgcggtaggccgagtccaggtcgtcgagcaggatgcgccacgacacgccgtcgacgatcgcatggtgaatcgtcagatagagctgcgtcgagccgtccggcaagcgtgccgcgcatgcgcaggccagcggcccgcgaccgaggtcgaggcggcgctgcaacgcgtcgaagcgcgcgagcgcgtcggcttcgtcgcgggcggcgacttcgacgaacggcagcgcgtcgtacggtttcgcggcatcgctggcgtgccacgtgccgtccgcgccgcgtgcgaaacgctggcggaatgcgtcgtgatgcgtcagcaatgcgtcgaaggcgcgcgcgaacgcatcggcgtcgaacggcccgcgcacgtcgaatgcgaccgactggttccagtggcctgggcgcgggatgtcgagcgcgaagaagcgctgctgcgcgggcgtcaggacctgcgccgtcaccggtgcgccggcggcagatccgaccgcaggctgcgcgacggcggcggcggcagccacgtcctcggtcttcgcgatgcgtgcgagttcggcgaccgtcgggctgtcgaacagctgcttcggcgtgaagcgcacgccgcgcttgcgcgcacgggcgatcacctgcagcacgaggatcgaatcgccgccgagttcgaagaagttgtcgtcgcggccgacctgcggcgccttcagcacggcctgccagacttcggcgagcatcgtttcgaccgcgccctgcggcgcattcccgggcgccgtcgcgaccggcgcggccgcctgttcacgcaacgcggcacgatcgatcttgccgttcgcggtcacgggaaggcgtgcgagcgcgacgaactgcgcgggcaccatgtagtcgggcagcttcgcggcaagcgccgcgcgcacggcagcctcgtcgaaggtcgcgccgtcgcgcatcacgacgaacgtcgcgagccgcaggcggccatcgtgttcgatcgcgagcgtttcggcctgcgcgaccggcccggccgcacgcacggccgcactcacctcgcccggttcgacacggtagccccgaatcttcacctggtcgtcgatgcggccgaggaacgcgagacggccgtcggcgcgcaaccggacacggtcgcccgtgcgatacagccgcgcaccgggcgtaaacggatcgggcacgaagcgctcggcggtctgcgccgggcgccccaggtagccgcgcgcgacgcccggcccgcccagatacagctcgcccgtcgcgccggccggcacgcacgcgctgaacgcgtcgagcaccagcgcgcgcgcattcggcagcggcaggccgagcggcacgccgctcgcgggatcgcgcgcatcggcggcgatcgacgccgtatcgcacgcgatcgcaccgaccgtcgcttccgtcggcccgtagtggttgatcacgcgacaggccggcgcaagcgcggccaggcgcgcgacgagcgcccacgtcagcgtttcgccgccggtcacgagcgcatggcgcggcagcacgtcggccggcacgcgtgcgtcgagcagcgcctgcaggtggctcggcacgatcttcagcacgccgacgtcacggcggcgcatctcgtcggcgaacaggtccggatcgaacgcgcacgcggccggcagcaggtgcagcgtgcggcccgcgcacagcgcgccgaacagcgtcgtatgaccgaggtcggccgcgacggtcgataccatcgcgaacgatgcgtccggtgcgaacgcgagttcgtcgagcatcccctgcacgtagtcggccagcgcgccgtgcgacacgacgacgcccttcggcgtgccggtcgagcccgacgtatagatcaggtaagcgccctgttccgggtgcggcgcgacgcgcacgccggccgcgagcgttgcgtcctgcgcgagcgtgtcgacgtcgagcggctgtgcgtcgatgccggccggccacgccgcggtatccgcgacgagcgcccagcgcgcgccgcagtcggctgccgccgcggccagccgggcggccggctgcgcgggatcgagcagcacggcgagcgcgccggccttcagcgcgccgagcaggccgacgacgaagcgcgcggagcgttcgatgcagacgatcaccggcgcttcggcgcccacgcctcgcccggacagcgcgcgtgcgaggcggttcgatgcgtcgtcgagttcgccgaacgtcagcgacgccgacgcatcggcaagcgcgacgcgatgcggatacgcggccgcctgccgcgcgaacgcggcgacgatgtcggcatgttcgatgcgcagcgcacggccgtcgcgcggctggcgcgcagcggccgacgcgtcgcacggcaggacggccgtcgtttggtgcggatcgcgcgcggcggcaccgacgagcgccgcgtagctgtggagccacgcgcgcgcggtgtccgcatcgatgcagtcggtcgcataggccgcgaccagttcgatgccgttcgcatcgtcggtgaaatccaccgcgtagtcgaagcgtgcggcgagatcggggcccggcgtcgcgacggccgtcgcgcccggcagcacgctgtcgtgccgcgcgtcgaactgctgcgcgaatttcacgcgcagccattcgtcgccgcgcttgaccggcggcttcaccgcatcgacgacacgctcgaacggcacgtcctggtgggcaaccgcgtcgagcgccgccgtgcgcgccgcgtcgacgagcgcgcggaacggcagcgtcggcgtcacccgcacgcgcagcgcgaccgtattcaggaacaggcccagcagcgcacgcgtttcggggcgctgacgatgcgcgaccggtaccgcgaccacgacatccgttgcgccggtcaggcgcgacagccaagcgtcgagcgcggccagcagcaccgtgaagacggtcgcctgcgcgtcgcgcgcgagttgccgcacgtcggccgcgaccgcgtcgggcagccgcaccgacacgcgcgcaccttgcagcgtgcgcgccgcgcccggctggcggtcgaccggcagcgcgagcgggcccggcacgtcacgcaatgcgccgcgccagtaatcgagctgacgttcaccctcgccgccggccagcatgtcgcgttgccagtccgcatagtcggcgtactggatcggcagatcgggcagcgacggcgcgcggccttcggcatacgcgcgataggcggccgacagttcgtcgaacgcgcagcgcgagctccagccgtcggtgatcgcgtgatgggcggtcagcagcaggcggtgacggtcgcccgcgagcgcgaccagcgtcgcgcgcagcagcgggccgcgcgcgaggtcgaacggttcggccgcttcgcgctcggcaagacgcgcggcttgcgcgtcgcgggcggcgggcggctggtcgcgcaggtcgacgtcggcgatcgacaccggcaggtgcgcatgaatccgctgcatcaccacgccgtcgtcgttgtcgacgagcgtcgtgcgccatgcctcgtgccggccgatcacgtgatcgagcgcgcgttgcagcgcgtcgcgatcgagcgtgccgtcgatcgtccagtgcgcggcgatgtgatatgcggcgctcgcgtcacgcgtttgcgcgagcacccagaaacgttgctgcgcgagcgaggcggcacgatcgacgtacggcgcgcatgccgcggcagcatcggccgcatccgtcgtcaaacggcgcgcggcgatcgcggccagcggttcgccggtttcgcgttccgcacgatcgaccgcttcggccagttccgcgagcgccggatcggcgaacagcgtatcgagccgcaggttcacgcgtaccgcggcacggatcgcggcctgcaactgcatcgccgcgagcgaatcggcgcccagcgcgaaaaagcggtcgtcgcgcgacggtgcggcatcgaggccgagcagcgcctgccagaggccggcgagctgctgttcggtcggcgtgcgcggtgcgtcgccgccaccctgcgtcgtgtcgcgcgcggcggcaatcttctcgcgcagcgcggcacggtcgatcttgccgttcaacgtgtacggcagcgcgtcgcaacgcacgaaccggtgcggctgccatgcggccggcagttgctcggccacgtgcgccttgagcgccgcatcgtcggccgccgcgcgcagtgcgacgcacgcgatcaggcgcgtcggcccgttgccggtttcggcgaccacggccgcgtcggccacggccggatgcgagcgcaggcacgcggcgatttcggccggctccacgcgcacgccgcgtacctggacctggtcgtcgaggcggccgagatagtcgaatgcgccgtcgtcgcgcagccgtgcgaggtcgccggtacggtacacgcgcgcaccgggttcgccgtcggcatccggaatgaaacgttcggccgtcagcgccgggcggccgtgatagccgcgcgcgacgcagacgccgcccagcagcaattcgcccacgccgtcgccctcgccaccgtcaacgcgcgcgacgcgcgggccgatcacgcgaccgatcggcaacgacgcatacgcatcgtcggcggccagcacgggcgtctcgcccggttcgaccggccacagcatcggcgaaatcacggcctcggtcggcccgtaaccgttgatcaggcgtaccgacgggaaggtgcggcgcacgaattcgaacgcctgctgcggcagcgcttcgccgccgaacgcgagcacgcgtagcgccggcggcacgccgtcgcgcgcggccaccgcggcgaattcgcgcaggtacgcaggcgggaacgccgccacgttgaccgcttcgctcaccatcagcgcatgcgcggcatccggcgcgaacggctgcggcggtgcgacgacgatgctcgcgccggtcgcgagcggcgcgagccagcactcgtgcgcggcgtcgaaattgaccgacgcgaaatgcagcaggcggtcgccggcctcgatcggcagcgcggccgcgagcgcgtcgcagtgcgcggcgagcggcccgtgctcgacgacgaccgccttcggcgtgccggtcgaacccgacgtgtagatcatgtaggcggccgcacgcgggtggacgggcaccgcctcgtcatcctcggcgacctcccggccgtccgccgcatcggctgccgcgtcgaacgcgtgctcgaacggcgcgccgagcgccgcgcggccggccgcgtcgacgatgccgtgccgcagctgggcatcccggacgatccagtcgaggcgcgcggccggatggcgcgggtcgagcggcacgaacacgccgcccgccttcagcacggccagcagcgcgacgaacagttcgcacgaacgctcgacgcacacgcccacccgcacttccgcgccgacaccggccgcgcgcagttgccgggccagccgcgacgcccgcgcgtcgagcgcgccgcgcgacaggcgcaagccgttctggaaaggtgccgcgattgcaggtgcgtcgggcgcgatgcgcgccagttcgcggattaggtgatgcagcgcagtcgggaaactcgtcatgtgcgtgaagtccttcggtccggccgcttcggccaagtctcggggccgcttggggcggcttcactggtgtgacgaacggcgcggccgatttttaccgttttgtgcgcaaagtgcgggcggacgcttttttgaacgcgcggctaaatatttgcgcggcccgttcgtctatcagggaggaaagccgcaacggggccccgcctcgtccgccgctttcgcgccagctttgccgttctggcgttttcgcctgccttccctttaccgacgttgccgatgaccgctgcccacgagccttcttccccgccgtccctcgacgcctccccgcccgcccgcggcgcggctgatcctcgcgctgctgcgcgaaagccgcgcgtcgctcgcgctggcgctcaccgcgtgcgtgctgaacggcgtcgcgagcgtgctgctcgtcgcgacgctgaaccgcgcgctgtcgcagccgggcgcggccgacgcgtcgctcgcatggcgcttcgcgctgtgcgcggtgatcgcgctcgtcacccggatcgtgtcgggcacgctgttcgcgcgcctgtcgcaggacacgatggcgcggctgcgcgtgcatctcgcgcggcgcgtcggcgcggccgagctgcgcaacatcgagcggatcggcgcggcgcccgtgcagtcggtgctgaccgacgacgcgaccaacgtgtcgatgctgttcttcgcgctgccgaacctcgtcatgcacggctcgatcgtgttcggctgcctcggttatctcgcgtggctgtcgtggccggtgtgcctgctggcgctggccgcgatcgtcgccggctcgctcggctatcacaccggcgaccgccgcgcgatcgcgtcgctcgaagcggccggccaggcgcaggaccgcctgttcggctatctcggctcgctgttttccggcgcgaaggagctgaagctgcacgatgaacgcgcaagacagttcgtcgacggccagctcggcgccgcgatcggcgaagtgcgcgaccaccgccgccgcgcgttcagcgcgtacgcggtcggcgtcggctggatcatcttcctgttctatgcgttcctcggcgtcgcgtcgttctggccgcagctcggcgtgcatgccgatccggccgcggccgccggctacgtcgtcgtgttcctgttcatgctcgtgccgctcgacgggctgctgaacaacctgccgaccgtcaacgcggcacgcgtgtcgctgacgcggatcgaaggcgtgatggccgaattcggcgcgctgcgcacggtgccgcccgccgccaacgcacccgacgtgccgccggccggtgccgtcacgctgcgcggcgtcacgcatgcgtacttccacgaacgcgacgaacggatgttcagcgtcgggccgatcgacctgacgatcaggccgggcgagctcgtgttcatcgtcggcggcaacggcagcggcaagacgacgctcgcgaaggtgctgacggggctttacgaaccggaggaaggcacgatcgaggtcgacggccgcccgatcggctggcgcgagcgcgccgcctatcggcagcgcttcagcgcggtgttcaacgatttccacctgttcgatgcgctgctcggcatcgtcgatcccgacgatccgtcccgcgcgcaggccgatgcgcgcgcgaacgcgctcgtcgcgaagctcgcgctcgatcacaaggtgaaggtggtcgacggcgcgttctcgacccgcgcgctgtcgaccgggcagcgcaagcggctcgccctcgtcgtcgcgtacctggaggaccggccgttctacctgttcgacgaatgggcggccgaccaggatccgtcgttcaaggccgtgttctacgaacaactgctgcccgagctgcgcgcgcgcgcaaggccgtgatcgtgatcacgcacgacgaccgctacttcgatctcgccgaccgtttgttgaagctcgacaacggacgtatcgtcagcgacacgatgcccgcgcggtcacgcgcgcaggacggcgtcgacgcgctgagtgcgtaatccggccgtcgatgaaaaaatcgccggtgggctgcaatggcagcgcaccggcgatattcgtttcagaaggaaatgttggtggcgcgcggcgcgatcgtcgcaatgccccggccgtccagcgcgagtcgggtctaccgccacaccctgcccgcccgggcggcaatcgaccgccgcacactcaacgcacggccggcagcttcagcatcgtgtcggtcatcacgtcggccagtttcagcgccgacatcggcccgccgaaccccagatattgcgttcgatcagcgcgatccggcgttccttcatcgcgggaacgaaacgccacaccggcgaatcgagtttcgcggacagcggcacgtccatgcccgatgcggtcacgaacagcacggccagctcgcgctgcctgagcagatcggccgacgtcacgtacagcgtgccttcccgcgtcggtttcttcggccacggatcgagcccgagcgcccgcgcgaggcccgccgacgtgctgttgcccgtataggcccagtagcggtcgggcaagccgagatcctgcaacagcgcgatgcgctcgcctttcctgcccgcggccgcgagccgcgccgcattgcgcgcgatgcccgcatcgagttgcgcatcgaccgcctgcgcgcgcgcgtcgcgcccgtgaccgcaccgatcgtccggaagatctgccgcatccagtcgagctgcgttaccggcacgccgccatccgacacgttcgggctgaactggaacaggatcgtcggcgcgatccggtcgagcgcatcgaaaatcggcgcatgacggaagccgacgccgatgatcaggtcgggcttgaccgccgcaatcgcctcgaggcccggctcctggcgcgaaccgatgtcggtcacgctggcgagccggtcgctttgataaccgagccagcccggatagaacgccgtatcggccatcccgaccggcacgatgtcgagcgcgatcacgctttccgcgaacatgaaatcgagcgcgaccacgcgctgcggccgcaccggcatcgtcgcgctcgcctgcgacacgacgggattgccggccagcgataccgcgcccggtgcgccctgcacgcgatgtgcatcgagggccgcggcaacggcgccggacgaggccgacagcgcgccgcaacacgcggcgccgagcgccgcgattgcgccgatcgcgccgagtgcgtgccggcggccggcatccgtcaccggatcgcgtcctgctcggccagcgccgcgtcgtccatcgtcagtagcgggggcagcttccacacagttgcgtttctccaggaatttcatagcgcaggcagcacacgcgtcgcgcgcggaacggcgtgggcagcagcgccgaacgcggcaccgcgtcgcgcacaggcatgcgcaacggattcggttcgcacgcaaagcacgtcgcaccgaacagccagcccgcgtcgcgcaccggatcggccgcgcatggcagcgcacgatacgtatcgagcagatagtcgagcaggttgcccgcgttgctccacagcacgcgcggcgtgacgcgccccatcgccgtgagcaggtcgatcaccgcgccgagatgcgcgacgagccccgcgtagcgtggcgccgggtcgtcgcagggttcgccgagcgcatcgtgcgtgaaatacagcgcggcgggcatccgtcgtcgagcgcgacgaacgtgcgctcgggtgtcatgtcgagcggccggccgagcgtcagcgcggcgacgacgccggccggcgccgcgcggccgaaatagtatttgctccattgcgacatcagcgcgcgcgcgtgctgcgccggatcgccgccgtaatggcggaccatcgcgtcgagcacgacgtcgcggtacgcgggcaacgcgctgaccggcacgacgaggcggcccggcgcgtgcgcgtcgtcgggcaaaccgagccagacgacgtcgagatgatcggcgaacggttcgggcgcgaacgccgagaaacgcgtggcgcgcgcgccgtcgagcggcagcgtcatcgccccgcgcgccgggcgcggcgccctcgaggatcaggagcccgagcaggtacggcgcgccgatcagcgcggtcagcacgccggccggcacttcgcgcggcgcgacgaccgtgcgcgccgcgaggtccgccacaccgaggatcagcgcgccgcacgcggccgcgagccacagccgcgtacggtgccggcgcgcgccgagcatcgtcgcgacgtgcggcgccatcaacccgatgaagccgaccggcccgaccgccgcgacggccgcacaggcggcgagcgtcgcgatcgtcagcgcgagcggccgcagcacggccaccggcaggccgagcgcggccgcctggtcgtcgccgagcgcgagcatgtcgagcggtttcgcgagccacgcgaacacgggcaccgcgagcacgcaccacggcagcagcatcgacacctcgccccagctgcggccgtaagtcccgccgacgagccacacgacgaagcgcgcgggctgcacgctttcctgcgtgatcagccattgcgcgagcgtggtccacaacgcgccgatcacgatgcccgtcagcgccaccgcgagcggcgcatagcgatgccggtgattcagcgcgagcgtgatcgcgagcgacagcccgccgccgatcagcgcggccgccgcgagcgtcacgtggcccatcagcggccacgtcgacaacgcgaacagcgtgacgagccccgccctgcgtgacgccgagcacttcggggcccgcgagcggattgcgcgacgctttgcatcgcgaccccgctcactgcgagcagcgcgcccgcgaggagcgcgcacagcagccgcggcatgcgcaggtcgatcagcatccgcgcgagcgcatcgtggccggacagcgcagcggaccagcgcgcgatcgacagccactcggggccggccgacacgccgacgaacacggccagcacgcccgccgcgacgaacagcgccgtgcgcagcggccagccgagccgttcgagccagccgacgagccgcgtcgagccgccgcccgccgcgcgttcggcatccgcatgcagcacgcccgaccacgcggcgccgcgccggatcatcgccagcatcagcggcgtgccgaccagcgcgatcgcgacgccggtcgacagcgtggcgtcgagccccgacgcgagcaccgcgctgtcggtgacgagcacgagcgcaccgcccgcgagcgccgacagcggcacgagcacgccgagccgcgcggcgcgcgcgccgcgcctggcgcagcaggttcggggcgacgaggccgacatacgacagcgggcccgcgatactgacggccacgctcgtgaacgcgaccgcgacgatcgtcgcggcgagccgcgtcgcgtcgacgcgcacgccggccgcggccgccgcgtcgtcgccgagcgtgagcggattcagcggccggatcacgaacggcaatgcgatcagcggcacgacgagccagcgcgcggcgagcgcgagcccgtcgcgcccggctggtacaggctgccgttggtccacagcgcggcgcccgcgatgttctgctcgaagaaggcgagcacgagcgtcgacagcgcggcgaacagcagcatgcacgctgcccgcgagcacgagacgcaacggcgtcgcgcgccagccgccggccgcgacgatcgcgcaggcggccgcggccagcccgcacacgaacagcagcggcaccgatgcgacgccggccagcgccggcacgagcatcgccgcgagcaggccgagctgggcgccgcccgtcacgccgagcaaatcaggcgacgcgagcggattgcgcgtgagcgactggaacagcgcgcccgcgatgccgaggcacccgcccgcgacgagcgcggccgcgacgcgcggcaggttgaggtcgaacaggaacacgtgcgcaagcgcagcggcatcgctgccgggcaccgcgctccaccacacgcgcagatcgggggcgacgcgcaacgccgccagcgccgcgatcagcgcgacgaggccgatcgcgatcgcaccggcccggcccgatgtcgtgcccccccgccgccgccgctgcgcatcgcgaacgtggtcatacggcgagatcccggtcgaagacaccggccgcctgcggcgcgccgtcggttgtcggcccgtaggccggcacgcacatcggtgcgcccgtctgcggatgcgcgagcttcagcatctcgacgccgaacgccgcgcgcagccgcgccggatcgagcatcgcgtcgggcgtgccctgagcgacgaggcggcccgcgcgcatcagcacgatttcgtcgctgtatgcggccgcctggttcaggtcgtgcagcacccagacgatcgtcagcccgcgcgtgcggttcagcgtgcgcagcgcatcgaggatgtcgagctggtgatggatgtcgagataggtcgtcggttcgtccagcagcacgatcggcgcctgctgggcgagcgccatcgcgatccacgcacgctggcgctcgccgcccgacagtgcgccgacgtcgcgctccgcatcgccggcgaggccgctcgtgtcgagcgcctcgtcgatcgccgcatggtcggcccgcgacaggccgcgcaggaagccgccgtacgcatagcgcccgtacgcgacgagttcgcgcaccgtcaggcccgacggaatctggttgaactgcgcgagcatcgtcagctcgcgcgcgagcgcgacggcgaaacgacgcgagcggctgcccgttcacttcgacatggccggcacgcgcgggctgcaagcccgcgagcgtgcgcagcagcgtgctcttgccgcagccgttcggtccgcacagcgcggttacgcggccggccgcgatcgacaggtccagcccgtcgatcacgacatggtcgcgatatcccaccgacagcccgcgcgcggcaagcgcggtactacgcgtcatcaatcctccgttcggtcgcgcgggaccgtataactctgcgccatcgcgacgacgaccttgcgcggcccctcgaacgggtcgcgcgcatgcgcggtcagcatgttgtcgagcatcagcacgtcacctgtgcgccacgggaacacgatgcgctgctggtcgagcacgccgcggatctccgcgagcgcgtcggcttcgagcggttcgccgtcgccgtaatacacgttgcgcggcacgttctcgagcccaaccgcgtcgacgagcgcttcctgcatgtcgtcgtcgagcgccgacaggtgaaacaggttcgcctggttgaaccacacgcggtcgccggtgcgcggatggcgcgcgacggcctggcagcgttcacgcgtgcgcagcagcagctcgccgtcatcatcggtgcgccacgcgcattcgatgccgcgcgccgcgcacatccgttcgacctcggccggttcgtcggtgccgaacgactgctgccacggcaggtcgagcccctgcccgaaattgcgcacgtacagcagctcgcgcttctcgaaacgcgcgacgagcgccggatcgagcgcacggtagacggcacggctgtccgcgatcggcgtcgcccgcccttcggcgcggcgagcgcgcagtggaaccagatccgcagcggccattcacgcgtatcgactgctcgttgtgcagcggaatcgcgcggtgcggcggatactcggtcgacgtgtagacggcgccctcgacctggctgcgcggtgtcgatgcgtattcatagccgatcagcggatcgccgaacgacgccgcgaactgctggaacgcgtcgatcgacggcacgtgaaaacccgtgaacagcacaccgcccgcccgttcgagcgtgtcggccgcgatctcgcgcgccagcggcgcgacgtcgtcgatcgacatccgtcgctgccgcgcggcgacacgacggtgggcagccccggctcgatacgcaggtcgtcgagcgtcggcaacgaaagcagggtcatgcaacgtcctcttcaggtggcgcgccgcccacggcgcgcgcgggtcacgacgcgcgcgatgcgcgctcgccgtccatcgcgcggcgcaggcttgcggggcgcatatcggtccagacggtctcgatgtgcgcgagacagtcggctttcgggccgctcacgcccacttcgcgccagccggccggcacgggccggaacgtcggccagatcgaatactgttcttcgtcattgatgacgaccgtatagacgagatcgtcggtgtcggcggaaggcgtcgtggcttgcgtcatgatcggaaatcgctgaggcggttgaaagtggcaaagcggatggcaaagcggcgggttcggccgctcctgtctgatagacgattggccggcgcgtttttacccgcgcttaccggcgccgcgtgcggccgcccaggaacaccgggcacgcgacaccgcgatggcatgcgtcgaggcattccgcgcagtggcgctccgcgtcgcgcaccatgaaatgcacgagcgtctgcgacacgttcagcgcgcgcgccgcggtctgcagcgtctcctcgcgcagccgcaccatctcgaaggccgcgcggctgcgcccgcaggtcgtcgagcgcggcccacacgcgccgcagcgtatcgcgcgtcagcagtgcggcttccggcgtcggctcgggcgacggcacgtcgaagccgtcgtcctcttccgtgtgatagacgttctcgaggttttgccggcggcacgcgtcgatcgacgcattgcgcaccatccgcgtcacgtacgcgaccggctggcgcaccgcatcctggttcgggaattcgacgagcttcacgaacacgtcgtgcacgacgtcctcggcacggctcgcgcagccgacgaagccgcgcgcgacgttcacgagcatcgcgcgatgcgagatcagcacgtcgagcaacgcaccttgcgcacggggctccgtggcgggcgcgcacgcggcggccggtcgggatgactgccgaggaacgggttcgccgctgccgccgccggtcggtcgagcacttccgccatcgccatcgatctgctccgtcaaattccgagatagcgcaatttaacgtaaacgcaaatcattctcaatctgattacccaatgaccctttcagtcgacaggatttgtctgaacaattgacgaaatcgttgcccgggtggagggacgcacagcggctggttcggtacgtggtcatcggctaatccgaacggcgcgaccggcctgcgacccaccgacacgacctttcacgcgtctgacaacgcgcctgcacgtgtcatgtgcggtagcaacttcttactacgtgaaattttgggggctcgtacgatcgggggctgtttcaagggagaaaaccatgaaatccatcgtgttgtccgctgtcatggctggcgcgctgtcgagcgtgatgctgaccgggtgcgttgcctatcccgccggtccggctcaggtcacgatcggctggcatggcgatcgttactgggacggcaatcgctactgggagcgccgcgactggaagcgcagcatccccgcggatatgacgaccgccgggacgaccgacgcgatgaccgtcgggacgaccgacgcgacgatcagcggccgcagtggtaaggcgttccctcttcccgtgattcacttttcaacgatcaggactgcaacatgaaaacgctactgaaatcgctcgccgtcacggcgctcgccgccgccgtgctcgtgccggccatcgccgaagcgcatccgcaccgcgtgtgtcacttcgaccatcaccatcacaggatgtgtcgctgggtgcggtacagaaacaaggcgccggaaaaccggcgccttgtttcatcgcttcacctgcgtgcgaccacgctcgttagcgcgtggccggcaaccgcggcaggcatcgcgcgagctgcgccgggctgacgggcatgcggcacgcgcttcgctgcatcgctgcgttcggcttcgccgccagcatgcgtgacgccgccttgagcggcgaagcccgcacccgcaatgcgtcggcgcccgggctcgccggctgcaacgcgcgcagggtcgccgcatcgatgtgcacttgccagaactgcggccgatagtcgggatcgccgtcgcgatagccctgccccgtgatggtctgcccgtcggggctcacaccgatcacgttggtcaggttcagcgtgccgaccgacaggccggccgcttcgagcaacgcaacgaggctgcgcatgccgctttgcggcgtccacacgaacgcgctcggcaccggtctgcccgttgctcgatgtgccgatgacgacccgcccgtccgtgctgatcgataacgcgtagctactgtcgtcgccgtcgagaaaaccgagccgctggatgctgtcgccgccgttcgtccacagcacggcctccgagtcgacccgttgttcgtccggcgtgactaccagcgtgccgagcgagccggcgatcgtccgttcgtcttcggtcacgccgcgggccatatccattctcgccacgcccgcgttgatcgtcggcaatagtcgttcaccgattcgttctgtccaaaggagcgcacgcgagccatacacgccgtcgacattgccggcgaaccctgctgccgcattcccggacgaggtcatcgacaggagctgcacgccatagtcaccgcccggcggcaactcgcggaaacccctcggctggtcccacatgaaccgtgcattccggccgtctgtcgccgtgaagctgcccgtcatcctcgtgccggcgaggttcgcgacttcgaccgatgcgtcccggcccgccgtatccggaacgagtttctgtgtgcgaccgtcgccgggccatcgcaccgcccatcgatcgaggttgctgctttccggctggcgcgcactgatcgagccgccgatcacctgcccgtcgcccgacaccgtctgtgccagcgagtcataggcgttcgccggcgcggccagccgttgccagcccgtcgcggccgaccacgagaaggccatcgagttaccgggctgcgcgtcgctccagtaggagccgatgatcgtcttgccgtcggcgctgacggcattcccgttgtaccgcatgtcgcgcggaccacccaggtcaccgatcacggtcagcgaatacccccgccgataccgtctgtgcgtgagccgcgcccaccgtcgaagcaacgaacagtgtcgctgccatggtgcccttcagatgcattttcatctccccaataagcgctcgatcgtcgccctgccagggcctcgtgcgcgtcagtaaataaacaagcggatcgtcgccgttgcgtcgaaccttccgatcttcggtggtccgaacgacttcagcaccgcgtccatcaacacgctctggttcatgacgttcgacgggaattgcgcgagcgtgaactgttcgttgaatggaatcgccttaccctggctgtcttcgatgccgataccgaaattgctgtccgacgcgggcaccagcaaaccgttccgaaccggaaagctcgtttcgaagtacccatcgaccttcaccgcgacattgcatttcttggttagcgacaacgagaagcgtttgcgcggcaccgccggcagaaagccattgccgaccgactgtacctgcccgaaattgacgatgcccggttcgggcgtcaccagcacgtcgacgaagcacggtgtcggcgagattgcgcatgccgctcaggcggtactggaagctcgggtggatcgcattcagccccttcgctccgtcgaactggaataccgtgtagatgtcgctcggcggttgcgtccacgagccgcgcttgcggacgaccacctgataggaaatgtcgataggcaccttcgggcattggccccatgccagttttcgtcactgcacgccggtaccgtcttgcccgtcgccacgccggtgccaggctgactccccgcgccaaagtggtcctgtcccaggtaccggatgccgatttcgagcccccaggcagccgggttctgcttgttcggattcgcgtagaaggagatcggatcgtcgatgtcgatgttgcccttgccgcccagatccttgaagcaataccccgtcgtcgtgcgaaccggcgacacccagatcacgtagccgtcaggtgcgtcggtcggataggaggcgacaccgccgatcgattccgtcatcgacgtcgcaccgctgctggtcacgcagcgtacggcaaacgccggctgcatggcggcgaccagcaccgcgaagatcgccaggcgcagccgacgccatcgtcaacatgcgggggcctgtcgtccgcccccgctcatttcttcacgctcttgcaagcaccggcctcgcacgcatactcgaccgccacctggccgccgtaatcgtcgatgtgcgtgacgaacagcgtcgcgggcgtcgcggccttgaacggcacgtcggccgtgctcatcgggctgaccatcaccggctccagcggcacgtgcgtcttctgcacacccgccgctacgtcgacgatcgtgatgtgatacggcgtcggattgtcgaacacgagcttgtgcgcggccgcatcgacgcgcaacgtcatcggcagcgtccagtcctcgtcgcgcgcgggctgcacggccttcggccggtagaacagcttcatctgcgtatgcagcgcgatctgcagcgtgttcggcgtatcggtcttcggcggcacttcgcggatgttcaggtagaacaccgattcgcgatcggccggcagctcggtgcccggcagcttcgcgatccgcagcacgttgcgctcgttcgcctcgacgcgctgcaacggcggcacgaccatcagcggcgacgtgatcttgttgcccttcgcgtcctcgagccacgactgcacgagatacgggtacgtcgtgctcttgttggtgatcgtgacgaccgccgcctgttcgccttcgttgaagatcacgcgcgtgcgatcgggcacgatcgccgcctgcgcggcgcctgcgaggagcgcaccggcggtcgcgagtgcgcaccatgcgcgccgcgaaaaggaaaggagaaggagtttttcatcgctggatccgtgaattcatcgttcgacccgtgcggccgctgcatgcgactcaccgggcgtctggcacgtcaccggaatcggcgtgccttcgagttggagctggttcggcagcgtgtcgatcgtgcagagcgtgcgttcgcccgcgcgcaccgccagcgtggatttcggttgaacctgggtcaggaacgccgcgccgccctcgccgacgatgccgagttccttgccgttcgctatgtcctgcaccgatgcgccgaacggcagcggcttgccgaccgggtcggtcagtgtcaggtacaggttgctgccacgcgcggcggagaacttcacgaagccgatcgcgccgtcggtcagcaccatgcgctggatcgggttcgacacctgcacctcgagcggcagcttctcgacgttgaccgtcgcgtcgtagacgttgtacggcgagatgccgtcgagcaccgtataaccgcgcgaatcggtatgcgagagcgtgccggacagcggcacgtcgggcacgccgtcggtcgacaccagcaaccgcgtgtcgcccgcgttgccgttcgcgtgcgccgcgacgccgtattgcgtcgcgacaaacgagccgtcgacttcgagcgacgcggccgcatacgcattggcgagcgtcgacgcctgcgcggtcagctgatacgccgacgagcgctggcggtagctcgcgttcgccgacgcccgtccgtcggtcgcgcccgcgttgacctggtaggtgcggccatccggatcgtcgtagatataaccggcgttcacgctcgtgctgccgctgcccgtcgtcaggttcgacgtgacggtgtggcggccgccgatcggcagcgtcgcggtgaccgagacctggttgccgcttgcaccggcgctctgcgtgcggaacgccgatacgctcacgttcaggttgcgcagcgtgccgatcgagaacgcgcgcgtcagcgtgaggccgacgcgctgctcgttcgcacgttcccagtaggtcgtctggtcgtacgagaaatacgtcgacgtgtcgccgaaacgcttcgacagcgtcgccgagtagcgctgcttgctgttggcgaggccgtacgcggtcgggtcgcccgagaactgcgcgaagttcgtgtattcgcgctcggagaagcgataaccgaagaaacgcacgtcggcatcgagcccgtcgaagtgcttcgaatagttgatgcggtacgagttgccgttgcgcgtcgcgccgttccaccacaggcgtgcccgcgcatgcgtgacgtcggccgacagcgcgccgaacgcgccgaagtcgcggcccacgccgagcgcgatcgacgtgtagcccgacgcggcgatgaaaccgccatacgcggtgacgtcgaacggcaggccgtaggcgatttcaccgaagccgaagaacggcgtgatgccggcgccgccaaagagccgcggcttgccgacggcggcgtagcgcaattgcccggcgcgcgcgaggaacggcacggcggccgtcgtcacctggaagcgctgcacgctgccgtcctcttcctcgactgcaacgtcgagcgtgccctgcacgctcgtattgatgttctgcagcgcgaaggcgcccggcgacacgcgcgtcacgtacaacacacggcccgcctgcgacacggtcaccgtcgcgttggtgcgcgcgacgcccgagatcagcggcgcatagccgcgcagcgaaggcggcagcatgcggtcgtcgctgcggatcgacgcgcccgtcagcgcgaacgtatcgaaaatgtcggacgtcaggtagtcgtcgccgaacgtcaccgtcgactggatcgacggcagcgcgcgaaatgcataaagccggctgaagcggaacgtgcggtccgcgtaggccgtattgcccacgttcgattgcgcctggtagtcgccgcgaaagcgccatgcatcccagttcgcgccaaccgtcccgtaggcctggatcgaattcgtttgcccgccacccgtgccgaagttgcggttcgtgttcgcgatcacgcgatagtcgagcatcgcgccggggatcccttccgaccagcgctccggcggcaggtaggtcgtatcgttgaactcgagcgcagcctgcggaatcgtgatcttgagccgcccgtcgcttttcaggtagcgcacggtcgccccctcgatcgcgccgagatcgacgcaacgtccgccctggaagcgcggcaggtccttcgcgagcgacggcttcagcccgaactgcgcgacgagttccgggcgcaggcacggtttgccggcccccgacgcgtcgacggcgatgaactcgatcgcctgcagcccgtagaacaggtcgttgacctgaacgtcgagcatgtactcgccgggcagcgtgaagtccgcctgcgagaactgcgacagatcgacgttgttcgagccgtcgatgctcaggaacgacgaattgaattccgtcgcatggctctggctgccgacaaccagcacggagacgcaaaggaaggaatgtctgattcgcacgcggcgctaccggaagtccaacgaaggggaaatgaggaaatacgaacgaggaagggtgcgcgcacccttccccggtacggcggcttactggtagcggacggtgaagttcgccacgccttcggcggtacccggcgtcacgccggctgcggtcgcttcgtacatggccgcgaagcgtgcgacgttcgtgccgttttgcagcacggtcggtgccttctgctcggcgccgttgtcgaggtattcgcccgacgctgcctgcaggcggatgccgacgttggttgccgaaccgatcgtggcgagcagcttcggctggcccgcgctcgacgtgcccgtgaacgtgaagtacgcgttctgcgcgacgctcgtgtcgcagtcggtcagcttgatgtcgaagttggtcggcgtggacttgtcgccagcttgcttgaacacgttggtcggcaccttgccgaggttcacggtctggttgaccgagcccgaatcgatgccgcatgcgcccgcgacgatctcgcccgtgaagttgatcgtgccggtgcccgctgcgaaggccgaggtcgacagggccgcgagtgcgacagcggtcaggatggatttttcatgacgtttcccgaaaggactgcaaatggaatagatgacgtggcggacacaaacggtagcgtgtggtggctcccgtccgtcacgaggcggcattatcgagataatcgtgaaagttttctgtaaatcattgtcaaatgcatctgacaatgtccgatttaccctctagatccgcactatttcccgtcaattttcaatcccggaatttttatccgcagtcctttttattcttcggaaacaattgaagattaaggatattttcgatcgataaccacaacctccccgcgcacccttgctggcattggctccggcaaatcatcctcgaaaaggacaaaacattgtccatagccgccatcgttgtccgacgacaacgccaatatcaaatcattttcaacaaacaggaaattaaccggcgattcaatcaatacaatttttcgcgcaaacgattgcgacatgaatacaaacgttttaccgcgacactttgccgccctcattatttccgatatatggttaattcgtttgtcaattccggatcgtaaatcgcacgcatgagcggtcgccggaacccgacatcgggaccgcatcgcatgggagaaagaaggcaaaatgacccgcacgtttgcgcggaattgcgacacgagcgatcgcaagacgacggctgttccgcaacgcgcacgcgcgcgttgccgcaggatgaaaaacgtcccggccggcctgtcgatggggaaagatatcgctggaaccagcggtatggatcgaaggaagcggcggcagcacgtcgaaacgtaccgccgtcatgccgcccgacgcgctgcggcgtcaggcgacgggcattacgcggaagccgcggcctccgccgacgccggcgaccagccgccgccgagcgcgcggtacagcgcgatcgcattcgcgagcctgagctgcttgagccggatcagttcctgccccgactcgtacgtgctgcgctgcgcgtcgaggagttcgagatacgtcgcgacgccgcccgcgtagcggcgctccgcgagcttcagccgcgcgccgtcggccgcatacacgtcctgctgcgcggcgagctggcgatcgatccagtcgcgcgcggcgaatgcgtcggccacttcgcggaacgcggtttgcaccgtcttctcgtaatcggccaccgcgatgtgcttgcgcgcgttcgcgacgtcgaggtttgcgcggttgcgtccgcccgcgaagatcggcaacgtgatgcgcggcgcgaacgtccacacgctggtgccgccggcaaacaggctcgagaacgcatcgctgaccgagccgtagtcgctcgtcagcgtgatgcgcggaaagaacgccgcgcgcgcggcgccgatctgcgcgttggcggccttcagccgcgcctccgcctgccggatgtccggccgccgttcgagcagcgcactcggtgcgccaggcgccacgggcgcgatcgacagcccgtcgagcgcggtcgtgtcgccgggcacgttgcgcgcgaagtcgcccgcgagcaattgcagcgcgcgcaccgactgcgcatgctcgcgctgcagcgcggcctgcgcgcgcggatgccaccagcatctcggccgagcgcagctcgatcgcgtcgctcgtgccggccgcataacgacgctgcgtgagcgcggccatgcgttcgcgcgcgtccagcgtgcgctgcgccagcgcgagctgctcgtgcagcgagcgctccgacacgtacgcgcccgccacgtcggcgatcacgccgatgcgcaccgtgcgttgcgcgtcggccgtcgcgaaatactcggcgagtgccgcatcggacaggctgcgcacgcggccgaacaggtcgagctcgtacgcgctgacgccgacgcccgcacgatacagcccgctgatcgcgctttcgcgcacgaccgggtcgtactggcgcgcacgctcataacccagattcgcatcgaccgacggcatcaggtccgcgcgctgcacgccgtacagcgcacgcgcttcctcgagccggccggcggcgacccgcaggtcgcggttgttcgcgagcgccgcgtcgatccacgcctgcagcgcggcatcggtgaagtacgtgcgccagtcgtcgagcagcgcggcatcggcgggcgatgccgcggccgccgcaggcgcggcactgtcgtcgaccggcgcataggtcgccggcacgggcgccgccggccgctcgtaacgcggtgcgagcgtgcagccggccagcgcgagcgcggcggccagcgcaacctgaacccgcagcgctgcctgtgcattcagcgcaaacatcattgagaaccctccatcgccgccggctgcgctccgccgcgccggcgcgggccgacgtcgaacaggcggccgacgatcacgaaaaacagcggaacgaggaacaccgcgagcacggtcgccgtgatcacgccgccgagcacgccggtgccgatcgccatctgcgcgccggacgcggcgcccgacgcgaacgcgagcggcagcacgcccacgccgaacgcgagcgacgtcatcacgatcggccgcagccgcaggcgcgcggcctcgagcgcggcgtcgacgagcgacatgcgctgcgcgaccaggtccttcgcgacttcgacgatcaggatcgcgttcttcgcggacaatccgatcgtcgcgatcagccccaccttgaagtagatgtcgttcggcatcatccgcagcgtgacgccgagcaccgcgccgatcacaccgagcggcacgaccagcatcaccgcgaacggaatcgaccagctctcgtagagcgcagccagcgcgaggaacacgacgagcaccgacagcgcgaacagcatcggcgcctgcgcgcccgacagacgctcctcgaacgactgccccgaccacgcatagccggtgccggccggcagcttcgccgcgagttgctcgatcgcggccatcgcctcgccgctgctgtggccctgcgcggccgagccgttgatcgtgaacgacggaaagccgttgtagcgcgtgagctgcggcggcccgagcgtccagtgcagcgtcgtgaacgccgcaagcggcaccatctcgccatgcgagttgcgcacgcgcagcttcttcacgtcgtccggatcgagccggtgcagcccgtcggcctgcacgatcacgcgccgcacctgcgtgccgtgcatgaagtcgccgatatagtcggagccgaacatcaccgcgagcgtcgtgttgatctcatccatggacacgccgagcgcggacgccttcgcacgatcgatgtcgagcttcagctgcggcgcgtcctgcgtgccggcgaacatcaggtcggtcagcgcgggatccttgcggcccgccccgagcagctgttcgcgcgcggcgctgaacgtcgcgtagtcgagcccgccgcggttctgcagccggaagtcgaaaccgctcgacgagccgagatcgggcagcgccggcgagttcatcgcgaacaccgtcgtgttcggcgtgcccgcgaagcgctcgttgatgcgcgcgacgatcgcctgcacgtgcgcgtccgcggccttgcgctccttccagttcttcagcgtgacgaagatcatcccgccgttcggcccttcgccgtacaggttgaagccgccgagcgcgaacgtatacgcggccggctcgtcatggcggatgtacgactcgacttcccgcacgctctgcatcgtttccgcgagcggcgtgccttgcggccggatcaccatcaccatgaagttgccctggtcctcgtccggcaggaacgcggtcggcagttgcgtgagcatcagccccgcggccgcggtcagcgcgccgtacacgacgagccagcgcaccggcttcttcagcatcttgcccacgcgcgtcgcgtagcgctgcgtcgaacgcgcgacgaagcggttgaaccagccgaagaagccgcgcttctcgtgatgttcgccggacacgggcctgagcagcgtcgcgcacagtgccggcgtgagcgacagcgcgaggaacgccgagaaaccgatcgacaccgcgagcgacagcgcgaactgccggtagatgttgcccaccgcgccgccgaagaacgccatcggcacgaacaccgacgtcagcaccacggtgatgccgacgatcgcgccgctgatctgcttcatcgccttgacggtcgcgtcgtacggcccgagcctcctcgaccatcagccgctcgacgttctcgaccacgacgatcgcgtcgtcgacgaggatgccgatcgcgagcaccatcccgaacatcgtcagcacgttgatcgagaagccggccgcatacatcacgccgaacgtgcccgcgagcgcgaccggcacgacgagcgtcgggatcagcgtcgcgcgcaggttctgcatgaacaggaacatcacgaggaagacgagcacgccggcctcgatcagcgtcgtgacgaccttgttcatcgacacgcgcacgaacgacgacgtctcgtacgggatctggtacttcacgcccggcgggaaatacgcggacagctcgtccatcgtcgcgcgcacgcgcttctcggtggataccgcgttcgagcccggcgcgagcttgatgcccatcccggtcgcgaccttgccgttcacgtacgacgggtagttgtagtcgttgccgccgaactcgacgcgcgcgacgtcgcgcagatacagcgcggagccgtcggcctgcgtgcgcagcgcgatcgcgccgaactcggccggcgtcttcagcggcgcatcggcgaacacggtcgccgcgatcggtgcgctcgccggcaccgcggtgcggccgatgtcgccgatcgtcacgcgtgcgttgtacgcgcgcaccgccgacgcgatatccgacgcggtgaggccgtgcccggccatcttcaccgggtcgggccagatccgcatcgcatattcggcgccccagaactgcacccggccgacgccgtcgacacggcgcagcgcctgcacgacgttcgccgacgcatattcgccgagctgcacgtcggtcatccgcccgtcgtcggatgtcagcgacaccacgagctggatgttgtcggcggccttctcgacctggatgccgtcgcgccgcaccggttccggcagccgcgcatcgaccgtcttcagccggttctgcacttcgacggccgcgagatcggcgttgacgccctgcttgaacgtcaggtacagcgacgccgcgccggcgctgctcgtcgcggacgtatcatcagccccggcgcgccgttcatttcgcgctcgatcagcgcggtcaccgattcctcgacgacctgcgcggatgcgcccgggtacgtcgcatagatgctgacgacgggcggcgcgatgtccgggtactgcgcaacgggcagcgagcggatcgcgaatgcgccgcccagcatgatgaagattgcgatcacccacgcgaagacggggcgatcgatgaagaaacgtgccatggtggtgtggtgttaaccggtcaggtttgacgggcggccgcctgcgaagcggccgctgccggcgccgctttcgacggcggcgccttctcgacgggcttgacggccgtatcgggcgcgaactgcgcggcatcgtcgacgatcacgcgctcgccgcccgcgaggccgcgcgtgatgcgccagtcgtggccgctcatctggtcggcggcgacctcgacgtccttgaccttgccgttcgtgccgaccacgcgcaccgacgtgcggtcggccgtgcgcagcagcgcatcgcgcggcacgaggatcgcccgctggtcgaccgccgtgtcgagcgcgatccgcacgtacgcgcccggcagcagttcgcgctccggattcgggaacagcgcgcgcatcgcgacggtgtcggtggtcggatcgaccgcgagatcgctgaacagcagcttgcccttcagcggatacgcggtgccgtcggcgcgcagcagcgtcaccgtgatgtcgtgctgcgcgatacccgtcgcgcgtccgctcttcaccgcccggcgcaacgcgtcgacgtcggcggccggctgcgagaagttcacgtagatcgggtcgagctgctcgacggtcgtgagcggtgtcgcctggtcctggccgacgagcgcaccctcggtcacgagcgcgcgccgtgcgcggcccgcgatcggcgcggtgaccgtcgcatagtcgagctgcaactgcgcccgtgcgagttccgccttcgcggacgcaacgtcggccttcgcctgcgtgtcgccggcaacggcctcggtgtggtcgcgctcgcttaccgcgcgatcgcgcacgagatcgtcgtaacggcggcgcttgtcgctcgccgcgagcgcggcggcctgcgccttcgcgagcgccccctgcgcggcgtcgcgcgcggccttcagcggcgcgggatcgatgcggaacagcaccgcgccctgcttcacttcctggccttcctcgtaggtgcgtgcggtcacgatgcccgcgacccgcgcgcgcacttccgcctgccgatatgcatcgagccggcccggcaattcgacggtcatcggcacggccgtcggacgcaccgtcacgaccgtcgcctgtttcgcggcctccggcgcggtgtccttgtcgccctttccacatccggccagggccagcacggccgccagcgcgaacggcgccagccggtggcgcaacagggagcgattgttattcatatgtgacctcggatcgttcgccgccgatacaatgcggcggctcagggtggccgattataatcagtcacgattgattaaatacacgccgcttcaatctgaccgtcatactgtctcaataaaacgacagcgaactgtaaggaatttcaggacatggcccgcaagacccgcgaagaatcgctcgccatcaagcaccggatcctcgacgccgccgaactcgtgctgctcgagaaaggcgtcgcgcaaaccgcgatggcggatctcgccgaggccgccgggatgtcgcgcggcgccgtctacggccattaccgcaacaagatggaagtgtgtctggcgatgtgcgaccgcgcgttcgcgcgcacgtcggaaggcttcgacgcgggcgacgggctgccgccgctcgccacgctgcggcgcgccgcctcgcactatctgcaggaatgcggagagccgggcccgatgcagcgcgtgctcgtgatcctctatacgaagtgcgagcagagcgaggaaaacggcgcgctgcagcgccgccgcatgctgctcgaattgcagatgctgcggatcacgaaggcgctgctgcgccgcgcgatcgcggccggtgaactcgccgccgatctcgacgtgcatctggccgccgtctatctcgtgtcgctgctcgaaggcgtgttcgcgtcgatgatctggaccaaccggctgcgcgg
